United States Patent 11,001,841 (CCCTC-BINDING FACTOR (CTCF) RNA INTERACTOME) - sequence listing, part 38

SEQ ID NO: 91098 - DNA, 1503 bp, Homo sapiens
ccctgagcaaaggcatgtccaaaagcagatgagatgtcaacttgctgtgaaagaggcccattagctctgtaaatacagagcgtatcttagttctttgcacttgtccagtaaacactacaaaggaatgtgtggaagtgcgtcaggctttgatgggtaaaagacttgaaaagcaaccgcagtaccccaaggcgattttaaaactctgtgaagccagggtttgggggggttcggtggcagtggctcagtgcttctctgtatcgtgtgtacgttgtttattcaggaaggtagggagcagcagtatagtccatctgatgttttcttagcagcggctctcaagtagatttaggactgcagaaggagcagcttggaaggctctgcagtctgtgcagcctggtcaacgggagggcacaactggagaccatgccaggcctggctgccatgctatgttgtgtcttttgttaagaatgtagctgagggctaatgtaactgagggctactgctgtatcacatcctgtgactttgtgtgtcaaaggggaaggaacttttaaacgtctatctgttagaagctatgctggctgcttttatgtatcttttgtttactcctcacagatacaaggtagatgttacgaaatccacctagaagatggacctggggctgaggtgcctgcccaggggcaggatctgaacaaagatcttctggctttgaagtatctgtttgtttcatgtggtggctgttggtggggggggcttctgccgtcagagcctactctccatgagaggtgggcagaaagggttatatgcctagagaaccagggagaaacagttgctcttcagattagagaagtctctgtcaacacaactcctttgttaagggaattttcagaggatttagagtaagttgatttgtctccctttatgcccctggattttccaacttaaagctctgccgctggacggagtggtgcttcagaatctcagtgtggctggacggtcaggagactgcactttgggatgctgcctcacatccagatccttttggctccctgtccacttcagcggccatagtttactctccgcgccactgctctctaaagacacactggctggtctgcggacatcatgtgctagcctctgcctcaggctttgggccttgtgtggctgaccatcgtggctaatctctggctttcttcaaacacacattgaggcctgtcaacctgcgaagcactcactagatactatccatgccaatatgcacttggaagaaggggaacaaatgcggccacagcattacagtgtggtagatgctgtggttgcttgtaattgtgcattactggtatataaagaagcagttgatgtttgtgtatctcgcagccttgcttcttatccaggagtcttcgggattctttttttttttattttgagatggagtctcgctctgtcgccgggctggagtgcagtggcacgatcttggctcactgcaacctctctctcccgggttcaagc

SEQ ID NO: 91099 - DNA, 1034 bp, Homo sapiens
cctgtcttcttcattcaccccctacccaccaccaccaccaagggactcttgagttgattactttgctgtgggcatagcatagcaatctgtgtgcggaatgtgtggaagtgtgtcaggctttgatgggtaaaagactttgatgggtatatgagcacatatatcatgagaaaggaattgtgtgagtttctgtgaaagttacagaactctccagcaaccattagtcttggggaattctttttaaaatggcaggggtcattctgttcattctctatgtgatggtcacttctcatagagtgatggggccttctcccttaagacagacacgtggatcaggaatagacaggactgacaagagcccctcttctttcccagatggaagacactgcctatttctacaaaatgggggatacctagccaccccggtgggcagccatgatagctgagcatgtttgctccccatgtgcccacttactgcaagtgtttgtggtgccaccatgactggggaagggctctgtgccggcagaagagggttgttgctacacctggggtgtgacctgtaaaggtgacacgatgtgccagcagttacccaaatgccagaatcctaggaaattatcctgggctgcttggggatgtcttagtgtgagacctgttttctttctttgggtcttaggcggagtcggattgatatttgaatgattgggcattctttctgttaagctgattttctggttgtgggaagtagattgttataattttggcttagttcaaagtgttagggaagctgtatagaatttctttcatctctttttcagggtggggtgaggagagaagggatgtgaccacaagcttttttttttttttttttttttttttttttttttttttttgagttggagtctcgccctgttgcccaggctggagtgcagtgatgcaatctctgctcactgcaaccgctgccccccgggttcaagtgattcttctgcttcagcctcctgaatagctgggactacaggcgcctgccaccgtgccgggct

SEQ ID NO: 91100 - DNA, 1055 bp, Homo sapiens
ctaacatggagaaaccctgtccctactaaaaatacaaaattagccaggcgtggtggctcctgcctggctacttgggaggctgaggtgggagaaatcccagctactcgggaggctgaggcgggagaatcgcttgaacccaggaggtggaggttgtggtgtgctgagatcgcgccattgcactccagcctgggcaacaactccgtctcaaaaaaaaaaaaaaaaaaaagatggtcttaattttaatgtaggtgaatttatgaatctttgttttacggttggtgggaagaacactatcctgaagtgaaatatattttatattttcttctggaagttgtaaggttttgcccttccaattcatgcccttgatccatcaggaaatgattttttgggggtataaggtgaggagtcaggtgtgaccttagatgaattaccgatttcttctcgcatcagcttccttggctgcaaaactgagaccctaatccctgccctgtgcgaggttcttgtgaggtcggaatacagcatacagacacattgagccccatgtctcagtaagcattcagtaattgcttgttggtttaagtccaaccttcttccctaagcatgtggacactcagggaaagttggcgcttaactgggaaagttgttgctcgtacattgtctgccagcttactacaagcatcatggccaggctgggtttggctgctcagcacatcccctggcagggcactggcggcctggaaaatgtatagcaggcaggtgctcagtcagtcctagagctgatttcatgtgatatctgatgcatttattatagaaatgaaagcataaaaatgtgttttaactgtttcctactcccccggcacagtgacaaggctgattccaggcacagcttggttaggccagcacttgtaactatggtggggagcctcgaggcactgagtgagctcagcctccttgggcagaaaagcttgtttagttattgccagcacacactgtgtgttcctgtgggcaaacaaacagacggctggagatccgggggacctggtagtcgtcagcat

SEQ ID NO: 91101 - DNA, 1966 bp, Homo sapiens
ccgcctcggcctcccagagtgctgggattacaggtgtgagccaccgcacctggccccttttttgtacttttagtagagatggggtctcaccacattgcccaggctggccttgaactcctgagttcaagcaatgtgcctgtcttggccgctcaaactgcagggattacaaatgggagctacaagctactgtgcctggccgatgcttgcttttattagtagtaggtgtttattgaacacttgctttgtgtggcatttcatttgacccagccctgtgagggcattttcccatgttagtattgaggaatgtcggctgaacccatttgcctacatgcacacgcatgtgtttcaaaacataaaatgcaacatcctaaccattttacagtgtaaactatatgcatattgtcgtgcagcagatcactagaaagttttcatcttgcaaagctgacactgtatccttcgaataacttccttttccttctttctcccagcctgtggcagccagtcttctactttctgtttctatgagtttgactaccatagttattcatataagtagaatcagacagtattttttgtttgttgagtatttttcgtttgtttgtttgagatggagtttcattcttgttgcccaggctggagtgcaatggcgcgatgttggcttactgcaatgtctgcctcccgggttcaagtgattctcctgcctcagcctctcaagtagctgggattacaggcacccgccaccatgcctggctaatttttttttttttaatgtatttttagtagagacagggtttcatcatgttggccaggttggtcttgaactcctgatctcaggtgatccacccacctctgcctcccaaagtactgggattacaggcgtgagccactgcacctggccgattcagacagtatttagaattttgttactggcttacttcactaagcataataacctgttctccaggtccatccgtgttgtagcatgtcagaattccactcctttgttgatggagttgggttgcttccacctcttggctgttgtgaataatacagcagtgaacatgagtgtgcaaatatccacctgcctactgttttttgtttttttgtttttttttgagacagagtttcgctctgttgcccaggctggagtgcagtggcacgatctcgactcaccgcaacctccgcctcctgtgctcaagcaattctcgtgcctcagcctctcaagtagctgggactacaggccccttgccaccatgcctggctaatttttgtatttttaatacagacagggtttcgccatgttggccatgctggtctcaaactcctggcctcaagggatccacctgcctcggcctcccaaagtgctgggattacaggcatgagcccctgctcctggccatcttgcttactttttgaacacatgttagaactaagaacgtgggtgcggaagcctgctgaggggctttaaattccccatatcctgcctccacacggaaactgattttggggatggatattgggcatcggtgaagagtaggcacaaaggtacgggagatggttcaaacagtggtgcagccaggtgtctttcaggactgcctaaaggactgtttaaggccaggcacggtggctcatgcctgtaatcctagcactttgggaggccgaggcaggtggatcacctgagatcaggagtttgagaccagcctggccagtatggtgaaaccccgtctctaataaaaactataaaaattggccaggcgcggtggctcacgcctgtaatcccagtactttgggaggccgaggcgggcggatcacgaggtcaggagattgagacctcctggctaacacggtgaagtcctgtctcgactcaaaatagaagaaattagccaggcgtggtggtgggcacctgtagtcccagctactgaggaagctgaggcaggagaatggcgtgaacccgggaggcggagct

SEQ ID NO: 91102 - DNA, 1367 bp, Homo sapiens
gtagggctgttgtcaccctgttttgacaggttttagagaaaatggggtcactttagttccttgaccatgtggagcttgtcgacatcctcatggatgctgtcattgaagcggttggatgtgcaagcctggaatgcaagggtggatctagaccagacttgggggcattgggcatctccaggaggatggatgtgagggctcctcccaataggacgtcggaaataagagtcccagcagggtcccagacttgagaaagccaggcccctgtgtagtaagaacacagattagtgaatttgctttaatctggggaatggtgaagggcttttctttccaaaacaatgtgtcctagagtgaactctagtgacctagataagtatcatgtttaatagttttgtcctctgttcttggaggctagaaaatttcccacttctctttggaatttgctttgtctgacatctttcatttcattcattctatgcgtccacaccctcacgtcctccattttgtgagcagggttttgggagcaggactggctcattttggcacattatatttgtgtgtggaaaatgtgaagtgcgaacgaaagttcaagcacatactcaaggctgagctgtggtactagaaggtgccagtggtgggtccacctggagtgagtcaagcagtggttgaggtgacttgaaaatatcccctatcgatggttcaggcaggatagcccctgagttcctaaggcagagattcttaaatttggtctgtgtaatcttccctctccctcatcatggagtttttccggcaagcacttgatgtttctggttattgagcagttacttgtgctgagtgccagggattgtctgggtgctggaggtcagcggtaagcaaggtggatgatgcacaccctcctgcctgcccattagttcatgtgctaggagactgcagggcaagtgatgcagcctgcttggcttttactccatgattacagattatgaaatataaatattaatacattaaacagttcttactaaatcattacattcacactttttttgagatggagttttgctcttgttgcccaggctggagtgcagtgcgcaatctcggctcactgcaacctccgcctgccgggttcaagcaattctcctgcctcagcctcctgagcagctgggattacaggcacccaccaccacgcccggcaaatttttttgtatttttagtagagacagggtttcaccatgtcagccaggcttagtcttgaactcctgacctcagatgatccacccgcctcggcctcccaaagtgctgggattacaggcatgagccaccgctcggcctttttttttttttttttttaaagatggagtcttgctttgttgccc

SEQ ID NO: 91103 - DNA, 2587 bp, Homo sapiens
aggcaccgctcccagccttttttttattttttgaagggacgaggtcacactatgttgcccaggctggtcttgaactcctgaacttgagcaagcctcctgccttctttgtctcccagactgctgggattacacaggtgagccactgtgccaggctggttttcacatgtatcttacttttctagacatttacaactttatgacttggaaacagggtggatcacccattttggtttgtccttgcaaaaatcctccagaggtttcacagagttgtcaggtaacgtgtcaacagtgatgtgaaccttcccagggcccctgtgcccccaactttgtcagcctgtgctctttcctggggataaggaatttgagaatgtaccagaatgggtctgttgcaaaggccgcagatgagggtcttggaactagggctctacactgaagctgctgctgtttgtaaactgtctccatgatttgctgttggtatggagcctttgctccagaaggtaactgaatggttcctagccagcctcattatttatgtggtagtgttggatgtgggtaggcttacaagatttatgctgtggtcccttacgtggcttaatgtgtgccctgtgctgcgggacatttgcttacgcatgcactggaacctgcagattgaggaagaaagcttgtgggaaactaccattcttcagcatgacatgcttacgtttagggatatcgacatgctacaccaagcagtgtacacagtgccactctctttctcctcacatccttgtctggtggaaggaataggaaatataataccataaacttgaataattcatacttctgtaattggggcagagttgagtcagaggatggaaaagaactcttattacttctaagaatagcacctattacagactccttcacccccccgccccaatctctatagtttgaagattaaacttgtatgtgccaatggatgttttccctcattcatgtaccattggtcttggcttttattaatcccatttctctgctcagttgaattgcagtcttactgtacaggcatgatttttgtaacttaagcagtttcccctttctattttgtaattaagagaaataagatcatgtgcgtgaaagagttctgtgaaaggtggtgctatctgtgtgtaggttgttttcatttgtaatcttcattaaaaattacttggctctgaagcactttcagttataaaaagctgccaagtaatagagttgtgtgtgtatgagactcttcatatgttttccttttgacagtaggaaaccattcagctgacagattagctgcctggaaataataccaccttcgtgttcatctttttcaaaataatagctcagctatctgtaatcccaggaatgcagttttaaattaccagtgttagagcggtctctctattgggcccttttgagttgcgtagcatgctgcctgcagcttgcttatcctcagtctttaggcctgtctgctctggtaactgatgtcctttgcacttgtgagagctggtttaccctttctggcctgtgtctctttcccctgaccttcctgaccaccaccaccaccaccaccaccccttgcccaccaccccccactcccattgttcaccttaaagcagtccttatctttgttgactctgaaaagttcagggtttgtagcaaatagctgcctatgaataggcttccctgtaaagtataaaactacattttctgactggatgcttgacatcttccttaatttttttctattgcttactgcatgcctgttttaaagtggtggagccagacatccatcagtccagtttctgtgtcaaccatgatgctgtagggagctgcagacttggtcacttcactgccacattgccctccccagaccctgagcttgagcacactgctgctgattgttctgttttagcgaatatttctaagcctctacgcattccttaagtcctcagaaaacaaccatatacactgggcactagtatcatcccggtttgcagatacggaaggtggtgcttggagagctgtcacttgggcagggttgcagggtcacagagttggtaagtacttggagcacttgtgtccagagcccactagctcttgtctgctgtggcataagctgtgggagtccaccatattcagctttgttctcagtgaactcagatggtttggatgatacgtagtgagcacagggtagagctcagaagtgctttccaagatgtccaggcaaggcagcctgagagggaggagaccttccaactgggagcataggaagggggctagcattgagtctggttcttcaatgaggacagcagaggtttggaaagagacctggacaggtctgaaagcaagtacctgtcccttggaggtgctcaccagtgtgaggggatgatcagaagagggatgcagaatgctgactggacaggtctccttttcacccagacatctggtcagtaaaaacagtgcttccctcctgaggagtttctcatgaagacattcacaagagtggaatttaacctcatcttcaaaaagtttccgctagagaaccaagttgccttgatttggtttcacttctatt

SEQ ID NO: 91104 - DNA, 1344 bp, Homo sapiens
aagaaattatggatggctgaaaggaggtttccatactagtttgtaaaccagaattagtggaaaacagttcagaattgagttactcacaaagggtagaatgaagatagttaaggatgtgtgtatcccaaatattttcgtagaagatgaaatgaaagacactgtgtatcttacctgtgtcaggcatagaaggagctctgggagaagtcaagccaagtctcaggagttacttgggtgggctgaatgatccagtttggcgggaaaacagccctgaagggagcacaggagtgagaccagcttaaagtgttcaggaaaatcttggataagagaccaggtagatataaagtttaaataaatgcttacaagattgaaattgtgtttatcacattaggtctctcttccatataaataacaagttgttatttatataacttatgtaatctgtatggtatattgttattactagtaactattgttagttcaggagactggattcatctatcttccgtgcctgcaaaaggtacagttgtaattttgctatttgctaagctatttccatactcaagttctcgtagtctgctgcttggcattcctcaagcattacgaaaagcctcctcagatttccataatcaaaaacaagtgttaagttctactgtaataatcgttttcctacagttctcactgttggaaatattattcctttaggagacacaaaataattgagtctagtggctaagaatgggactgaccctgcttctctctagatcatcactccttaagaggaggctggaggtctccttgagtatgctacagatgctttggatcctctctccacaaaaatgcacataggcataaacattgaactctaaagaccaggtaccagaatgaatttcctgattttactctgtggaagaaaaatttattacgatgttggttaaagggctattgatggcttttttgttttgttttgttttggaggtagagtctcactgtgttgcccaggccgtagtgcagtggcatgatcacagctaactgtagtctcagcctccccaaactcaggtaatcctcccacctcagcttcctaagtaactgggctacaggtgtgggccaccacactcatctaattttggtatttttttgtagagacggggtttcaccatgttgcttaggcaggctggtctggagtcctgggcttaagcagttcatctgcttaggcctcctaaagtgctgggattacaggcggagccacttcaccctgcctcttgatggttttgaatactttttatttttattttttaagacagggtcttgctctgttgcccaggctggagtgcagtggcatgatct

SEQ ID NO: 91105 - DNA, 1151 bp, Homo sapiens
tctttccatacctttctggcctccattggctctgattctgattgtattggcatctgggcttggtgaaaggattctggtccccaggaaggtgtaaggtctccctggaaaagtttggtagagtaattttggcagctggatgtgtggaggtcctgactgggagtctggcatactgccgatcgactttgggccttttgaccagaagaaccagttaagtccagttacttactaggcgtcattgggatccggttccacaaaggttgccttttgcttgtgtgaaatgcaattgaaagatatattttctttagaggttggtcacataatctaagcattagcttcaaattaagagaatgtgaataaatttgacatttgttctatttttcgtttatcctaggtgtagacagttgtgtgatccttccccttcccccctccccaggcatgtgttagcctgttctgcccagtgtaggaagtttctgggaccttgggctgtggcagacagcattggttgggcttgggtggagccgtgtaccagagcaggagaggagagagaacaccatggagttcactgttgggtgcagtcccagccccacccccttctggccttgacctcaggggagttacatcgtctccataagcctcagttttctcttctgtaaaatgggatcagtgtgcctgcacagtgacaaaagggggaccatgtgggtactgacctgggcctcatgtctaattgtataaagatgcctgggactgttgagaaagatgggggccgaggagtgctggctttgctttctgcctgaaaaagtgtgagaaatgctatccaggcccttcctacttagtatgtgtggtcaccttccttgtcttggtctccactcaaggctgaaactctttatttgttcctagctgctgttagtcaggagacactggtacattgtcagccagcaccaggggagaggtgttgggcttggtattacacaattttcagaaacgtgaattagtaattctcgtgtccttgtgtgttgctaatgtctgcagttgttccttctcaggcagtaacacatacatgtctatgggtggattagccttcaaagttttgttttgtgtaaagaaaagggaagagggtgagaaaaatttggggacttcatacttgaaaattt

SEQ ID NO: 91106 - DNA, 2509 bp, Homo sapiens
agcgcagctgtcccggtccgcggtcctctaggcgggctcggccgcggcgctcacgtgggccggggccggcgcgctctccttctggcacccaggtcgttttgcctgggccggggcagcgcgcccccacccccatctcttcaccttcccggcggtccccggagtgctgcggagaaaggggcaggtcccctgcggagggaggtggctgcggctgcacgccggtctgaggccaggcctcagggcgggagcggtgccctggaggcgagcttggcccgcttgacgcacccactctcagcctggcagccccttgctgggcgctttgttttgctcggtccgtgctcgccggcgtccttgcaacggcctattttatttgcagtgttgtgtggtggtggtgattgtggtgatttggggtggggatgtgggggagttgtgattcagcgaaataaaatgatccccctcctcccaaacggaaatagcatggcttcactcggctgagatgcccccaaggcttgggtttgcttgaagatgggaaaccccactctgttgtagtggacggtgtaaatactttagttcaggccggtgcatgagtcatgtgcttctcctgggtggctgacctcccttttactcaagactacgctttgtttttttaagatttttatttgcttgtttacttgtttacgtttcgtgcagcctggtggggtgtctggtcttgggttcatttctctgcgtgtgtgttggatgctagtgaccccttggaatgtatgcctcacgagaattggaatgtctttgcttaccttcgacagggctctaccagtccgtggttccaaaaaccaagtcgcagtttacctcgtaagccagtggctctttggggctgtaacaatggtcgggagttttttgtgaatggagctgtcaagttccctaccgtctttggaagttgtaaagaaagcgatactcaaaaggatttatgaatgtgtttttaatttcaagaaagtttttgatggcacaatctgttttatgatcttgccaatatatacatatacttttagatggagtctcgctctgtcgcccaggctgtagtgcagtggcgcgatctcggctcactgcaacctctgcctcctgggttcaagcgattctcctgtctcagcctctcgagtagctgggactacaggcgcccgccaccacatctagctaatttttgcatttttaggagagacgcgggtttcaccatgttggccaggctggtctcgaactcctgacctcaggtgttccatcctcctcggcttcccaaagtgttgggattacaggcatgagccaccgttcccggccgccaataatttcataaagcatttatttcggtttaatttgggtggggattatgttttttatctttttatcttatcactgatgcgttgtagataaccaagcgcttccccccaaaaacttcagccagggaaagataaaccactcagggtttccattgatcaaatggagaaggcaaagcctaatctgaaacaaaatgtattgctgctctgttatccaccatacctctttctttggtaggaaacatagtatcttaaaggctcaaactggagttagccggtctcagaatggctttagttggtcttaattggaaggagtcgagtccacctccgagtatcttgctagcagtcagcccagtggaattgctgaagataaggaactttgcctacggatgaaagataagaaggtagctgctgagttttaaggattgtttggctgttctggggtgctatatgcctagcttcgctagtctggaggacagcgagggaaaatttttagctaagaataacgagaatcattggccacttagtaacatttccactaaattattgaattgtttaaaggaatttagactttgtttctaaaagttgcctttttgagccagttgttgtgatctttgtactaaattgcacttttgctttaggaggtgggggtaacaatattttcttgtttcacaattcaggttattgaatgacttcagatttacagatttaagagattgaattttgttttgtttttattttttatttttttgagagagtctgaagtcagtcgacaggctggagtgcagtggtgcgatctcggctcactgcaacctctgcctcctgggttcaagcgagtctcctgcctcagcctcccgagtagctgggattacaggcacgcgccgccacgcccagctaatttttgtatttttagtagagacggggtttcatcatattggccagtatggtctcgatctcctgatctcgtgatccgccagcctcggcctcccaaagtactgggtttacaggcatgagccactgcgcccggcctgttttgtttttaaagcaaaaaaccatttggcacctcagtgatttgaagaccctgggctgttaaatctgcttctgacaacctactgtatagtgtgttgtattttgtgaatgtaaaatgttttggtttctgattttgaataaacttgtagagtagaccatgt

SEQ ID NO: 91107 - DNA, 1744 bp, Homo sapiens
gaggcaggagaatcacttgaaaccaggaggcagaggttgtggtgagctgagatcgcgccattgcactccatcctgggcaacaaagcaaaactccgtctcaaaaaaaaaaaaattgcagaatgggccgggcatggtggttcacacctgtaatcgcagcgctttgggaggctgaggtgggtggaaaccccatctctactaaaaacacaggaggcggaggttgcagtgagccgagatcgcaccactgcagtccagcctgggcaacagcgagactccatctcaaaaaaaaaaaaaattgcagaatatctccccgaggtgttttctgaatctgtaggctctgagaacatgtaggattcactcctgtggcataatttacagaagtgtttcccttgtggactgctggttctgaaaagctgacatccccgcaatcatgggcctcctgagctctgcttacaccacgctgaccggtgtttcctctttggccagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcactt

SEQ ID NO: 91108 - DNA, 1021 bp, Homo sapiens
gcttgtctcgaactcctggcctcaagtgatccacatgcctcagcctcccaacgtgctaggattacaggcatgagctgccacacccagcatattcatacttttgttgttgaacttatgaaatcaatgtaaccccaaaaactgaaaagaaagagcttgtccttttcctccactgagtccacacagcctttcatttgtaaatgctcttgtttcacccccaattctgcatgtgctacatgggtatcagtggtgcatctttgcatttatctcttaagattgcctagcttttccagtttgttagtcttggttgcacagtctctggagccttctattcttggaggctggcgttttgagattcgcttctctgcatagggctgatctcaggatgactcggcagagcctggctggtttattctcttccttaatctttgccatttttaagagctcacatttggttccctttgcagttggctgctgaacagttcaagaaaaccagtctccatgtggctaagagtgttttgaacaacagacatatagtgaagatgctggaaaaatacctcaaggtttgtgcttgcaagtaccacagacaggaaaagctttcaaaagggaagatgaaccccaggagcagggagttgaatccagagtgcagcatttagcatttctgagtcttttgacagttgagggacactggaatgcatcaagctcaggaacatgacaactgggatttctaatgagtcagtgcttgcctggggactctggggatgtggcgctgcttgattaatcagtgcgtaatggatttttaccatgaaaaatcctgattgtttagccttaaaattctgagcaaatgatggttaggtgattttttaagaaaaacccaaggctagccctactcgggaagctgggatgggaggattgcttgagcccaggaatttgaggctacagtgagtgatggtgttaccactgcacttcagcctgggtaacatagcaagactggtcttgaaaataaaggaaagcggggaaccgg

SEQ ID NO: 91109 - DNA, 2930 bp, Homo sapiens
gaagcagaggttgcagtgagctgagattgcatcattgcactccagcctgggagacagggcgagactccgtctcaaaaaaaaaaaaaaaaaaaaaaaagacattgggtaaatataaacaaaagctcgggaaacgtggtggaacccattttctatgaagaatgccagaactggcatcccccaagtgagactctatctccctacggttggtgaacaggctccattcatagaattgtacgggtgggtctttgtcatggggcaggcagttctgcagcttaggaggaaccgagagagggtgggtgaatggctttttagcaaggtgattgtcacagaatctctgaaggcaactaggagtaataacaggacacacaggccctgtcctgagccccggaggctggtcctaacacactgtggctcattcttggtggcatagcaacctaggtcttgggtgagactgcccaccaggcagtggccagggactgggctggttgtggagagtctggacacaccagctcactgccggactttgtgtatactcttttccaggaggatgaactctgcgactctgggaggcaaagaggtaggcatcaccgtgtcccttgcagctttcctgtgtcttcccagctgccccgcacttactgcccagcttctgagcaagccaggggcctggatggaggggcccgtggctgtgggggaagaggggctgcagccaccagatgggccttgaccgtggcgatcagccaacactttgcttcaaagtgtctggggcagcatttactggaaacgggtctgtctgcctgacccgatgtgggctgcagtggggatggggggcagccttgggtgtccaccacagtcgaagtttgtagggaaggagaaacatgagagaagaggcccccagcccatcttctgtgccctcctcggccagtgcatttccctgaagtgttttctctggggcttccttttgtccagttccttcagtcgcctgccctgggctgtgctgtgggcctctgtggtggggatactggcagctgcactgcacattgcttcgtgcctgcgagtgtgtgacagcagacacctgcggggtcgggagcacccaggcccactgggtctttgagaggcgggcgcccttcagcaggtctcttcatgtccaatgcaggagaccagagggtctgcagcaacagcagagcaggcttaaatccctcatggcagagcggcctgaggtgccgcggcctggagctcaccctgaagccactcgtttctttacctgtcctgtgggtctttccgtagctggttaccccaaggatcataggctggctcctcagtggccctgctcccatccattctgaaggcccttggcttagatgttcctcctgttcaggctttgccagccctctgcggtcctcccccccgcgacccgcagcagtcctgtccatagcacggggcgccccgagcgcttagcggcacaatgctaaagcaaaggtgacatgtctgttgcgcgcaggtcctgctacctacccgggatgactttgctattaaacagcagtcatagtttcaggcagtgacctcttgccaaaaatcccacacgcccttttgagaggcttctgagcagcgcacgccggtcgccatcttcgtgggacagtctcgggactggcatcaggggtaggggttacagttcagatgcttctccaaccttttttcagcgtccgtccctggcctcatgctgggatgatggccgcgtggctctccgaggagctcctctgctggccccgggggacggacgggaggaccaattggtctcttcccaaatttttttctaggattgcttcccacgcagccctgggaaagccctagattgacggtttttgtgagtggaagatagaggtcgggccagcaaggactgtcagacctgctgaggccctagttcagacggggccgccaggacgctcgtcacagtccacctagaggtgggatagagggcggcggagcagctgcttcacttcctgaggccttcagctgccgcctcttcatccggggagaattggcttctcctgtgatattgggagaagaccccatcgcagggcatgagattggacaagcagaatggggaggacagagggagcagggggctgtggtgcacatggggtgggcaggctgtgtccctagcccatcctggccgcctcaggccatgtggggagtttggtgactactccgggctctcactccaggcccgtgtccaccaggagtctctgacagtgccttggggcatcctggaccctgccgcgtggtgcaggcagtggcagggcacagggtgcggtggccaagctgcagccccccgaccaggccctggagctcagctcctttgcaggccactcagagcgtctcgaagggacttgtctgttacaggagagaaggaggacgaggacgaggatgtgaagaagagaagggaaaagcaaaggagaagagacaggacgcgggaccgtgcagccgacaggtgaggcgcgggcacacgaccccacaggaggaggtggactcgtgcggtggaggcgctgccgagctcacctgtcctcgctccacaatgctgggggcctggtggcctgactcctctggccaaaccagtgggaggcaaaacagtaaacaattgggagtgcagaaaagaccatcactcgtgctcccagcacacgagctacctgtcttctaggatggctgggacgttgctttggtggttaggtttctgttcttgctttagaggattggtgtttgactcctgtgtctctattcctctggaatcccagccttgctggtgggtctgtgtggtccataactgctcagcagcgggctctgttactctcctgcaggcctgaggggcatccctgccccctagcctggtgtctggcatctcagacactgtcctgtgttcaccttatccaaatcca

SEQ ID NO: 91110 - DNA, 2411 bp, Homo sapiens
tggcagcgggtgcccctccccggttgtgtccaccatggacaggcctcgtggctgctgaagtctgacttggctcctccccctgtgacaggttatgaaaactacaattactatggcgcccagaacaccagtgtcaccacaggcgcaacctacagctacggcccagcctcgtgggaggccgccaaggccaatgatggcggcctggcggccggggcccctgccatgcacatggcctcttacggcccagagccatgcaccgacaattccgactccctcattgccaagatcaaccagcgtttggacatgatgtccaaggaaggaggcaggggcgggagcggcggcggtggggagggcatacaggaccgggagaggtgattatggacccaagccctcccccgggaccccacacatccccacctttgtgcgcatgggagtgggcacccactcttgagggagggcctgtccccgcctccctcttgggtgtggcattgacgagttgggctcgtggggggtcagtgatgttacagtaggacttccttgcttttcttcatggcggggcttgggcgtggttgttggctaagctccccgagactccttttttctacatcatgctattcctgtggccaggggctctgtcccctgctcagcagtgttccagggagggtgttggtcagttttggtcatcccagcacttaggtgggatgcagggtggtttggtttgctgttttgaatgtaggggcgtcgaggttatactgagggagtgtggcagtgggtgatcggggtgaccgcccctgatgggctgtgcttctgttgcagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcgggtaagccctcgcaaggttccttccggccgccttcgcttctctttttagcagctttattgaggtaaaatttccccatctcaacattcacttaaatgtttttaagtgcgcagttcgacttttagttaatttacaggattgtgcaaccatccccaccatcacagtctaatcttagcatttatgtcaaccagaagagaaacttcttctcattagtcacccctgtctcttccccgcccccaccagcccccgacaaccaccactggtctctggatttgtgtgttctagacattttgcacaaatggagtcgcgaaacgtgtggccttttgttcctggcttcttttcactcagcatgattttctttttagtttcaaattatgttgtctctttgctttttgaaaagaccttttgtgcctgtgttgtctgatcctacaacctccttgttcttttctgtggggcatcttcatggccctcgtaagtagctcatggggtgtgcttgttgtctgtagcccaagaggagagggtttgaccgcttcggaccagatggcacgggcaggaaacggaagcagttccaactttacgaggagccagacaccaaactggcccgggttgacagtgaaggagatttctccgaaaatggtatgtcctgggggccaggtgggccagacagatgtaggatgggtcggctgcctgctgggggctctgcttgccccatctgtgtcgtggacactcgcaggtggcatgtttcaaccccactgtggtcagggcagactcaccctggatggcgagcttgggagggcggaaaccggatgggaccgttctccggggactgacttttcctttctttgtgtctggcagatgacgcagctggtgacttccgctcaggagatgaagaattcaagggtgtaagtccaccaggcagcccttttgcctctagtgtgggatttcttctttctttaatcacccttcctcacaaaggggcaggagcagctgccatggtagatttgactacctctgagtggattcaggaccctgacttttagctagatttctaaaagttttccaccttagccggcacggtggctcacacctgtaatcctagcacttagggagg

SEQ ID NO: 91111 - DNA, 1020 bp, Homo sapiens
ccccgtgacccgagctcggggcgggcggagcccgcgtggccgaagctggaaaccaaacctaataaagttttcccatcccacctccgggtttctctgttactgtgccgcgcgggcggggcggggtgggcagaggggcggggtgcgcatgcgcgcgggccgggccgtcgggcaccgcggtgggaccacaactcccattaggccacggagctggatcgtagcagcccgaaaggccagctgggacggcgagggcgggccctcgtgaagaccagccaatgggggcgcgcggaagtagtgacgtgtgcgcctggtcttccagtagtcgatggcggaggtgcgctgaacgcatgcgtgctgtggtcgcctagtaaacggggctgctggtgggccgcgtcgaagacatggaccagggctacggaggtttgtgttggctgctgggtgcggagcggggagggaaggctctgtgcgggcgacgcagccgctgcgcagactgccgccggccgggccttcgtcccgagcgtggttgccccagctgggccctccggagaggcggccagggcgcgcgcgcgccgctcattgggctttggcgccgtcgctcccggggctctgcgtgcggattggccgccaggccccgaggaggcgggcgggactcggggttggggcagacgccgcggtgggcttcgtgggggcgtcttagacagtgtgggccgtttttgcccctcaccttcggcggagtccttccggcccccagcgaccccggggtttgcactcccggcttcctcttccgaagacgccacaaaatggcggcgctaggggggcggagctacagcgtggggttgtgaggtcggacccggggagctgggtctggggccgcgggcggaccgcgggggccgcctctctcccgacctgccctaggcccgcggggccgtgtagggtctccgctgggctcacgtggcccagggcgcctgtcccggaagccgtcgggctgcgcggggtcgggcctttagtccccggtgcagcgcg

SEQ ID NO: 91112 - DNA, 1328 bp, Homo sapiens
ccgacaccacccccaagcattctgagcagaggatgggctgggcctttgagtcccccagatcccagaaggaagatgcagcaccttttcgggccctgcctcgggactgcgtactccactctgcacctcagggccacctggctcacgccagggcatccttccttccggtccccacctgggccaagtgcacacgctcctgcccagccttggtagcgaggccctccagcaactttccagcgactcgttgcctgttgcagcagctgctgtctcaggcttcagcctcctgcctgtgggaaggaagagctcctcccctgtcccctacgttgcagtaactgcagcctgcagactttctggccctttctactcccgaccccactggtcccagcctgtccctctgctgggaccgtacttcagaggcccgtgagcaaggcctgtttcagggcttgtgtctgggttgggtgaggcggcagcactatcccctgggacacttgcagcctcagcccctcgtttccttcctgtggcaggatccagtttgtgtgttctctgtgcaaataccggaccttctatgaggacgagatggccagccatcttgacagcaagttccacaaggaacactttaagtacgtaggcaccaagctccctaagcagacggctgactttctgcaggtgagccttggagtaacacagccgctcttagtttcttggacccctgagaacataaggcggcccacatgaacctttatattccttgcaggagtacgtcactaacaagaccaagaagacagaggagctccgaaaaaccgtggaggaccttgatggcctcatccaccaaatctacagagaccaggatctgacccagggtgaggagattttcagcccactcccaccaggcaaggcctcagcctgcactcctgattttcggtgcagggtcaggacacccttctgttcccccagggaaggtcaggagaccagccttggctcaggcccaggtggaagtggcagggcgagttgaggaggagctggtgtggtttttttctcgaacacctgggtctatcttaggcacctgggcccagtggtgactccctcctccccactacagaaattgccatggagcattttgtgaagaaggtggaggcagcccattgtgcagcctgcgacctcttcattcccatgcagtttgggatcatccagaagcatctgaagaccatggatcacaaccggaaccgcagggtgagtggccacagtgctctccctctgtcctgtgggtagattgagtgaggcctctggggaggttgtgcagttggaacctctgccagcccgtgagggactgc

SEQ ID NO: 91113 - DNA, 1040 bp, Homo sapiens
ccagggcagggtgggtgctggactgggagattggggagggcaggagcagttgcctggaggtgagggatcctgaggggctccacctgatgctcaccccatgcctctgcaggtatgactcttatgagtcctgcgactcgagggccgtcctgagtgagcgcgacctgtaccggtcaggctatgactacagcgagcttgaccctgagatggaaatggcctatgagggccaatacgatgcctaccgcgaccagttccgcatgcgtggcaacgacaccttcggtcccagggcacagggctgggcccgggatgcccggagcggccggccaatggcctcaggctatgggcgcatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcagatgaggcggacctggaagacctggaccacagccgacttccgagtgagtggaggcagccttcccctctgggaagcttagttcccactggggcggagctaagggccgggtgccatgcaccctgacacggcttcccccccttatgacccagaccaagaagaagaagagaaagcagggcggcagtcctgatgagccagatagcaaagccacccgcacggactgctcggacaacagcgactcagacaatggtgagcccactaggtggtactgggcggctgccccctgcctctgggaactcctgggttgagcttacctccttttccctttcagatgagggcaccgagggggaagccacagagggccttgaaggcaccgaggctgtggagaagggctccagagtggtaagtggctctggctgggcattttctgtctgcaggcagggcgagctggcctaaagagtggtgctctccctgggggccagaggcaatgctgtgtcagctctgcgtgcatggtgaccagcat

SEQ ID NO: 91114 - DNA, 1362 bp, Homo sapiens
aaagtggtgttcacggagttgatgctgcttcctttcgttgtgcctcctcactctgttgtggcagatcctcagcaggtgaagcttgcagtgaccacattgtagcctcccaagcagagccctgatggatctgcttttgcctccatatcctattttctttttcttttctttctttttttttttgagacagagtctcgctcggtcgcctagcctgtagtgcagtggtgcaatcttggctcgctgcaacctccacctcccaggttcaagtgattctcctgcctcagcctcccaagcatctgagaccatagacgcgcaccaccacacctggctaatttttgtatttttagtagagatgaggtttcaccatattggccaggctggtctcgaactcctgacctcgtaatccacccaccttggcctcccaaagttctgggattacaggcatgagccaccacgcccaactcctattttctttagaatagctagtgcccactgtccctggtacaaacagtcacttggccaggtgtacagtagctgcctgggctacctgtgtgttgttctatttttttttttttgaaatggagtttcaccgtgtcgcccaggctggagtgcagtggcgcgatctcacctcactgcaaactctgccgcctgggttcaagcaactgtgcctcagcctcctgagtagctgggactacaggtgtgcaccaccacgcctggctaattttgtatttttggtagagaaggggtttcaccatgttggccaggctggtttcaaactcctgacctcaggtgatccgcccgcctcgacctcccgaagtgctgggattacaggcgtgagccactgcacccagccttgtgtgtttttctttatgtggctctgccagcctctcttgcctcttagaatggctccattctttcctcagctaccactcctgacttacccatgctgctctctggctgttagcatctctcttaccaacaggcagatctccatgcctgagcagtgcctgggactgcaagcctctgttccctgtgctcaggggatacataaacaaatggatgagaagcctgttttggtttctccagcccaagagtttttgttttgtgagctctcttgttaaacatagtggtcatcagcagttcctcagcttctctctgatttcttcccattctttttgtgcactgggtcgtggaggaacccaagtgcaggacgacagcctgcctgttctctctggctcatcttttcagttgacttacactcttcctgctgtggtctggcttctgccacttattgccctgctgtctgtctcactgagcttcggtcccctgccctgggatgagcatgtcctctgcggggcagagatg

SEQ ID NO: 91115 - DNA, 1034 bp, Homo sapiens
gaggccggtatgagccaatgcggtcgggaggcggggctcgggtgtgtgtggaggggaccctgtggttagcagcagctatcgcagcgtcggatgttcagagcagcagaagccggcgtcgtcggatgttgtgttgcccgccaccatgagctacacaggtgggcctggcagggtggggtcgggctctgcgtgggggatgggacagggacgtgcggatgccgcaccaggcttgcccgcacctcccctggggccccgtcactgccttccctgcggtcacaaaatggcgccgctggcccgtcgcctcagggtcgctgccctcacgcctcgttgcctcagctctctgtgtctgcagccggcgtcccggctcccggccgcctgatgtcttggcttctgtcgcctgtgtccgtgggtccgggcctcagcgcacgaggtctccgcccccaccacctccgtccctggcctgcgctcctggacctcgacgccttaggtttccctttctcaggccttggtccttgcgagcaggcagcaggctcggctgccgtcgccattgtcgcgtcctcccccgcgcagtttctctgcaaaaacgccgcagctctacacccccatcccgatcccacccaccacccccttttgtctatttcagaactgggaaaggcgccaggccctagggggataagtaaatattggaagggtttgggctgagcggggagccttgggcccctaggggctgaactgcaaggaatgacaaggttccatgttaattccctctgcgtctgtcaaatgaaccgtgtccggtacagactgggtattgggaatacagacaagaattcctcaagcagcttagaggcgaggatcttaataggcaaataagcgagtgtaggatatattttagggtggtcagtaccgtgcgggggtcgctccactacgtggagtggttggagccttctgtaaagaggtgacatttgagcagagacctaaatggagggagcgaataaagatatctggcccagggagcttttgctgtaaaaggcttacgg

SEQ ID NO: 91116 - DNA, 2482 bp, Homo sapiens
tgaacctgtgtaagtgtgaccctgcagtagggcagggagaacagttggaggggtctcctccctgcctccccttgggggtatccagagtgcctagggttgaattggaagggaggacacgcaggtagagaggacacagggttagctgtgtattcctgctatgcagacccctgcaactgagctgctgctcaattgtcctttattcatttgagaagcaggattgtgtcattcagtgacagcagaaagattccatctcttgtgccatttcaatcgattggtagtggctgccagccagactcctagggagaaagactgcggggatccattagtgatgtctgctacagcaggagcgtagggactggcagtgaacgtctgaactgtgtctttctgacatttttggtaattaagtgcttgacattgggagtcaagtgtgagttaagatctctgttcctccacagtctagctttatgtgaccttgggcaagtttcctcatttggaagatggagatcagcatagtcccaactctgtctggttttcttgaggattaagtgggataaagcacttagcacagcacctggttacagaaaactctgtatgccatcattgtaatgtcacttgctcgcttgcctgtcacaccagcactgtgttcattctgctcaggttgattggatgcccactgtgtgctgagcaggtgagggcagcccaggcttgtgccttagcgctcacgtgtgttgtgtaccagctctgtgccccatgctgagagctgttcccattttagaccgtcccaaagtaacactgggaggtaggggttttcatctccattttgcagcggaggaaacaggctcagagagggaaagtgacttgcccaggatcatacagggaggtatcttgaagccagctagaatttgaagtgacagaacaagcagaagagccagatgttaaaagggcctctggaagcccagatgagggagcaggttgttgcggtctggtgggtggtgtggacaggggtagctaggcagctggcactgatacgggggctttgagcttggaggcttcctgcccgcagccgccgcctccttctcctcctcctcctcctcctcctcctcctcctcctcctcctcctcctcctcctcctccctcctccctcctcctcctccctcctcctccctcctcctccctcctcctcctcctcctcctccttccccctaccctggatcccctgcagcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctgtaagcagcgggcggcagggtcctgggagggcgaccgccagggcctgccaggccaggcaatgccacaagcgtgcacactgaccccaagtggggcccccatggctgggtctgtgtgggaggcgggattggcacctggcctgggcagggccatctgggtgcacctgccccctttgggctgtgactcagcagcaccccctccgccccgcagccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacagtgagtgcttggtggaggagggtcgggagcgcagcgggcacctgtcaggcccacccagccactccccaggcgctctgctgtggcccttaagtcctttctccagt

SEQ ID NO: 91117 - DNA, 1990 bp, Homo sapiens
cagctcatttgctgaatctggcctttgctagctgtgcagtctctcgcatgacaccatttcttcgtctgttgatcctaaggttgttattgactagtgacgggccctggggtggactccagggaggtgagaggagcaaaatgaatttggcccttgctcttgagggccattcaagttggggaacggggagacagagaagcagataggcaaggataaaggctctgtggaagagggtgcaggagactgcaaggaccagtgtttcgggcaggagttgagccacagagggtggttagaacttagttcagtgaggcatgtggctgtcaggtcagcgtttgtgtgaacctgttgccagggcaccccgtaggcctgaaaggttgtgaaaggtgtcccactggctggatgacagaagggctctatctcctgctgtgtgcccttgggcacaacttttccctctctgagtctcagtttctaacccttattggcaaagcagccaagctattctctgcgttgttagggtcattgtgaggtttggggggcctgacggaggcaaaacacttccatggagcctgggtgagtgggactctcaggggaggagaagcgggagagctgggccgtgggcctcacagcctgctctcccggcctctgtgttgcccttcagcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcagtgagtgtgggtcccaagagccgagggaggttctggcgctgggagggtcgggacctcaggttgggctgtagcccagggacagggcccagggtgggtgggggcggtggggactacagctcccatgtcctgggccagccaggccagagtattggtcaagcctctgcatctccttttgggccgccttggatgtggatcgtgcctcccactttactttgctgatcttcccctgaaagcctcactgcggctgatgagcctgccagggtcatgctcgccactgaggggcagctcttggctttctctgggcctgtgggtaggggcggtgaaggtaaccagggttcctgtggcctagctttctcagtggtagttggaagcatcttggatagacaggggatcacctgatgggaggtgcccacgattggtcctgtcatcaagtcttcctggctgtccaccacgcagaggcagctctctgcgcctgccggtgaagccccacctcctgggctgcctgtgggcacggcaggcagggtttgggaagaaaccctccaggtgcagtgagcaggtttaacaaggacgtcccttacaacatcaggctttcccatatctttgtggacattagagtctgggggtgaccccagggtctcaccccctgcccaatggagccccccatttggcaccttatgttcccttgaagttgcttccactgagtctgccgtgcttccaggggcagggccttgagcaggtgtgcccttggctgcgtgagcccagcagccaccatcgcccccaaatagctcccatagcagggatcctaggggagagggtctgggagtatctgat

SEQ ID NO: 91118 - DNA, 1098 bp, Homo sapiens
cccaggatgccagcagctgagcatcagagatttcccgctgtcaaagccactcctgcatggcacgggccagaggcctctcggaaggctggcctttccctccacactagcatccaccccctactccttacagctcgggagaaacaaaagcaccgtccacccacaagggctgggggaacggaggcgcccttggagcgaagaggaggaggaggaggaggaggaggaggatgtagtgctgacctccgagatggatttttcccctgaaaatggggtcttttcacccctagccacccccagcctcatcccgcaggcggccctggagctgaagcaggcattccgagaggccctgcaggcagtagaggccacccaggggcagcagcagcagctccgagggatggtacccattgtgctcgtggcgaagctggggccgcaggtcatggcggcagccagggtgcccccaaggttgcagcccgaggagctggggctggcaggcgcccaccccctggacttcctgctcctggacgcgccgctgggcggcccgctggggctggacacactcctggatggggatccggccatggcactgaagcacgaggagcggaaatgcccctactgccccgatcgcttccacaacggcatcggcttggccaaccacgtccggggccacctgaaccgcgtgggcgtcagctacaatgtgcgccatttcatctccgctgaggaggtgaaggccattgagcgcaggttctccttccagaagaagaagaaaaaaggtagggcagcttcacttttaaaggcccaggagacacatggctgggcaacccaccgttgatctaaattctctcccttagcgccaagcagggggacactggggcctctgctcctgagagacttgagagccacagtgaaggccacctggtcggtggatgtgtggagacgccccagtcccctggccattccagccactggaggaaggagtgtgggtagaagagtcagcctcaggcagagaatttcattcattcctccattcaacaaatatttactgagcaaggttcccctctgttctggggacctggggacacagcagtggacagaatagcagtt

SEQ ID NO: 91119 - DNA, 1084 bp, Homo sapiens
ctctcaggagcagagatcagatggcacccaggcgtcctttctgaagacccagcaccctctccccaatgcgccaggaggcccccaaatcagactctgcaatagcatcctgggtattgagcaccaacggtgtgtcaggccctgagttctgggctcccacgctcccattggctctatgatgcctttgtccccgtttttacagatgaaggaactgagactcagagggggcgctgtgtatccaggacacacagctagtaagaggctgtactgggattcagacactcaaccccaaggtcacattaattgagcgatccgtggggtctcactttaaccctcacccagcgtggggtttcactttaaccctcagccagcccaggatgcttgcttcattttcaaaggaggcatgtgacccccggggaccagtgctcacacagaagctgggcctgagccctgtcccctcttcctccaggaattgcatcggacagagcttcgccatggccgagttgcgcgtggttgtggcactaacactgctacgtttccgcctgagcgtggaccgaacgcgcaaggtgcggcggaagccggagctcatactgcgcacggagaacgggctctggctcaaggtggagccgctgcctccgcgggcctgagcgtgggcgcgcccctgcggctcccgagggtccaggccccgcccccaaaggaccaggactcgccccaaagatcccgagggcataggccacccccctcgaagttcaggttcagctcctggatgaccaggcaccgctgttgagcagcctggtggtactggccacgcccctcaaggcaaggctcctccccttagggggcctgatcccgccccttgaggcttaggtcccgccccctgacttctcgcacctgtcctgtttgagggaccagggtcgaccctgcccccttgggctcaggccccgcccccaggatcctacggattgaggtcctcaggccacgcccctgcagatccaggtctccaggccttgcccactgagccttcagaggacctaagacccacctatgactcagggcccaccacaccccacccccccccaactggctg

SEQ ID NO: 91120 - DNA, 1393 bp, Homo sapiens
cctcatgatttacgtggccttggaagggcaggggcagctgtaaacttggggtcccagagtcaccttggccccaggttcaagcaggagatactgaaggctgaagatccagtttccactctgaactgtgacactgacttggttcctctctgcacccagctgatactgcctgcaggttttggccagctgcccaggcagggaggaggcagccaggcctatggcctacggggattggctgcccctgactgcccagcccagcccagccttgcctaggtgaggggccagggacaaagaagccccaggaggagggaagaggaagttgtgtgggacaagctgctcctgacagaaggtgccaggctggaactgtcggggctggagggtcctggtctgggagagggaggggcactgcccaaggctggggtggctccagggagctggtcctggtggggctgatgggttcctggtaactgaaaccaagccactgacaacctgcagtgattcaggctgggcctttcaggactctaatcagccttcctctctctctttctctcttccctctctcttctttactctcttctctctccgcctcttctcctggctgtacctgggtttccctctctgctttcagcccttgttttctcatctctgagctctccctgcctccagcacctcccatccctgcccctgtccaatgtccccgaagctccccgggctctttttctgggcctcaggacctcaccctccatcccgtgtgccctgcaggatgtcgctgctgagcctgtcctggctgggcctcgggccggtggcagcatccccatggctgctcctgctgctggtcggggcctcctggctcctggcccgtgtcctggcctggacgtacgccttctatgacaactgccaccgcctccagtgtttccagcagcctccaaaacggaactgcttttgaggtcacctgagcctggtgagtatggcagcacgacgggtctggggtctcagggtgggtggacttctagaggggtgggaatggggctcagggagctggatattgagggtgggttggggtctgggacatcagaggagtgagggaggccgaggggagcccctatttcctcactgccccaaccggattcattcctcctctctgtccactccatggccccaggcctttttctttctctctcttccccaccctaagcctgctttggctcaagttcctacttgtcttccccacattaatgcatcgttgtatccttgttctactgggggcttctagggtggactgcacagagcaggtactccctggctgcccatgttttttttttttttttgagacagggtctcgctctatcacccaggctggagtgcagtggtgcaatcatagctcaccgcagccttg

SEQ ID NO: 91121 - DNA, 1017 bp, Homo sapiens
tgatctcagctcactgcaacctccgcttcctgggttcaagcgattctcctgcctcagcctcctgagtagctggaattacaggcacctgccatcacatccagccattttttgtattttttggtagagacggatttcaccatgttggcccagatggtctcaatctcctgaactcatgatctgcccatctcaccttccaaagtgttgggattacacgtgtgagccactgtgcctgacccaaagcagatcatcttaactattactgaagatttgacaggggggacctaaagagggcagtgggctgaccaagggtacatagggcacagaagcagagctggaacttgaacccaggtcacccgaaccccagccttgggccttcatgtcctaatagtaacagcttctgtccctcacaagcttggtcctccttggggatgggtacccgggaaagacgactaggagttggttctgggggagtccatcctggaggttggggacgggaagggactcaggggagccagggctcagttcctgctctgtccccttctctggccaggccaaatggcaacgcctggccttggagggcagtgtccgtctggaaatgtttgagcacatcagcctcatgaccttggacagtctgcagaaatgcatcttcagctttgacagcaattgtcaggagtgagttcttccccaggacctgggatcttggccatggacccacaggagtaggttatggagagaggactgatcagggcatctgaagtgtcttcttggagaaaatgagtcagaattgagcatggaagtacagggaaggggagagagaaagatcagttctccaggtaggtagaagtgtttgggtaatggcaaggaggctaggatgagcagagcacgtgcaatggccatcaaggggacaccttggaaatgagattggaggggtcagcagtagctacaacttaatgacattgaaaagccatgcaaaggggtatgaacttcatccaaggctcccagggaatcatgggaggt

SEQ ID NO: 91122 - DNA, 1062 bp, Homo sapiens
agaaagccagccaatccacactcccctgaaatggatgctaacgcccttcaaaccctgggcattggtttcatacacagcctcttccagggataaaaggggttcttgtacagcttcttgttaccctcaaccatggaggcaagttctgagttctggttttcctaggacactaactctagtcacaaagatctctggagtgatcacacatggtggagtggcagggtgaatatttcaaaaggataagtagaacaggagtcttgcccaagccctgtcatgtcagtgtctgtgtgtggcctcccagcccaaccagaaattgacagagaggcatgtatatggtgaaaagatatatatatatatattcagaattaggcagctgcactcagtttagataatcccaattttgttggcaacatccaaagcatcgtaatcaggagtcagtcgaacatataccttcttctctccatcaggccgaatcagggtgttgaccttggccacatcaatgtcatagagcttcttcacagcctgtttgatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgtggatcttctttttgtggctgtggacacctttcaacactgccttcttggcctttaaagccttcgctttggcttcggctttaggaggggcaggagcttccttcttcactttcggcaccatcttgtgaaaagggtccaaaacaaatttttttaaataaataaggatttggtacagtggggacacagttgatccacaacataggtgagtagttctgtttcgttttgttttgttttgctttgctttgttttttgagacagagtctcactttgtcacccaggctggagggcaatggtgccaatctcggctcactgaaacctccgccccaccaggttc

SEQ ID NO: 91123 - DNA, 1081 bp, Homo sapiens
caggacttccttgagcatttcttataaggcagaaaatattctcaggatgtcagttcttcccaagtaattatgtagattcaatgcagtcccagtaaaaatttaagaaggcttttttaatggatatcaacaaactaactctaaaatgcacatggagagacaaaagacctagaatagtcaacacactgttgaagaagtggaatattgtttgaggaatgacaatatcccacttcaagacttactgtaaagttacagtaatcaagatgttgtggtattagtaaaagacaaataggtcaatggaccagaatacaaatcccagaaaatagacccacgttaagtataggcaactgatctttcacaagagttccaaggaagtacaatggccctaaacaagaaaatataatgtatttggagataagaatcaaggacaaggtgactgagtgtaacaagggaggaatatgagctggagagaagatttgacaagtctgcagggtgcagcggtgcagaattccttaggctatgaacagaggtcaatgtttgtggcaggacatcattttaaaacattaactgaggcttctttccttctcctaccaccttgcactttcaggtgcccgcaaccagtcttagaaaaaattgcctcctaaatgcacagccctctaaaaggcaagagattattcaaggagcacaaatattacaatttttgcctgtaagttccaagacagtctttaaagtcgtggtagaaaaaaactatcttgaaaggcaacatggtttattagccagactttctcagagaggaggtaataatggccacatttattaagcatccaatatgcaccaggcaacaagttctgagttctccacattttgtcctcaggacaaccctgagttaggtagtgttgttgcccacattatatgtttgaggaaactgaagtgcatagaggggaattaacttactcaagtcacacagcaaagatgagacttcagcccaacagtctggctccagatcccatacctttgggatggtgttctgtttccagtcatctgtctttgaatctcaagggtcaaacaggatgttcctgactgc

SEQ ID NO: 91124 - DNA, 1020 bp, Homo sapiens
ccttgcctgtcccaaagcctagaacaatgaggaggacttgtggctggtgggggatctgggctgctacttccatgatgtccacctctggtgggtcaattccctttaccccatcctatagcttgtctgccctaagttcgttgctctcctgctgcaggtcccggggatctccaagaggagactccaccccagcttgggtccctttccttgacccctgtgcttcccatcgttggacgggcgaggctgagcagggggaatgggcagcatcctacagagaccatggctctgacctcaaaatgctgagtgactctgggctggtacccagctgtctctggttattgaagtctctttcagttgtgagtggtggaaacccaacctggtgtggtctaagcaaagaaagataatctattgactttaaagtccagggagggtggccttcaggcatggctggatccaggtctcacacaaggtcactggaaatctgtctttctctcttggctttagctttctccatgtcgcttttcctatcaaggtggccttttcctcatgatgtcaacgatgagtcccagaagctcagttcttatgggaaaggccacctttcccctagagttcccagaaatggcccatggtttacttctcctggcctggatcacaggaccaatttttcacccaatccctgtgtctctgattgcccagtcttggtaggcctgggtcttccagagctactgttttgggggcacaaagaagtttgttggttaaggattcaggccatgggtgcagacagacctagtcttaggcctcaggcttgccgtggtctgggactgtgggcaagtgactttattgttcagagcctcaggctcttcatctggaaaatgggatgaatgagagcccagggaacatggtgtgtggatccacatggggaaagaccttttctgtctgtgtaactgaaggactggagagtcctgcatggaggatgtgaggaggcagggggtgctcagcactgacaggaggatgagatgctgc

SEQ ID NO: 91125 - DNA, 1019 bp, Homo sapiens
gcagggttggtcagtgtgtcctggatattggggattggtcaatgggggaccaggtcggtggagacctggtcatcggggcccatttagtgagggccaggtcatggaaggcccgggtgatggggccctggttgcctggtcagttggacctggtcatcccaggactgatcctcagggaacactctgacttcaccaggctcccctgaccatgccagtccctggcctgcagccaatggtgtcctttgtgtctctcccagcacagacccaggcccaggggatgcccaatgctgggaggaggctcagacagcaggaaggagagaaggaaggaaggaacttccgtagtaccgatgcctacaaaattacaacacgtggtgctgtttctactccatcaccatgttcgctctttatttcctatgtaattctctattcaaccggcctcagttgagcacaaaaccatccttgtaccaccatgaatagttggccatggctctttgatagcaatttttgttctgccgtagaaattatccttgaaccagaaaaaaaaatccccaattcaacactccatttttgtgaagagctggttccgaattctgggtcactttttggaaaaaatatctgttgtggtaaacagtgctgcatctgtgatctcaagtctctactggaattggatagagatggtgaatttcagccagagcgcccaaagaactcgtgtcccgcgctcctgaacgccatcagccgccgcacctccatcttccctcctcccacgagtctcctgctccccgtgactctggtaagagctcctctgtgaacgtggaggtggtctgggaagttggcccagtgctcctgggaccgcactaacaggtccgagacggggtccaggtcctgcctgggccaatccgggaagagcttgccaatggcatcacaggcacctcggggaaggggatggtttggttcaggaccacccagaggcctgctgggcccactccaaggcctggctgaggccacagaagggctggccgcct

SEQ ID NO: 91126 - DNA, 1050 bp, Homo sapiens
gacgcgcaggagaagctggagctcacggagaagaaggcctccgacgtacgtgtgcagggatgcgggagcccgcggcggggccaggccggagccccggggccgggaaggcggggagagccgcagggggaggaggaagaggaggaggagaaggcggcgcctcccagcgctttctccaaataagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagtgagcgccccggcctcgggccccgcacccgcagcctcctcccccgcgcgccctcctttcttcccggcttcccgcgctgcccgcccgcgcgcagtcctcgggccgcctttttacgccctcggacgccgatcgccgacccacatccctgcgcccgcagccaggaccccctacttcctccgccgtcctccttcctgggcctgggacaggggagggggcgccgcctccgggtcgggcggggccggccaagcgggaaatggggggatggggcggagggggtgagcgatctccgggtggagaagtggagcggcgggagggggcgtatcgtgcaggctccgactccggggctggcgccggggtcccgggccgaggggaacccgcgaccggacttgtgggggagaatgaggatgaaaacgtggagcttccattgtctagggtttgaccggccgacagggatttcgacgggggaccggggatctgggg

SEQ ID NO: 91127 - DNA, 1034 bp, Homo sapiens
taagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttccgtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctcccaactccagacagctgaaaatctgccaaaagcgttgtttgccaggattcagaatttcccacataagggctactcacttcttaaaagacaactcatgaatcaagcacctctgtttgatctttaaaatcaattcctcgactgctaatgggtacacagttttttgtttgtttgtttgtctttggcgggttatgaaaatgtcctggaattcgataatggtgttggttgcagagtgtttttgcaacatcagttcctggcccagttactgaaggtggtaggaggagttaagatctaggcaattaaaaagaatgaaaggcacccattcatgggaaggcctcagtgacgtttcttaagacagtttcatcagtggttttcacaattctctgcatttggtgtttcagaggacactgcaatacgaaacacctgtgggagtgc

SEQ ID NO: 91128 - DNA, 1089 bp, Homo sapiens
acagcggtatctgagagcacatgcccagtttgcttttgttttcacgtcttcagaaaagcatcctgtaggcataattttctttttgtaataagcttttcatttgtgagtgagagaggctaaccacccactttgtgtttcaggctatggttaagggcacacagctacagctcaaaggcagcaagtggagaaaatgagaatgagggggcatgaagaggaggactgcccgtctttatttcggttgtagagtcacagacacatcagaagaaggctctgacgttcaaaccagaaggcaggccaccggagctcctagaagcccacaggggcgtaggaggcaccatgtgagaaggacagagggcagcgacctggctgcctctcagagagaggtcatgtcgttgagagcgtggtccagttcctcgctgatagctttgtacttgagcttctgagcgtataactcatctagagggcggaggtccccagggagacagttcagaagtacaggggacagaaggcaagggtcggaatggagtgccacagatgaaccacaagaggaagaaaaaaacacgtgagcaaacaaagcacagactaggagaaagctgtgttccatgtgaaacagatgaagaaaaccaaagatctatggagttgatctctaagtggtttgaggttctgcagggggattagccacaatgaagcttcaaaacagtggtaaccagaagtgacagagcttccccccactggtccccacccctcagtttatttcggatttccaatgacgtcaccctgtccaaaggtcgtattttggaatggggcattttcccttatatgggaacctcacttccccaaaaaaacattggaagatatggtctgaagaatgtgtcctttctgggtgggatgggcagtttggaagattccatttgaaccccaagattctggaatttctgaggccgaatgttaaacactggaactcttgaaaaaattctgggagaagtgggccccagacttgcagactagtctttattgcagtccctacactttctgtatttctgtttttttttttaaatactatgataagctttgagctccctgggacag

SEQ ID NO: 91129 - DNA, 1020 bp, Homo sapiens
tcacagttgtaagataaaatgcagggcgcccagttaaattgaatttcagataaaccacaaataatattttagtgtaagtatatcccaaatgttgcatgagatgtacttatgcaagagatatacttatgattaaaaaattattcattgcttatctgaaactcagatttaagttggtgtcctgtatttttccttgtgaactctggtaacccttgagtcagaatacctgaacttaagctccagttgtatcacttaagtaagcatctaaccttcctaggtctgttttccccgtctgtcaaatgggggtaacgatatcaatgcgtggtgtgggggttatgatgaggaataaaggagaaatacttcagaacctatgacgtgctgctacatgaagatttcagtcctagatatgtgtgacttaatataaatttccacccaagtgctagttaattagcccctgagcctttgatagttaaatctaaaatcctgtaacccatctttccttcggagcttctgggaatggctgtttaaattatacacataattgtgtaactgtctatgaatccaggagaacggagacaaaccccaggtaaatgcgaaatttaagccattctacaggcatgttattaagtaactgagctgatgaaacaatttaaattaaaaaagaaagagagagagaaaaaagacgccatttagagctatgcgtgacagagcacgagagagaacttagtttgcagtaagtgatggctgataagggacaaggccaagactcattaaaatgctgggggaaagcaaaatgcctcataaaatgtgatatcatcagcctggaaatttacagaaagaaaaaaatgactgcagaagatggcagcctttcttatttatttatttttaaacagggtcttgctctgttgcccaggctggagtgcagtggcatgatcatagctcactgcagccttgacctcctgggctcaagtgatccttctacctcagcctcccaagtagctgggactacaagtgcgtgccact

SEQ ID NO: 91130 - DNA, 1032 bp, Homo sapiens
agagcaagaccctgtttaaaaataaataaataagaaaggctgccatcttctgcagtcatttttttctttctgtaaatttccaggctgatgatatcacattttatgaggcattttgctttcccccagcattttaatgagtcttggccttgtcccttatcagccatcacttactgcaaactaagttctctctcgtgctctgtcacgcatagctctaaatggcgtcttttttctctctctctttcttttttaatttaaattgtttcatcagctcagttacttaataacatgcctgtagaatggcttaaatttcgcatttacctggggtttgtctccgttctcctggattcatagacagttacacaattatgtgtataatttaaacagccattcccagaagctccgaaggaaagatgggttacaggattttagatttaactatcaaaggctcaggggctaattaactagcacttgggtggaaatttatattaagtcacacatatctaggactgaaatcttcatgtagcagcacgtcataggttctgaagtatttctcctttattcctcatcataacccccacaccacgcattgatatcgttacccccatttgacagacggggaaaacagacctaggaaggttagatgcttacttaagtgatacaactggagcttaagttcaggtattctgactcaagggttaccagagttcacaaggaaaaatacaggacaccaacttaaatctgagtttcagataagcaatgaataattttttaatcataagtatatctcttgcataagtacatctcatgcaacatttgggatatacttacactaaaatattatttgtggtttatctgaaattcaatttaactgggcgccctgcattttatcttacaactgtgactcccaaatttggtgcttgttccttagtattctgtgatgttctgctgtaattaaaaatacaaagtactggacaggcatggtggctataacccacctgtattcccagcactttgggaggctgagcagatggg

SEQ ID NO: 91131 - DNA, 1471 bp, Homo sapiens
gtctgtaatcccagctactcgggaggctgaggcaggagaattgcttgagcctggcaggtgaaggttgcagtgagccaagatcgcgccactgcactccagcctgggtgacagaatgagaccctgtctcaagaagaagaaaaaaaaacaaatctttttttttctttcatttaacaaagacgcttattaatttatctttccccatactcttaatcctcaccagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctct

SEQ ID NO: 91132 - DNA, 1089 bp, Homo sapiens
atcttcctaactcaggcaacagagatgattttccctgcttttatctcttaaaatcctactcattcttcacagcctggcttaggcagcgtaggggataaggaaggccaggagttttcgagtgaccgaggctgagtgctctcgcctgcaatgagactgtaatatccttgtatcatgaagtcacagtataaagcaaatagataaccttgtctacattcttggctctggttattttccctttccatccctttaacatttgttgaaccaaaatgctctgtgtacccccacacattctaaaattcacgcaaattgtagtttatgtaaaaatttatttgaccaaaatgtagaaaaagtgatactattacatatgatacagttgcaagaatctaaagtgtggattttattccattgcacaatttgctagtgtatttcctgggtagtgtggtgctgaataaataggagtagggtggtggggtggggtgggtaagggattcagataagccagaagcagggtgatttttagttggaattgtaaactttagtcagcccccacacgctgctggggaatgtggaatgttctagctctgagatgttaactgagaaaagagaagtcaaacaaagccgatacgtgcagccctgtctacagaatccttcattatccagtttaatcaggagtttcttggtcttttattaacttggtcccaaagaaggaattcaagtcctagataagtaaatcctcaatttgctgttccctgaagtatggaaatgaagttgggccagtttttaatctctgctgccagagaggccctttctgctaatagataaaaactcttttgctcaacttagtaatgacttgtggtcttttggatatggctgacctgaattggactgaactccaccatattcctgctgagtgggtcattactggaatgagacatttgctcttcagagaacaactttatttttattttttcttgagatggagtctcactctgtcgaccaggctggagcgctgtggtgcgatatcggctcactgcagtctccacttcctgggttcaagcgatcctcctgcctcagcctcccgagtagctg

SEQ ID NO: 91133 - DNA, 1042 bp, Homo sapiens
agctgacgggccagtgggacacagaccacccgcagaaaatgaatagcatgtacaaaagctgggggcaggagagaacgtgaccatgtgcattgacgcatggtggggcctaaggccctgtgtgcctgggggttggtcagctgcagggtgttggggagcaagggactcaggcctgcagagggctctgttgagacccactccgtacaactgcctggggtggggaggcgggttcagctggcagcaagggacaagagcagggctttgccacccgcgccccctgggtttgctctgcactgctcccatcagctcttggagagggaaaatatctccaagtgtttccagatctggatattccgacatcctgcatgcccagcaccaggcagggtctccgtaagccacaacagctgtcacctgcacaggttggtggcgcccagctcagacacaacttgggaaatgggctgacagtgacgtgccttttttcttttttctttcaggaattgactttaaaattaggaccatagagctcgatggcaagagaattaaactgcagatatggtaagagtcattgttctctgtcattctctccacctggcaatggcttcaagccagaagcccttggccttctccctccaccgtccctgtgaccttggcctccatttcttggtgcccagtcctggcacatggggctttctccagaagctcctggaggtttatacccagcccagagagctgtcctctgctggctgcagggcaccagggcctacagcatcataggcacaaagctgcccagccctggctagctcagtgttccacagtgggcaccatctgggtctggccttcagagtgggctgcttctgttgaacgggaagagagccctctcagtgccaggtgctggtgacgcctgcagggactgtgagatgccccagccgagagtttccttttgagcctctcaacccactcagaagcataaaggtccaacttcacttcctcttttctcccctggggcaggcctggcctcccttcctagcgtacagaccgaaacccc

SEQ ID NO: 91134 - DNA, 1072 bp, Homo sapiens
gccgagatcatgccactacactccagcctgggagacagaacgagactccatctcaaaaaaaaacaaaaaaaaaagtgtcaaagcagaaggtcccaggacaacagctggggcctcttgcagaggagccagggagggaaggaggaaagccaaggtcggggggtaaatatctcagcctcactcacctcccataggctagacccgcccagcatcccaggtgcgggggcttgattgatacagccatagaagctgccagaaagcatttcagaaaatgtgcatttgctcagagtagcagctagaaccctggccccagccctggcattggctgtgtgacatggggccggctgcttggcctctctgagcttcagcttgtcccttagaccaggctgtacctagcagtcctgaccccaccgctctgatttctggggacagactgtgtgttggcagaggcacctggcctgtgtcatccggtctgatcccccgtctgtccccctccctctcagcacgcctctgcagacgtcgaaaagatgatactcgggaacaagtgtgatgtgaatgacaagagacaagtttccaaggaacggggagaaaaggtgggcatggtggcacaaggggcagagggcctcggggtcttggggttcttgtgcagaggccttcccctgtccctcctctgccccaggggcctgagacgagttggtcaccccagtggggcacgtgccatgggatgacagaagcacacacccagccggggcttcttgggtgcactctgcgggcatctcatcaaaacctaccatggccccgctccagactttcaagaccacaggagcggggaacagagccatagtttgatcccagcaggtccccgccaccctcccatctcagctgccatccccagcaactccatgccctgtgaggccctgtggaggggcattcactatagaattgagggagtgatccaggaagtcacgcccacagccccagccctgttgctgctccctcttggcgccggccctgccttcagctcctgttttaggcaagctcagatgcgcccggcggctggtgtgctcatgcgtgt

SEQ ID NO: 91135 - DNA, 1679 bp, Homo sapiens
gcattgctggttcatttcctgccactcacgaagctggcaagtgacctgggttccctgttggaccagcctgggtggagttgagggagggggacaaggcacagagcctgaaacctccagctgttctaaatgtgagagccagtctggccaggctccatcttccaccccatgccagcctgggctgtgttgagcctgtaaactcacctccatgtctcttctctctccagcaaatggaaaggatcctaaagaaggcatccaaaacccacaagcagagagtggaggtgagtcgccgtgtccagtgggggagactgagccattcagggtcccagctgggcccagaggctatcagctggcagagggagctgttggcatgttgacgagaagggaagtttacctaatagaagtgacacttccccagggttattcaaaggggagcccagggttcaggagtctgtaagacctggcagggtgagtttgagaggagggggctcaggagagataggatgtgggagaggtggggctgggcagtgccacttctccccagtaccccacttgggtctgcgctgacaccggccttctactccacctccccaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaag

SEQ ID NO: 91136 - DNA, 1050 bp, Homo sapiens
tttatttcatgggccaaggcttgtgtttccaaagccaggaagggctgaagccagaattggccctggctgcttgccacagagtctggccgggggaccctggacctcagcagggtcatgatgaggtcagctttggaggagcagggccagtgtgtcctgctttctgctcctggaatgagcctcactccctccctgctcaaggcagcccttcacccagccgccgggacaggtgccctgtgccacctgccatccctgtgattctccatctcagtgagtgctccctggggcctgggagcgcatctggctggtgactcctgtgtcccaggtctagcttggaccaggagctttgtagcccaccatgggccaagtaaacggctgggagtggggatagggaaggctctgagggttgtgagggttagggggtccctccatgaaccaggatcttccaggcagcagccccagcctctgaatgctccttaactgtggccgccatgcagtggttgccacatccaagaagaacgcgtgcgtgtcgctggtcttttctttcctctataaggtggtgcaggtgagtctcgctcggaggggccgtgggcttgggtggaggttgtcttggctctgcttgtggacctccccatacctggccaccctacagagagctgtggcatccccagggagcactggggctggaagcccaggaagtgggaaaggggagtcccaactccccacgcctgtggaattctatagctcacgttgctcccctaccgtggggaagaaaggaaagtgaacaggaaaaggtagggctcagagcaggggtgccctgaccctggaagggacaagcaggggtcagcgagctttggaaggatgtggggtgaccagctggatggggctggaataaccagcagagctgcagagctgagcccacctcagaatctcccagggggctctcaaggcacagatgcctgacgcccaccttggagagagctgacacgccaggcccaggctgccagtgagacacagatagcagccagggtgaaggcgccaggacaggtgtat

SEQ ID NO: 91137 - DNA, 1050 bp, Homo sapiens
cgtcccttccttaaccttctgagctttccattgaaatggggaagatgcatcaagctttccactgaaatggggaagatggcagctcatcaggtccttgcctgagtcactccagactcagaaagggatgacagttacagtcgctcaggaggggctgcctgtctgcgggtgtctgggcagggaagagaatgggaacgcagagcttctgaaggcctcgggacatctgcagtggctccagcctggccccaccccacagccagccactgctgtcctgccccataacctgggtccagggccctgtagcacaccaccgagcctgggaagtaggctgttggtaggacttagcgggcaaatgaatgtgtgcaagcgttcattcattcctcatccgtccgctcaatgatctgcctcccattcctccctccctccccaaccgccacaggtgttttccgagtacttcaaggagctggaggaggagagcatccgggacaactttgttatcatctacgagctgctggacgagctcatggacttcggctacccccagaccaccgacagcaagatcctgcaggagtgagtgggcaggggtggggcctggggccaggcctgggcggtgtcatgacatcgacgtcatcaggtgtggaaacagaaggggcaaatttgtgttcatgttgtcccccacctgcctcccacctccagcagtattcgggtttttactaagttgctcttagtggttttaattcgtttcctcctctacgcccccacataaccgtgcttttcctgctcctcatctttactctccatccacacagatgccttcagtaccttgctactaaggagtcacctcccttgtttttactgtcataaaatgagactgtgatcgaaatctcccctctttggaatcctgcccttcagataagaagcaatgtgaattaagtgcttcctgggggccgggccccagcacttcacattcactcgattcacagcctccccgtataccgtctccccattttacaggggacaagcaagcagactcccagagaagcctgtgttcct

SEQ ID NO: 91138 - DNA, 1656 bp, Homo sapiens
gtggtcccacaacagatgaggggcccagcctcacccatccatgaatcctggagactccagacttcccatccatccagggttctgcagccctctctgaggctggagccaatctccccttccgtcaagggatccggggagaccgccaagcccggtgctcccctgagagtctctgagaggccccgacaccgcccccgctccaggtccccgggatgctcgcgcaggcgggagcccggggcgcccgggggatccctgagcgtcacgccgctgttgtggagcgcgtgttgacaacgtcgccggggagacgggcgggggcggggcccgggagagggggaggcgcggccctggcggcgcgcgaggggccgggctgtcagcgcaaggcccaggccgccgcagtggccacggccgctgccgcccgccggcttatataccgcggctaaatttaggctgcgcccggagctcgtccccatccgggacgcgtttccgccgccgccgctttggcccggcccccgcgcgcgccgcgcctataaggcttgggcgggcccggccgcggcccacagagccgtccccgcccgcccgcgccccgaccagcccggcctcgggcagccactcaccggtgtccccgtccgcgtcctttctccccgggtcccggccatggcgctgagtgaacccatcctgccgtccttctccactttcgccagcccgtgccgcgagcgcggcctgcaggaggtgagggcggcggggacggcggggcggccgggaccgtgggcggcgggctcggggtagtagaacgtgggctgcggggtgacaggacgcgaaggcggggactgcagactcaggagaggaggatgcgggccacggggatcgcggacttagggtggtaaaaggcaagcagcgccccccgagccccgccgcccgctcacgcccattgccctgtcgcccgcagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctc

SEQ ID NO: 91139 - DNA, 2264 bp, Homo sapiens
gtgtcttagaatgctggagagagggtgcatgcttaggacccgtcggggagcgtggctgacaacagtggggagtggaccttgcgctcctccgaccccctgggggtgaggatccggattgtggggggagttggggatgtagggcaaggatccctcaggggcgcaacactaccgcggggagcgcgtcaaggccctggttagggataggttgcgctcgccggggtagccatacgtgccctgtcctgggaggggaactgacgcttactctcgccccctccctgcaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaagcctctgaggttttagccaaatttctggagtgccagctctatatttttatttttatttttaaagggggttaacctgctgagtttctggcatgttctgccctttactcgtctcgacatttagcaagtcttttcttaaggggtgagttccccattctgctagcggaaaacagtgaaacctgcattcgagggccatgcatgaagctcttttccagatgaggaaacggaggcccggagaggtagcggcagggtggtggagttgggttgttagcctgctctgtctgcctccaagggtccctgaaccccactggaagggagtggtagctttctacaatgacccacctgttgtgtgcattggaaggctaggagagcctcctcccctgtaggtctcctggtgcaaaaaattcactgcctcaatggtaggaggtgaccagtctggaaacccacctggagagcagaggagacccctaaatcccaccaccccaagtgtctcaggcaaggaggtatctctccccccagatttcacctgccacccctcaccttccccattctcaggggccccgggtaaccatgaccaccaaccattgcacaagtttccagaaagtgaaaatagctcgtaagcagcgcctgctttaaaacactctcaccccgttgcgacagaggctgggatttcctccctccctgcatccttcctcctccccaactacggcagccctggaaacagctgagaggtgtttggtaatccacgaaaagcagaaatacgatttgacaatctgattcattttccgagagtaaatagcctggcctcacttccgctgctgatgaagggtgtgaatgtttttgagcctcctgtaccctctgcgtgcagcttctgcaaaaaccgtcccaagacagaatgttggcccctcgacctggggagatgatccccctttttaaaagctggcctctgcagtgcaggggcagaaga

SEQ ID NO: 91140 - DNA, 1048 bp, Homo sapiens
aatcacatgcatcccgtccactctgctttccagatggggggcctgagacaggctcgcacgcccactgggcccagccaagacatgcttatcccctgcacatcggaccctccgctgggcggtgggcaggaccctgacccctcccacgcattccctgcctccctccagcttgcaggtcccagccccagggccacatcacccactctccgtttttcctttgcagtttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccacccgccctcccacgcatcagtcagacactcccccagtggtgtatgcactcgttgtataaaatgaagtttgaatgattaatataaaatattttaatacaaaacaagagaagcttctttaatctctgtaaacattgttttccctgcatgggtatcaggaagcagatcaaccaggtggaacattgctctttaaatcttaagtttttacttttaaaaaaaatttttttttaagagatgagatcttgccatgttgcccaggctggtctcaaactccttgactcacacaattctcctgtctcagcatcccaaagtgctgggattacaggc

SEQ ID NO: 91141 - DNA, 1047 bp, Homo sapiens
tgggaggatcgcttgagccctggaggccaaggccgcaataagccatgattgcaccactgcatttcagcccaggtgacagagcaagactctgtctctgaaaaaaaaaaaaaaaaaaaaaaaaaaaagaacttaaacctcagcatggcagagctgtgtgcagacccttataactaacacaccgaataaccataccacgttgtgaaactaattcctccttttcatttgcaagtaactctcccctctgcctttttttttttttactgttagaagcttgcagtgtatttttctgctcagccatgattttttaaattagtatgttaataaatgtgttgccatgctaaaatgaatctgtttgaaacgtacctgcatgcaaactattctaggacaactcaagttttagctgctctgtgtgcgttgtgtatgggagtcatctgaagtgtttttcctgtgttgttcacaacccgttaagcccctgggataaagctgattaaaactgggattccccagggtacccccgtccagcctgttagccaagttacaagcttttctcagagaagcgccccgggcttgtgcccaccagcattctgctctgtccgggtgagtaactcatatttctttctttctccttttttttttctcctaaactttccaggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaa

SEQ ID NO: 91142 - DNA, 1616 bp, Homo sapiens
gcagctctgggcaccgcctccctgcttttctggcggggtgaacatggcccctcatctttcatctctcctattcaaagccctgagtcagcgcgccccttgcctgccactgctaactgcaaaatatcacatgcactcgggcaatggggaatctggccataaagagagcaaaagtgtcccccaccatgggagctcctggtgggctctgcgcctcacttgctcccctcccaggggctcttttgggtcctttcatgcacgacccctaaccagctttcagactcgctgcacggcgttctcagggatcttgttacatgtgggcaaggcgccttcctaccctttgcagaggtggcgtctgcgacattggcacactccgtagggaggaacaaagctgggcccccttgccctgtcagggctccccgtgcctggctcatgcatagatagcatctctccctggaaatccccccagaggatggggctgacacccaggggtgttcacgcagggtatgtcaaaggtgcccgccagagaacaaatgcgaattttcaaagaagccagaattgtgacacctgccagtctgtattatttttgtcatgaagactggcttgtgatttgtaaattcatttccaaatcacataccccaccctacacacacacacacacacacacacacacacacttttttttcttccagggctggtgcagcccttgcctggcaggttttatgtaaatgtcatgggagccttttgtggtgacctctagaaaattgttatttctcacttcaaatgatatttgccttttgaggaccccaaggcacagcaccttttccccactttcttcttttaatggcaagatgaggccacagccattgggttcaacagccccctgcccacctcacacacctcacagggcaggaaaacacagcggccagcagtggctcgtagtaaatatttgttcagcttttctcaacagttcagaaccaaacctcatcctgttcccttcaatgcatgaagcagattttctcaaaattcggtaaatatttttagtggaaaatctcaacgctgcgatcgcagggacctcagattcttatctcccggggctgtgctgcttgacacagctttgatctaaggcagagtgcgcgcggggctggtgcctgcaggactcccagcctgcaggtcccttacgtggtcccgtgtgtcacattgtaaaaaacaaactcccctcatgtgtcttagatgggagccagaggaagacgttgacgtgtgttggggaaaagcactctttcaagacaagtccccgagcagtgatgaattttagaacctatactgttttctttctcccctctccccgcagctaagctttttttctggcaggatggggagggtggaataagacatgtcagtggccttggatgagctctgctggagtggtgccccgcccgggccactgctctcctaggcagcgtgactctcagaaacctggcagttgtatgggcatctgtgttgtgtaggatgaatgacagttgtggttgtgtgggatcacctgttgtgtagggtgaatgacagttgcataggtgtctgtgttgtgtagggtgaatgatggttttgtgggatcacctgttgtg

SEQ ID NO: 91143 - DNA, 1871 bp, Homo sapiens
ggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgctgccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagcatttttctggcttgtttctatttcttaataaatacttggaagagagatttttgtttactcctgaacacttcaagactgcttcagagccgagagagaggtgtcttagttctcccttgtgggtcgaagttgggggttttaggtccctgagaatagtgtatccacagtggtacatctggaacttcctatgtttggacagttctactcaggttactaaattccatgtgaagctcacgcagtgtgactttatctcaaaagtcaggggtttttttttttttttgtttttgtttttttttttttgagacggagtctcgctctgtctcccagactggagtgcagtggcacaatctcagctcactgcaacctctgcctcccgggtccaagtgattctcctgcctcagcctcccgagtagcagagattacaggcacgtgccaccatgcccagctaatttttgtatttttagtagagacgaggtttcacagtgttgcccaggctggtcttgaactcctgacctcaggcaatctgcccgcctcgacctccccaaatgctgggattacaggcgtgagccacctcacccgccaaagtcagggttcttaaagccatatttatttcttgtctatcatctgattatgagaatattgacctcttgctcaccatccaatcaacttatggagagaagctaataaatcatcccagacttaggccttactgaggacaga

SEQ ID NO: 91144 - DNA, 1050 bp, Homo sapiens
tcttctaacccttagagtttgtagttgggtgtcaggagcaaagatatgttgctttgcgcagtgcagtgccttacacctgtcatcccagcactttaggaggctgaggcaagaggatcacttgaggccaggagttcaagaccagactggacaacatagcgagaccccatctctacaaaaaatacagaattttttttgtattttttgcagagatgggtcttggtttgttgcccaaaaatataggtggtgacacgcacctgtagtcccagctactcaggaggctgaggcaggaggagctcctgaggtcaggagctcaaggctacagtgagctatgatcactccactacattccagtctgggtgacagagtgagaccctgtgttttaaaaaaaaaaagcgtcttttctgacatgttttcctgaccctgcttaatgctgatgatgtctttgttgcacaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggttgaataaacgtattacagtatggggctctggtcccctggtgtgacagcagaacatcccacccgccagatctgttcatggccaacgttggttccagccaagtgcaggcggctgtctgttgtttttgctgccactttgcgcgttcacaccaggccttgcagcctggcacaggtggccatgctgaatcctggcttccagaacaaagtccaagataggcctggatcctttcagaacctgttttgaatgccctccatctctgcggaagtatttacattgggccaaccacccaagttcagagggcttctcaaacttaaccaaaattggatcagtttctgctcattgtggaaaccccacattctactaatcagggggcaggggacatctgaggggcatgtgtctatgtgtatgtgtgtttccacaaggaac

SEQ ID NO: 91145 - DNA, 1002 bp, Homo sapiens
gtggagggtggtggtcagggggccccctccagcctgtcacaggcttccgctgtgtctggcgtcctttattctccctggcctgacagaggctgagcaaggtgcacgtgccaaggctcgaagcccgcgctccgtgacggtcagttcactgtctttcagtaggaagggcctctggtccgtcttaagtgctcccaggccatttgcttacacagctgggccctattcttgctggctgtgatgctggctctaacaggaggcctggactttgtcacagccgcctccgggaggtgcgggcagcagggccttggagcctctagcagagtggcctggcagggtgagggcgggggcaggaggccctgctctggaaaggccagtgctttggctcctggcgggagggtgagcacaaggagaccctgtcagtgcctcagagcccagtcgaggagtcggcctcaacccctctttcccccagggctggacacagccgacttcatagggctggggcactcctcttgccactggccagggctgaagtcacttttgagcttgttgctcagagccttgtggccttagagaaggcttcacttgggagctatcaaaaggaaagaattgctggataattctcgagaggcaaatacctccaagtagagcagtgaaattcaggatgttacttagtggcttgggggaaatgactgtccttagtggtaattcacagatgaccacactgtgaggtgggagcctgagaactagctgtcgcagagtcatcacccaaatggccaagccgcctccaactggctagggacagtgggtctcagctgcctcagatccagtgtcccttttagaaaccaacaaaacacagtgtcccctttatgactctgaaaccaacacacatacagttcctggttagcgccctgacaccctgactgtcatgtctaggggtcagtagagggaaagtaatttataatgcatgctgcaattgacacatgatgtaatgacatggaaatgaca

SEQ ID NO: 91146 - DNA, 1489 bp, Homo sapiens
tccacccccactcctgtctgcacttttcccatcagcatctttttcagtctgttctgtactccatgacatcatctcagaatctccttccttatatactcttttctgaccctgaatatcaacgtaaattcgaaaggtctgcacctctgcctctttaggagtgatttttttttcccaacagcatctcagtgatttgtgtgtctccctgtccccctgctcagctctcttctgctttccaaaaagccttccgtggaaatgcatccagatctctttcctccttgtactccccgaggttaccggtggcccctccgtccttaaccccggtgccctgtggctgcagccgatcctcctcgaactccgcaacactggagcccgtcggtcttcactcttcatcctctctcctttcagtctctccttcttgtcccctaatttcagcctccctacctgcatcttatctctctgtgcgctccctcccctggagcttctgtgcagaggacttcaaacctgccttctagagtccagaaggtgtctctctcctgcacctctgccagcctgctggactctggaatgggccatttccttgccatgccccaaagtggtctgggccattctacttcctacttgcccactccctcccacttaatcccacgccactgtggaagtcatctttttgatttttgagacagggtctcgctctgtcccccaggctggagtgcagtggtaggatcatagctcactgcaacctcaaactcctgggctcaagcaattctcccaccttggcctctcaagtagctgggactacaggagcgcagcaccaatcatacccagctaattaaacaattttttttttgaagagatgaagtcttgctatgctgcctaggcaggtcttaaacccctagcctcaagcaatccttctatctcagcctcctaaagtattggaattacggtgtcagccactgcatctggctaggattcatcttctaaaacatattcccctgttccaaaaacctttcacagctcccattccccttcctccaaaagaactcagtttatggctgggcgctgtggctcatgcctataatcccagcactttaggaggctgaggtggatggattgcttgaggccaggagctcgagaccagcctggccaacatagcaaaaccctgtctgtactaaaaatacaaaagttagccaggcatagtggcaaacgcctataatcccagcaacttgggaggctgaggcacaagaatcgcttgaaaccaggcggcggaggttgcagtgagctgagatcgcgccactgcaccccagcctgggcaacagggtgagactcagtctcaaaaaaagtcagctttgatgaccttagtaagccctgaatcgactccacctaaccttgctgggtccctttcctgcacttctggctcttggcaacactttctagcctcagcatccttagctgtgttgctccggttgctagaacatcactgtgagctcct

SEQ ID NO: 91147 - DNA, 1050 bp, Homo sapiens
actacctgtgttatgctaatcacagctgcctttatttgctgaatacctgtgttgtgcaaagcaccatataagcattttgctagaatgatctagcacagcatggtgattaagagtgaggacacagggtcagatcatgtgttcaaatcttggctccagccccgatttctctgtgcctttggttgaagctcttagccattccacccatcagttgcttcctttggaaaatggagatataaaaatgtgttgggattatgtgaaaattaagcacgtgaaaaagcgcttagaacagtgcctagcatatgagaggcactcagtgatcctataattactgtcatcatttaatctctgccagatttggacgtttgggagtagagaccgcagcaattaagaattccaaacccaaagagagttgataggccggttgcatgcttgcatgactggttagctgatccaaggagagagaagtgcacagctagccaatttgcaacactgtcactaagttaacagtgctaaaacccggtgattattaattagcaagttcttgttactgacatgaaagtgctctgtaaactgttaagtgtcctaccgataataggtgttaatagctaagtgctacagtttagagtatgtagtcagggggtggggggcggggaaggcgggagtcgggggaaaatcacctaagatcatttcatgagaaagcactaagcactcccagtttgggaggcgtggatctttctaaaacttcctgtccaatttttttttttttgagatggagtattgctctgtcacccagggtggagtgcagtggcatgatctcagctcactgtaacctccgcctcccgagttcaagtgattctcctgcctcagcctcctgagtagctgggactacaggcacgtgctaccacacccggctaatttttgtattttttttttagtggagacggggtttcaccattttggcgaggctcgtgtcaaactcctgaactcgagtgatccacccgccttggcctcccaaagtgctgggattacaggcgttagccactgcgcctg

SEQ ID NO: 91148 - DNA, 1054 bp, Homo sapiens
tctgcgggagtgctgcaggtccccagctcctaggagtgcagtgttcctagcatgttgatatttccaaaacacttcccagccacctctgccattcttcattttaggaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaagggtaagccttggggcccgtgggggccggggcagccgggacaggagctcagcgtgtggtttacagcatcctgggagacacgtgggagagctcaggttcctgagatttgggctcttgttattaatcacctggaggggttggccaagcaaggtggctcacgcctgtaatcccagcactttgggaggccgaggcgggaggatcacttgaggtcaggagttcaagaccagtctggccaacacagggaaccctcatctctactaaaaatacaaaaattagctggctgtggtggtgtgttcctgtaatcccagctactcaggaagctgaggcttgagaagaacccgggaggtggaggttgcagtgagctgagatgatgcccctgcactccagcctgggtgacagaatgagactctgtctcaaaaaaaataaaagtcacctagggaccttggctcaccatttcctcttc

SEQ ID NO: 91149 - DNA, 1021 bp, Homo sapiens
ttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagacctttctcccgcacatgtgtaagtcagaagtgtgcacgggctgagtgaggagacacatgtcctggtttgagctgtgcagcctggggtcagaggccgtgtccaggggctcacatggcgtccccagcgtgctgacctggtcccatgtccttaccctcgagcagggcttctcccatccaccctgtctccctctggctcactgggatgccaggacctgcctgggtggagctgctctgcagaggctggtggcccctgtcctgctgtgagtggggacagctccactgaaattctatttccactggcctgtggtgtcatagagctgggcatgctgctgggagagctgtcactgagctgggatttggctcagaggagtctggggccctcaccgcagcaccacctgccccaccatggaatgtcacacctggatgctgactgtgtgtgtgtgtgtccatcaccccagtacca

SEQ ID NO: 91150 - DNA, 1040 bp, Homo sapiens
gtcgtactccccaggaagaagacgccggtcacggtccaggagccccaccccgccgtaagatcctgtcttaagtgctgcgctggtaactctgggaagctgcggtgctttgctgtgaatgtggaaacattggtggttaggagactgtgttaggaggccgccagcattagcccggggacagtggcacccctcacccttcaccacagtagccacttggcgaagcctgaggcagtaactggggtctgctttctaaccaccatctgggttggaggtgtcctgctctcaatgctgagcgtggggtgggggccagcgtctggagcccccttatctagctgagacaggataaacgggtagagacgcaaaatctgcatacggtgtcacctggtgacagtgagcatgcacgcaagctgcggctgtgaggtcctcatcactgtcattccaataaatgtctcagttacttcttaaaaagaataacctgtctcgattttagttcctctgctggtctgggttctaattcggcgcctcccatccctgactcaaggctcggagaagagaacaaaggccatcagatgctggtgaagatgggtaaggcgagggaatggggagggcgcgggatgggtcctcacgcgtgctgggcccgggagtcaccagcgctttctcttcctcagtgcatgtggggatggatggagtcaggccggttctgactccacccagaccctctagacagggccggcctgcgggttctctctacccatttcccatgtctacactgcctgtctggacattcagccccccacgtgcacccccatctgcctccgccttgttgtggttgtgactgcgtctctgtttccaggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaa

SEQ ID NO: 91151 - DNA, 1053 bp, Homo sapiens
attgagagcaggacacctccaacccagatggtggttagaaagcagaccccagttactgcctcaggcttcgccaagtggctactgtggtgaagggtgaggggtgccactgtccccgggctaatgctggcggcctcctaacacagtctcctaaccaccaatgtttccacattcacagcaaagcaccgcagcttcccagagttaccagcgcagcacttaagacaggatcttacggcggggtggggctcctggaccgtgaccggcgtcttcttcctggggagtacgacttggaccgggaccgcgactgggaccgggagcggcttctggaggagcgcgacctgctccgacttctgcagggaagggtgcccaagggtcagcagcagccaggcgtcgtggggaggccacaggaagaggcctcaggcactgccctgaggcagcctctgcctacctagatctggagcgggagtaggaacgggagcaggagcgcgaccttgaccttgagtacgagcctgaagacttggaggatcttgagttggagcgggaggaagaacgccctcgactcttggatctgctccgagacctcgagggtccgctgtggggagaggcctgatgatcaggtgccccagtggatgggctgcacccagcccaccctggccctcaggttcctagaccaccccagatgcaggggctctggctgtggatgtggcgccatagccacagcaacggtaccaagttcctaaatagtgtggccgagcctgctgctgtgtgaattcaggccttgtggaaaacaccgccccataggcacaggctgtgtgagggtggacgtgatgagtgtatctggggtctgctcccacccatcacaagctgtggaccctggccccccggccactgcagacatctgcgcttttacctgttcctcttctcctggcctttcctccgccgggcccgcatttttgctcggaagaactcatagaggccgttctgctcccagccttcactgtaagacacggcattccgtgtgtgaccacgtgacacccacccacaaggaagtcgtga

SEQ ID NO: 91152 - DNA, 1385 bp, Homo sapiens
tggcgtttgtctggcagtggtagcggggagcaccttgtggcgcgggcggcctgtgtgcgggtgcagcgcgccccagcggcagaaacagccccgggactgagatgcgggtgcagcggttgggtgtctggtcattttgcagcagcatgtggtgcgggctgagagcaggtgcccagcatcctcgcaggcgtcagcgtaggaggcgcctcaacgtggccagggcagcgcctccatggtctgagccagcgctgtgatgctgccgagcgctgtgatgctgccgagcactagggcctagaccacgcagggctcaagcctgtcccttcccttgcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccggtgagtgtacgggcgcctgggtagggcctggcggaggcatccacggctcgcctgccgagcaggctggtggcgctgcttgtggccctgccatgctcctgagtgcacagtgacagacacagggtcatgggacgtccgaggagcccggcctgggttctcaggaagtgggggcacagactcagttttgccgccctgatgaggcccggctggctgcagatgaggcagagccagtaggaaaaggttcctgccgtgggtgggcgtggcgagggcagggcggggcctcgttctttttactgctgctgcttgttttttgcatcagttttcccgttgtattagttcgtttaaaaaatcaatacttggcgtggtgtcgggcgcctatggtcctagctgctcagaaggctgaggttgcggtgagctgtgatcgcaccactgtactccaccctgggcgacagaccgctgtctcaaaaaaaaaaaacaaaaaactacttttcttttttaaaaaaattttattttattttaaatagagatggggtcttgctatgttggccaggctactttcaaactcctgagctcaagcagtcatcccacctcagcctctagagtagctgggtctacagatgtgag

SEQ ID NO: 91153 - DNA, 1311 bp, Homo sapiens
ccgcctcagcctcccaaagtgctgggattacaggcatgagccaccgcgccccgcctttgttttttgttgagttggtttgcagaggttgtttgttcctctgggctgcagtgttttccttggttacctggagggcaggtgttgtctcctggtatgtcctgtcagtgccctgcccactccaggagggactgtcacagattcacggcaggcatgagagacagaatctcctcctgctggggacaagcaagggagctgatggccagagcagcccagagtccgggcatcgccaccatgtccccaccccgcccctgctgagccaggccggagggctcaggctgcgggtccctcctcatgtgttctcgaccccaccgacccccgcccgcaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggtgaggggccagcacttcccagagcccagctttcccttggtccctccctgaggcagggcctgtcgtagccaatctgggctaagggctgttacaatgggtgcccttccctcccgcctggagctcctgaggctgtgggaccctgtgccccccacgctcatggtgtgtccttccctgagctgatggtgacgcgctctcagggatgcagtgggtgcctgggggagccgcggccctgctcactcgtcattggctcggttgttgcaggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactggtgagcgccgccaccccgtgcccagagcgccacttcctcgcgctcctcctcaaccctcctgggtggccgcttgctccggtcggtagcttggcttggcctgtcccgagactagggggcacttgtccggggaccccgggtggggggtctctgtgagccaccaggcttctgtctccaggactgcgaggtctaggtgtcctgtgcaccttcgctgcatgccctgtcctctcccctagaccccggcctcacctgtcacattgctgtctcctgggggccactgtcccctgcactccttcctctcatggggcagcttcttggcgtctccttgttgccttctcagccacggcctccttggcctctgtgtctgtctcctgccctcgt

SEQ ID NO: 91154 - DNA, 1787 bp, Homo sapiens
cccagttctgctccacctccggtctggccggggagaatgtgacagtcgccgcagcccgggatccacccggacgcacctcacctcgcagtctcctcactgtgcccgcgaaaggaaagagaccctggcccaggcacgaagtccccaggcccctggtcgcccggaggtagcaaccagccagcccatcgggctgcgacgccgaccaaggggcacgccccgcgccccccggtctcgactaacacccacccgcgccgttccagcctttccgcggcgccgcgcgacggggacccactctgcgaaagtgtcaggaaacttctgcgcgtgcgcgtcgctagcccctcccgcgcgccaggcatcgcgcggcttcttcccgcctgcctcccgctctcacttccggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatggtgagacccaaaccggccgagagaccgtttctctctccccggaacctcctattggccggccccgcctcccggagtccccgggtctgggagggggcggggctcggcctcgcggcttcgcctgcggcctctcccgtgggtccccgcattcccggcgagcgtgtggcccctatcgggacccgtacaagggcggcctcttcggggcccacccccttggggtccccggcaaggcggacgggggctggggcgccgagtcccccggctttgggcggtcctcgctgacgccccgcgtggccttttctccgtcctccagaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagcgtgagtcccctccggcactcaggccgtcccatcgagcgcttcctttctcggattccagtccgggctctgccacaaacctctttctttcgggtcgtttattctttgaagtggagcagctcggtccacacgatccctgttccgctgttcccacggccctgcacagagcggctgctgggtgccactgtaatggagaacaacgaggttttcgatcctcccccctgggctctggatcagggattttgctgttgttttgcagactgatgacggagattagcaggagtagcgtgattgttttagtgttttctagggaggaagtgatagaggccggatgggagtccatgggacaggcactgtccagccccctttgccgtctccctgtgggtccagcaaggttttgtgcatttcagatgcctgcagcagaaatcaaaaagaattatccctctgagttttagttattggcaagtgtttatcaatgttcgttcatttaggcaacaggattccagtcctgctctaaagaagtttaaagttaggaagcagagctggcctttgaataatggatagtcaccaggtggtgcggctgctcagggcaggtatcacatctgtcacgttcagtacccaaccccgtctctagattgtttaaatgaataactaggagtttgccaggtagatggacattgagaggtggttgtccgctgtttgatcgaacgccaattgtgtgttatgtattaaggtac

SEQ ID NO: 91155 - DNA, 1754 bp, Homo sapiens
gactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaattggtcccgatttgtcagcgagggtctctttttgagtggccctgtcttcagtgtgcccagcaacaaaatgtggaaggaggagaaagagcaagccaacttggctgtcacgtctggatttactgcaacctttgttttttcttctgagccaaaaataaggacgtgcaatttgtgaattgattagatgatacaatgaaaataggatcacagctaaattaatgacgtgactttattgaacg

SEQ ID NO: 91156 - DNA, 1022 bp, Homo sapiens
ttttcaggtaccacagttaatgcagtctctctattggaaataccacttatttccaacttttcattgtaatgtagaaacaatcacgtgtgtgatgttttcctgtctcagttatttcattatgataggcttacagttctcaggttagagggtatgaaacgttaatcactcttaatatggtttgtctggtcgtattttagaaaggttataccaattcagcctcaaaccagtggaatttcagagtgcctacttcacttcatcctcaccagcactgagtgttactgttttatttttgttttcttttctcagtcgtttatgcgtggagcatggtgcttgtttcaggcctgtgctgtgtatgtcctcacaaatgcacttgcaggtttggtgtccaagctcagatgtcagggttaatgtccagtcactgtgtttggggcctgagtcactggagccctttttgccacatatagttttaatcaccctctaaagaggctttccctttccaggtcttgcgagattcacggatccaccatctccggctgctcaacatcctgggctgccacgccgtcttctttatgatccccacctgggttctggtggacctctcggctttcctggtcagcagcgacttggtgagttgtacagcaccaagaacacgccattttcttggctagttccagaataggtgctttgttgaggagctgtagctgcatgttaacattgtggtatcttttgggcacctgacagccagcgctttcagcagtcagtcctctgtaatgcctcacggtgacgatgcacgccatcgaggaagtgggtttcctgtgtatttccttctctggtgtgcttgatcccaggtgctgatagctgctgtgtgtgcgccagtagcgtcaaggaagagaaggtgactctttcacctcctgacagtatagtccagatagcacattgactttttatttttactcattttttattttaaatgtttattttttagagacagaacctcgctctgttgccagggctggagtgca

SEQ ID NO: 91157 - DNA, 1125 bp, Homo sapiens
ggggagtctgaggcaggagaatcgcttgaacccgggaagcagaggttgcagtgagccacgattgtgccactacactccagcctgggcgacagagcgagactttgtctcaaaaaaactattttttaaaaagagggaatgggggagccttatagaggatcagggcttcaaaccctggtgcgtcagtggcagctgaacagatctgtggagttaggaccagccccgggctgtggccctgagcagaggctcttaatgggggtgacggtatggggatggggctacccacaaataagccctgcccctggcgctctgataaccacctgcccccagccacccaccagagcgtcactggcacagcaaacaccactttcaaagtgttaggtggtatccctttgctgagggaggagaggggctcttccctgggcatctgtggcatgtggcccagctctagtctggcctgtgagcccttcttgatgacctcttcctgcaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtatttggtcaccatcagcggacatgcatggggtttcaggggtgtgcgggcagcaaactggtggcattgggaaaacaggcggagtagaaatttctttgctattagagcagaaaaatcttgattgccattctgctgattttctgtttgtcattttgctttttaaatagtttgtttttctggccgggcgcagtggctcatgcctataatcccagcactttgggaggccaaggcgggcggttcacttgaggccaggagttcaacaccagcctgaccaatatggcaaaaccccatctctactaaaaacataaaaattagccaggcacgcatctgtaatcccagctactccagacactgaggcacaagaattgcttgaacccaggaagcggggcttgcagtgagctgagattttgcatcactgcactccaacctgggcaagagtgagtctccatctcaaaaacaaaaaaaagtttttctattataaagttaatgtgctcaataag

SEQ ID NO: 91158 - DNA, 1010 bp, Homo sapiens
ggggcccagctgcctcctgcgctgggaactcggggagtccggcccaggcgggagggagggggcgggagtcacgcggtctctctgcgctcttccctcaaaactctttttgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcttccatcagaccaccagacaaaaaaacctttcctttcttcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtgg

SEQ ID NO: 91159 - DNA, 1030 bp, Homo sapiens
cggacaggactgtatctcccctcatatcacccgtccacccccaccatgacacagcttgaagcagggttttcagggtcatttggagccctgaatggagaacattgcaaggcaaggccgttgttgccaaagagcaaatgggcccattggcagggcagctttgtgggagttctgcggggactgctgtcgtggctctgcaactttacacccagaggagacaacacgggaagggagggagtggcagtggctgcctcccactggaagtggggcagaagagtagaaaagccagaatccatgaggccagcagaattaacagccctcaaggacgtccacattctagtcctggagcctgggcacatggtaccgtacatgacagatgtgactaagggaacagcctggagatggggaggtgatccgagatcatctgggcaggccctgcctagtcagggagtccttagagatggcacctatcctggctgggtcagagagatgccgggtgaggactcagcctgtagctggctttgagcataaggggagggggtgtgagctggatgcagtgccctccagaagctgggaatggcttcggatgacaaccagcaagaaaatgggcctcattcctgtagtgtaaagagctgaactctgggccgggtgcagtggctcacgcttgtaatcccagcactttgggaggccgaggagggcagatcacctgaggtcaggagttcaagaccagccttcaacatggtgaaaccctgtccctactaaaaaaaaatacaaaaattagctgggcgtggtggcgggtgcctataatctcagctactcgggaggctgaggcaggagaattgcttgaacccaggagacggaggttgcagtgagccgagatcgtgccattgcactccagcctgggcgacaagagtgaaacttcatctcaaaaaaaaaaacaaaataagagctgaactctgctaacacctgaaggagcaggaaatggatcctctagagaggatcccagcccagtgagactcagacctgatttctg

SEQ ID NO: 91160 - DNA, 1339 bp, Homo sapiens
tgtgaagggcgaagggagtggcgtggaagaggggctagatctgctcttgcctcttccacttcaaccccgcatcctgcccagcatcccaggaacatccccaccctgtgccagcatgttcctgaaggaatgtaacctgctccaggtagagcaacaatggcattgacacatgcctgtctgagttagagctgggtgtggcagcgtgcagccgagttgtctgcatctctccacgcaaggaggtgtcccacgtatgcactcgatggctgaggctgtggtcagcaattgtgggcagtatggcttcagtgccagtcctaggaaattatttatgaatgtctgtgccagatcctctctcttgcctgactggccttcacgtttggagacacactgccatacctgtgcagagtcaagggaaacataaggagggcaggataacagctctgacgcagcatggggttgctttctgggacccttggcagggcacagcagatttaactgctttctccctcccttttgtgatggggtcattgcactgtggaagccaagagccaaaaacagttgaagcatggctgggcacagtggcttgcctgtaatcttagcacttggggaggctgaggcaggaggatcacttgagctcaagtgaggtcgaagctgcagtgagccacgatggtgccactgcactccaatctgggcaacagggcgagaccctgtctcaagaaaaacaaaaagaaaaaagttgaggcagtaccagttgccatgacagtatttgaactctcttggagtaaagtttaacacctgggaattgattcctaaggaaaaaatgagagaaggaagcatgtttgaagatgttcattccagtactggttgcagcaggagaacctagaaagaagtgaactgcccagcaatcggagaaggttaagggaattatgatacattaatagaacatttagctgttagacatgatcttgaagattatgtagcaacaagaagtgttaaatgaaaaaagaatgcagtatctgtgatgcagtgatataattgttactggcactggactaggacgggaaagtcacccaggaaagcattgctgttgggggagtgaagggtgtgagttggctccacactttgttctgtgcagagcttggcctctgaggtcagacctgagcactggtctccattcttgggtctgctgggcactctcagcctgaagccaccacaggatgtcatcccttcctgagtttccaggtgtccatttgtgcaatgacaatgttcatctcacctcctgaggctgctggggttcaagacagcgcacatctgacaacagcagtggctcagtagatgctctcag

SEQ ID NO: 91161 - DNA, 1035 bp, Homo sapiens
gagccgagttcatgccattgcattccagcctgggaaacgagtgaaactctgtctcaaaaaaaaaaaaaaagtcagtgtttgtaaccaggctgcctgggccccagacccagctgtgtgacctcaggtagattagctgacctctctgtgccttagctgcttgtaaaagggctggagtgcagtagcacagtctcagctcactgctgcctcaacctcctgggttcaattttcgtgcctcagcctccccagtagctgtgtctacaggcgtgcgccaccacacctggctaatttttgtgttttttgtagaggcagggttttgccatgtgggccaggctggccttgaactcctggccccaagtgatccacccgcctggcctcccaaagtgttgggattacaggtgtcagccactgctcccggccaagaatttcttaataaataaaatagtgcctgatcggcctcactgaggctgtgaagaaccagctcttcctagtccatcttcagcagagctcctacagcaagcaggagggcctgtgggattctctttgggaggagcaggttggggaggagaatcccagaggcctcatcttacacttggggtcagtgggggtggtgcagttcaaggcagtcttggaggccactggcaggaggctgagaacccagggagctgataggggcttagaaagtgaggttgaggcttcctcacagggcctctggggtctgtggggagaggcagggttgtcaaattctggcagtattagcagatgtgcagttggatagggggattgctgggcatacctgaaaaggagagggcaggcccccctgcaccccaacgatcagtgaagctccaggtaaaagtggattttgaggccagatccagcttcagggccaggggtcccagtcattgatcagtgttaatgcatcactagagggggtggtatctgctctcctttcctcagcctggcacaattccagggctgtgccaagaggaggtggaagtagagcccatgcaaggctgtgcggagcaggagggggctgct

SEQ ID NO: 91162 - DNA, 1033 bp, Homo sapiens
caggagttcgataggaagacaactttgaaaaagcactttgtgactggcagggtgccatgcagcctcagctgttcatttccaagggtcatccatttacaggatgaatgctcaagcctcttcctcccggtgccatggagtctgcctgtcagtcccctccttgcccagcatctcccgcctgcctccttgttcccctatgccttcaccaagccatgtctcccaccctgttcacccgagcctctcctctcctttcctctagtgccgcctggctgggacagtgcagaaacactgctcctggcagggcgccctgtgcctgtcccctttcctgctgctctctctgactgtgtgtgtgcagtgagtggggcagcctggccaatcctacctgcctcaggtggatggtggccccaggtgctgctgccactgtctctgtgttctatccatttcccctttccatgggcgttgttcattcacctggtcactcatggccttcagttctcatctcagtctgaggaccccctttggcctcatcagtgtgtcctgcccacactggtgtctcaaactccaggcattaaaaaccatacttagggactttcctctcagctgtctttctgattctacctccaacaatttaaaaactgcctttagtgaggtctaatttacatacagtacaatgtgcctatttcaggtgtacatttggcagtggaagtccctcattaaacagttatgtctgtcttgctttcacatttgtctttttatttagctctacgctacattttgatgcatttttgacaaattcgtatacctgtgtaactactccagttgaggtgtagaatatttccgtaacttaaaaagttctccctccccccactgaggggctaccaccaatccccagttcaccccgccaccggcaccacattggcactgctggtgggtgctgtcgagtactgcaggtaggtactgattttcttacctgtggtgggaaaatggggtaacagcacccatatgaacagatgaggctcacagaggcttgggacgg

SEQ ID NO: 91163 - DNA, 1014 bp, Homo sapiens
gcatagttaatactgaacttgtgttgaataacattatgattattattatttttagaggcaaggttttgcttattattattattttttagagacagagtcttgctctaaaaactttacttgtccaggctggagtgcaatagcgcaatcatagctcactacagccttgagctactgggctcaagggatcctcctgcctcagcctcccaagtagctggaactacaagtgctagccaccacacctcactaatttttgtattttttatagagacggtctcgctgtgttgcccaggctggtcttgaactcctggccgccttggcatcccaaagggttggggttacatgtgtgagcgaccacacccggcttgaataacattactgaaataacattgcctttttttttttttttttttttttttaaagagtgcttgtgtccaagaacataacttttatatgttagggtgtgggttttgtttttgtttctgttttgcttgactttgataattgttgtggagaaattttgtttgcacaagaaggtgataaaacttggaagcattttttttagtaaacattgaaaaatttatgagttggcatttctaaaaaatccagattctttaatcttttcatttatatgtaatgttgaaatacaataatgcaaatggactttagtttcattcagactctatttcaagcacttcaaaataatgaagctctaatttacataaggcatatactaaggtatagacagtggtgtgctggtgaaaatttgacaaccagctctcaggaaaaagaaaagaaatccatacatatacatatgtaaatatgcatgtaagtttatgagttttactagtataaaggatgggtggcatataatttgcaaataataatgaaatatacaacactgttgtcagttccatatagccaattgcttctcaccagctgcttccgttgatttttgctgagcttttgtatcagcttctgattggttttgacatgactttggttaatatcttattc

SEQ ID NO: 91164 - DNA, 1073 bp, Homo sapiens
tctcagggtccagagcctccataagcatccctgtcttctgactattgcaggcatcctggtctgatctttcccgcagtgcttcctgtaaccggtctgacttgcctgtcatttcccccacccccattccccttgaagcaaagactggttggttgttttcttgctggtatttagagagccattcattctgttagggccagtgaccagtttacaaatggatgtgggtccatttctgacttcagattacagaagtagcattgcctaacctgggaggacccagttgggcttgggggtaagaattcaggcttagtggggcttagtcatttagctgattagtattggggttgaggtggctgcggctggatttggccagacccctggaggaagcccccttcctgtgatggttacttggctctctccaaccttcagccctttggattcctcccatggttcgaggggtctgttggagccatactggcatggtctgcacccaggcgctgagcctgtcctgtgtgtatcgctcagttccgttaggtttggggattccagaagccgtcgacaggacccagtggcctggtgaacccctcaggcccacatgagcctgcacgtgcctcctccctccaggcctgggcagacactccccacccaccccccacctttttattttattttattttattttgaaatggggtcttactctgtcacccaggctggagtgcagtggcacaatcggctcactgcaacctctacgtccccggctcaagtgatcctcctacctcagccttctgagtagctaagactacagacacacgctaccacacccagctaattttttgtaatttttgtagagttggggtttcaccatgttgcccaggctggtctcaaattcctgagctcaagcgatctgcctgcttcggcctcccagagtgctggaattacaggtgtgagaccgtgcgccgggccagacactacccttagcacagcttctggaccttagctggaaggcttcaggtccttctcagctgcttctactttggtgaccttggagcagatcacttaatgtctccgagcctcag

SEQ ID NO: 91165 - DNA, 1046 bp, Homo sapiens
cttagggaagtggtggattattgtcagagctgacttaacacagtctgggggcactgtgagatggctatgtggacatacccaggcccttggattctgtgtataggcctttggattctgtgaccatccaagtaccgggaggttctgcgattctctgtggagcctattcaaaaggagaggggtcatgtcaggtgaagtaccagcagccctctgggaactcacatcccaaggattgccaggcaattggggttaaaggcctttggatgttactgtgactgcagcaaagtttcctgggttcatccactgcaggaaaatgaatcttggaaaacgtcagggggctcatcaggtttcccctgcatgcagagttaggctcggtctcctgtgtgccagcagcagtctctgttgggcagcagaggctgcaagacgaacagccgctgtttactgagcacttacacagtgccagacactactgtgtggagtgtctcattgcttctttgaattacttctagggtaggtgcttcatcttcattttaggggctaggagagattcaccgatttgtctggtattgcagacaagggaaccagaagccttgggtctgaatccatcactgggtggttctgatgtcagagggcttaactacgacagtcttccgcttcccacatcggtggtgcccagcatggaagctgaactccattgcgtcttccaaggtgtacccttgcaaacatgaagtgttttcacatgttacattttgaattccattccttcccagttcctacaacttttccccctttaaattcctctagcctagtggctccaaacctttttgagtatgagggttcatttttatcatcagaaaccttctggaagcttcacataacaacaggtgtgctttgagtaactgttttaaagaaaattcgaggacagaacctactcctaatccagtcatgcttcgaaatgaagttctgtcttgtcatcaaaacagcatcagtgtaactctgagagcaggccttacctgtatgtgtgtgacacctggaatttgacctttgtg

SEQ ID NO: 91166 - DNA, 1012 bp, Homo sapiens
caactagcaaccgatgtggaacttttcatgaatctgtgtgaccagtttgctctctacttcaacattacagcacttttgatattaacttaaaatgccatttattctgcagaaaagcagaatggtgtaaattgcaaaatgaaggactcttgattctgaccctatccaaaatagtagaggaccctaaacccaaacatgtaaatgccacctgatccacaattgcccagattcagggactctcctgtctttactctgtatattgtggccaggacacaggagaggagcagcgtggtgttctctgacttcgggaaatggaaaggtagcaagtatcacctgtgacacaggtgtatgtccttgtctttgactcattctgtccctcaggagaaagtggactttacagtctctcctcactgaggtttctgggtggtcctcagaatatgttgtcctggttggaggtcccagagccctggaggactgtccaagaccagcatgtggtcaggggctttgttctggatacagatgtaaaaaggcaccatggtcacgtcagcccctgggcagctgtgtaagataggacatgtagcttaagggcgccaaggtctcttaggtgaaggaggacacttggctttccttttcttggttttggggtctgcgagcatcttctcagatggagctctagtttaaccaggctgactccaggtgactccagtccagcgggaggggtcccctggccacttccccactatcatctccttctggaaactgggtgctttgttactgcacgttgtgcttttcctttgtattcctagtggtaggctgtcccacgtctgcctggttcctttggggaccaggagctggttgtcagaatgggtggccaagtttgtggcacagtgagtaaaggagaggcagcacatttcattccagtgtggtctcgctagcacccatgcttggagcaccttccaaaacagccgcttttcactcttagagcagggtgtggatttgccatcgggattccctg

SEQ ID NO: 91167 - DNA, 2099 bp, Homo sapiens
gtctgagaggttgctgagatattagcactgatccttaatgccacctcagagagctttgggatcaggcggcactttgacaggcgatcacagtgttgtagattaggtcactccagtgacctcacagtttccagtattgtatagggttctaatctaaagggttccttgaggcagaagaaaggaggatggaacaaatcttagttttgtgtgtcttagcacatgcagaaatgctatataggtccctggttatgttagctggcatggaatttgcatttcataccgcttattttcagggactttagtgatgatcttgggcagagtcctactaacatggggtggatggatttgggaagttatcttcttgactatgaacaatgaggaaagtgcctcctttgtgattgaccctctgagcgctgttatgggccatttgacaggaccgtttgctttgagcaaacaccatgcagaaacacagagccgcggtggacaggattgctggcggaggtgatggtgagagccgggcatgtcagtgcgtctgcagtttctcttggatcaatgtgggctcaggtgagagcaggtggctccagcacaggtgctgccggcgtgccgctctctcctctctgccctgcccaatgatgaactccactactggatatttagttgacacatatttaagatgctcatgaaaaaaaaaaaaacggggacagtgttgaagagccaacactaaaattaaacctcttctgagagaagcggcagagaattgtgtcatgtaatgcttacctttatgggcatgcaattatggttaacaaacttagctattgcttgcaaaatcggtgtcaggaactgacctaatatccacaagtatctggaaagttagggaagtgacgaagtcgtgtttaccaaccatctccttgacaaaggaattcttaggaggaaagtagtttctgtgctctcacttttagcccctggagtatgcatttgaattcctatagcagcaggctcagagttaataatttctgccaattcagtaataaagtaaatcctctactctccttttgaaaaggctactaacagtttttcagagcagttggagcttttcttttcgtcgtgcaccctttcagcccagggtgttgaaaatctctccgaagcgcagtgtgtgcatgattgttccagcttactctcactgcattgtgggtaaagtgaaggactgtgtcttactctcgcacagcagtcatagtgagcagtctcctcagcaggtgattcggttcccatctgcctgggacactcgttctgtggaggtatgagctttatcttcctgtgcagcacgcaagcttcttggggatgtttcctgtcttgtcttctccctctagagcagaagcattaggcacactttctacctgctgcttaaactgactgaaccctagcatccatcttggacctgtgcctgaggagctacatttgagccccattttaccaagaagcctttgtgaccactttatgcccaagagttcagtcgtggaatattctaatgcagaactttggagagtggaagaatcacaggtggcttgagatgctactcagtagaactgtgaggaacacagatgttaagtgatgattaacaaacttagcttttagaggaaaggtccgacgaatagtagacggtgtactgcatcctcatggcaagtaaaataaccgcacagggcagggcttgctagctgcaggtgaatgccctgtgttcagaccagggagaggcctgagaaggtcccgcagcaaagagggacttgaactagccctggccgcgtgtgtcagtgcctccagctgccaggctctgagcgggaaacgtccttgggagctgctttctttttcacagctcttcaggcaacagagaccaagggagaggtgaccgaggcactctgcagagagacacagcaagaaagatcattttcccacctaagaattggaaggttggatgttgcttaccttggtttgcctgcagatttcttgtccacagggtgggattgggaactggtgtatgcaccccataaagctccttccagatctaagttcagatcctagaagggacagcagagactaatgtcaattgt

SEQ ID NO: 91168 - DNA, 1048 bp, Homo sapiens
gggacccgtctggcgcccacctcccctcgagggccgctgccatccctgcctctcgcttctcgggcccgggccgggggcaggtcgggcagcccggcagcgctcggtacgtgaggccgaggcttccgtgcggcctgggcggaggaagcagacgggggagctgaggctagagtttttcctccctttctgctccagctctacgaccctcactgctctggacgaagcttctctgcctcgccctccctccgggacccgagacccccgggaagccctcccggagcgggaaggggagggagaagggctgtgaagcaactggtgtccggggtatgactcggggaacctatgtctcccatgtcttggcctcctgggtgatcagggaagtccttcttccccctcctctcggctggcagcaccttcctggcttcggagagaacccccagtctgttttgcccctggccgggtacctagggtacgtggagagtctgtctcccttctgtgactagacacgcctttgccaaaaccctcttggggtcgctgccgacgatagatgatctcggggagggtgggatccttcctgttgcctttctgggcctcagtacccattgcgtctctgaccaagccagagctccattttttaggtagtgaattaaagaggacttttctctcccgtttacccaagagctctgtttcagtaggctctttccctcacctgggggtctcagcctggtggtttttgacccagactgtcggggttaactccagagtgtcgcttcctcgggtgcccctttgctgaggctactgtttgcggagggaccgccccctccccttccgtgtgtgtgtgtgtgttgttgcgggggtgggggggtgggggggaagactgatctattctcatattttctccaagagtttcttggcagtaggggtcattcttcccgcggcaggagcagggcggtaggaagatgcagtagcatccaggtatgaggggaggccctgcttcccaggaagtggccattgagatcactttttaatgtgctgtgaatggaagaaaaat

SEQ ID NO: 91169 - DNA, 1067 bp, Homo sapiens
cgtctacgcggcggcttctccacctcggcaccactggcatttgggcgggatcgctctgtcttcggggcgggtcccccgatctgtcggaagttgagcggcatctctggcctccgaagcgccccctcccccaatctgcagtcattgccgccgtcccttgtgggggcacagtccccccgcccccccaccggcagagaaccccgtgattgaaagacccttctacccgcctctgccttgagattctgtaaaactgagatgctcattctcttaaccaaacacgtcacagaggaggaaacggaggcccaaggtcacctagacttcggggttaagcccagaaccgcagatgtcaagtttaagggcgcccctcctccctccaccctgtttattgccttggtaattgctcccctctctctgggagctctgttggaaatgctcttgtgagacgggatggaaaggcaagctcggcggcctcgggagaaatcttttttttcccactgttacaggaagacctagatttaaaacaggaggaagacagctgatgagaaccacatgtgtgccttggagctgcccgacacctgttagtcttgtatttgttgtgcttctgggaaatattttcatttgcaaaaacggctgcttctgcacgtggctatggttgcgtgcttctgcacatgtgaaaagttttacatcacacttggaggagaaaagaaacacgggcaaaacacttgtcatttactgctcccaacctcgcccctcccagaatgcggtgcattgtgtacatggtgtacatggtccaagttggaaactggcccattcggagataattctctcatttctgataagcaaaataagcaaagccttcctcaggcatattctggtcttgcctctctcttaatttctaactcggatgtacagtatctttttttttttttaataaagtattacataggaggcaatttattttgcatgggtcaggttattttaagaaacatttgggccggacgtggtggctcaagcctgtaatcccagcacttcagcaggcggaggtgggcgatcacttgagctcaggagtt

SEQ ID NO: 91170 - DNA, 1064 bp, Homo sapiens
ggtgttggctgtgcggagtggctcacgcctgtaatcccagcactttgggaggctgaggcgggtggatcacttgaggtcaggagttcgaaaccagcccagccaacatggtgaaaccccatttctactaaaaatacaaaaattaatctggcttggtggcaggcgcctgtaattgcagctactcagcaggttgaggcaggagaatcgcttgaatctcggatgcagaggttgcagcgagctgagatcgcaccactgtactccagcctgggcggcagagccagactctgtctaaaaaaaaaaaaagagtatattcttcttttaactgtgtagttcagtattgttaattatattcacaggtggatcacaggttactttaaaaaatcagacaatcatgtaaaatcatctaagtaataggtaatagtcatgtaaaataatcgctgacaatatttttagaacagtcacctcctatcctcacagacatttctgccctctgacttctccaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattg

SEQ ID NO: 91171 - DNA, 1058 bp, Homo sapiens
ctggggaacatagcaaaaccccatctttatattttaaaaaaaagtaaaaactattagctcataggccatccaaaaacaggtggaagaggctgctggatttggcctgtgggcactgagcttactgagcttacatcttcccagctcagtaagcctggcagaaggtatctctttcccagtagttgggggaaaagtcccagggtggactctcattggacagacttgggtcacatgccccttcttgagccaatcagaggcagaggggcttggtgctttcaggggattggtcagtggtagacacagcctgatgagggtagggaagagggagaaaccaaaaggaaaagccacactgttgccgaagttggaggcagcaagcgccgggtgggtggaagtcacaaaaatccactgctgaggtggcagtagggatgggatgttagctgtgccataaaagtgctttctgattcttccaggtgacaacatccgggaattcttgctgagcctcagatactttcgaatcttcatcgccctgtggaacatcttcatgatgttctgcatgattgtgtgagtccagcctgccctttcctttcactgtcgtctcttagtctccttctccagggtgacccacctgatggtcattctctgtcttttcagtcatcactcttgtatcctggtttctgttttctttattttttgttttgtttgagatggaatcttgctctgtcgcctaaactggagtgcagtggtgcgatctgggctcactgcaacctcggcctcttaggtctaagcgattctcctgcctcagcctcccgagtaactgggactacaggtgcgtgccaccacacacggctgattttttgtatttttagtagagacggggttccatcgtgttatccaggatggtcttgatctcctgaccttgtgattcgtccaccttgggctcccaaagtgctgggattacaggagtgagccactgtgcacggccctgttttttttgtttgtttgtttttgtttttgagatcgagtcttgctctgttgcccaggctggagtgcagtggcgtgat

SEQ ID NO: 91172 - DNA, 1147 bp, Homo sapiens
gtgggaacccccgttccccatggggcccaggaggatctcattttagagcccagttggttggggcacccgtttctagggaccccactgcgtcaggaccccgcaccctgtgcagctcaggagtcaaaggattccttttgtccagaagcccaatttgggaccccagaaagtgagtaggaattgctgcccagctaaccctacggcatcgagacctcacgcatgcgcggcacgcttcgaacgcgtgacccaatcccgcccccaggagaccccgctcctcccattctggctctcggggcctccccagcgaggtggggcgctcgcgctcccctaagggggtctggcctgcagagggcgggaccctcccagccttgaccttcgattggcccagccctcgccactgttgctttaggattggtcggcttgtgctcctctcccctccctccctggggcttccgcttccggttctgacggacgcttcggccgtaacgatgatcggagacatcctgctgttcgggtaattagggggaccagaggctgggaagagagagccaggcaggacgcgggggcgcccctagtaactgtaattctccctctgcaggacgttgctgatgaatgccggggcggtgctgaactttaagctgtgagtaggtcgcggccggactgcggctccatccggggaacccgtagccccgccctcataagcgtgatctcggcgcacttctcaggccccgcccccaagccgcaggccccgccctatccgccctctgggcacgcctccagcctggtttatcttcctcgccccccaccccccgagagaccttaaacccatactctccgttccttggttgtccctctgttcaccttcctggagagcttaagccccatcccccaagaaatagccccaccgcggaccttccgccctgcacccgcactgtcgggccactttgtaaacggtcggtggctgctgacctggctgtgattgtccgggcagtgggggcccagagaagggtattgaacgtcagaggtcacacagcaagtttgcggcagggccagggctgaaacttagtgtttgtggccttctgagctgggggtcagggggctgaggactctatgtcccattgaaagtggacactgtctgctcctctttgta

SEQ ID NO: 91173 - DNA, 1067 bp, Homo sapiens
gggtgccgctcttccccgtcttcgacctcagttacttcatcgtctccatcctctacctcaagtatgagccaggtgagccggggcggggggctggaggggaccggcagcgggtggcgcgggccggggcagctcgggggtcgcagagaggggaagcccgtgcgtggtggagggagcgagggacaggttcaaggattgcatcgtgggagtaggcaggcgctagaatcgtggggttctctcacgccggggtgagcccgggggagaagcccccaggacgatgaagctgggggaggggaaggagaggcgtgcgcgggtttagaggagggggaacaggtgcttggggtcggggctcctggttgggtcagagctgcaggaacttgggcaaggggcgccggctgtggcgagggtgcaggtgggggtcggtgcatctgttctggccgcgcgcaggtgtgacctccctccttgaccttggcacgcggattgagagcgccagcggagtgtctataagggccactgcgctgggggctgcggtcaggttcagcgaaagtgacaccggttctcctccccactgcaactgcccagcaccctccactcccctcccttcccccacggtgctgaatctccgagcccccacgggaattcttccagccctggctccagatcctttccacttacggagcagaaccggccccaaggctgggtgacttggggtcagtgtcctccatctcagctccagactccacgctggggaggtcacaggagggtacagcctgcttcttaatttttaaaatgaggatgaatggcttccttagaacgtgttctatttttataaaaggttcaccgtgaacaaatgtttaaatgtttcttgttcaccgttattctagaacaccagcaacttactagataatagattttaggcttagaaaaataaaggaaccccaaacttcataagcctttctcccacttagatgtaaattaccactatagctcagaaaggaaatagctttattctcagaggataaaaataagcgcccctgtttactaaaaactcaaactgaaaagggcaaagg

SEQ ID NO: 91174 - DNA, 1034 bp, Homo sapiens
cacagtgttgggtgggcgctctggattaggataggctgaccagagcatatgggagtgaagcctgcccttggcatgctggtgatgatgggggacactcctgtgcctcccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtaagccatgctgggcatgggagagcagagccgggtgggggaaacaacaacctgggcaccagggaggagagaggttggaggaattagaatgcaccagcaacagccctcatgatggccctgaatatgctgccctccatgcccatctctggtctaggcacagcacgttggggagggtggtctgatataaccacagctccctacccccatccttcacagtctgcccatcccctggcactcactgttctctccccaaaaggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggtaaataggatgatgacaatgaaaaatcatcccagtggagaacttttggttcagtggtactaccaggcaccccagctaggaaagccattgctccaggcacaggggcataaagactgcagtaggtgttcaaacctccctacaggtatcagccgatacctttagggtaaatgggaagattcttctagaaatgttactgtcaggggtacctaagacagtgatgatgatgacaaaagccagcattgccagagcaggttttctcacttgcagcactactgacatgtggggctggatcattctttgtggtgggggctgccttgtgcactata

SEQ ID NO: 91175 - DNA, 1132 bp, Homo sapiens
tgatctgggctcactgcagcctccgcctcccgggtgcaagtgattcttgtgcctctgcctcctgagtagctgggactgcaggcacgcaccaccactccaagttcgtttttgtatttttagtacagacagggtttcaccatgttgaccagtctggtctcgaactcttgacctcaggtgatctgcctgcctcggcctcctaaagtgctgggattacaggcatgagccactgcgcctggtgggtcacattttaggttcctttgttgtctgttgagaaggtttttatgtggcagtatcaagggagtggggaatagattatatttttcatttatttcccaagacccttttgcccacttccgttgtttcttctagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggtatgccactacagtggttcgggtgatctcagccttcaccgagtatgtcttgctactcaggttgggccacgtgtctctcctgtatcattgctagaaagccacttaagatctgttctttttctagacgtgctcattgcttctagcacaaatcaaaatagatatggaaacacctacacaagcagcctctgcctcccaaattgatctgtttggaagatttaaatcaagagtggatgtcagggaggtatcctcctaacgcagaattttgtgtgaagtctaaataaccacctcagcagttgctgaggtcttggcttgaggctttcccagcgagcataccaggcaggcttgcccttgtatttaagcatgtcctcgtctgcctctgatcactctcagtaccacctacaaaataaagtggtcgagatggtgtgtgagtagccacgtttatgttggctgtgtttcatttaattgttgataggatcattagctcagctgggactcctggctttgctttggtcccttttttcttgggtgataggtgctggccctctttttttttttttttttttttttggagacggagtctggctctgtcacccaggctggagtgcagtg

SEQ ID NO: 91176 - DNA, 1132 bp, Homo sapiens
tcccttgaagtccccaacaacctggacagtgggtcgcctctaacctccagggtccccatcttatatatcctaccttggcatcactgctggcagcagttgcctttccacgtgaaagcaatcttgctgaaacagattgcaggaggcgtgggagacttctctattatatgcagcccagcacttggcaccacagaggcttaaacatccactttgtacatttctcctgaatgtgaagttttccaaatgcaaggtgctcgttgaacttgttgtgttccttgagtagattggtaaggatcgggtggaggtgagctgggaagactcacctgtgcaccccgccctgcttgcctccaggctctcagaagtaacctttccctgtctctaatacagcttggctccgtgctgagttttttctgttcctgtgcagacagtggctgggcctggtgtttttcacaatctgtttccagtgtcgggcctggcagtaactcattgtcgccttgtcaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccaggtaagaactcagattacaattccttgtgggttttggatttcatccagtttggggccctgcagatattcagattttcttgtcggaattcataaaatcctgtaaaattctaattagttgtggggttttttgtttgttttttcttagagtctggctctgttacccaggctggagtgcagtggcacggactcggctcattgcaacctccacctcctgggctcaagccatcctccaacttcagcctcccaagtagcggaggctacttggggctagaacatgggcgcacatcaccacacctagctaatttttgtaatttttgtagagacagggttttgccatgttgctcaggctggtcttgaactcctgaactcaaacgacccatccacctcagcctcccaaagtgctgggattacaggtgtgagccaccgtgcccagc

SEQ ID NO: 91177 - DNA, 1436 bp, Homo sapiens
tcattcatagaaaagacttcaaaacctggccccaaggcccccaccagtgccctggcaaacatcagccacttccccttgctgcctgtttctctgtccactgcaccttgtgtttctgtggtgccggcatgcacacggcgagatgccccaccagtggccgccacatgagcccccgcacgggaagacccaactcagctgtctccctcctgaaacccccagcccttctccctcccttatccataaaggcctcacaggagctttctcccagcctggcagtgttagtctgtgatgattcggttaccttggaatgtgagcatcttgctggagtcacctcacgcatggacggagcatctggcctggtgcccgtggccaccattgcccaccgggctgtgggctgagctggaagcagctctgcatgctcaggtgcatgggtccagccacgtctccggtgctgaccacctcccacatgtgtccttagttcacaggaaacgggccgtgcgagatgcacagcgtgcagaagaacgagcacgacaagaccccggagcacagcaggaagcgctcccggccctcgctcctccgccccgtgtctgcacccgccaaggtacctgtgagccacatgcagccatgcctgcacgcggggcccccagcaaatcgggccttcccagcatgtgaccagggaacagaggccccagcaggggttcggggctggaccgggggctgtgtgaggttcaccggcagtgggaccgttggaagtcagctctcctctaaggtggctgttcttccgttctccctgtcctgtgagattgttttgaaaaggaggaggaggaaggagtgttaaccctgccctaggtcccaagaaacagggtgtaccacccagtctccttttcaccctcaggactctctcacaggcaaggccgccatgtacgtttgttcaggttggtcactgcacagctgagggcagagaggggctgggatccagctcctgtcacgcctttcacctgcaatggtggttttccgattccattattccttgtgcagttactacttggctttctactattggtgggaactttgtcgtcctcccatttatttagttatgtatattagatatggactctgggttataatccattctagtgttgatgtccatactgttccagattgggccagcggggtccctttggctcttgtgtcctttttttctttcctttgagacagagtctcgctctgtcacccaggctggagtgcagtggcgcgatctcggctcactgcaagctccgcctcccgggttcacgccattgtcctgcctcagccttcctgtgtccttttggcatgtcctcatcattctttctcctgtggggggatggggtttcactctgccacctaggctggagtgcagtggcacagtcagccttgacctctgggctctagctgtcctc

SEQ ID NO: 91178 - DNA, 1040 bp, Homo sapiens
ctggttttggtctggtttgggtctggtctggtctggtctgtttggtctggtctggtctggtctgtttggtctggtctggtctggtctggtctggtcggttcggtctggtctggtctggtttggtctggtctggtcggtttggtctggtctggtctgtttggtctggtctgtttggtctggtctggtctggtctggtctggtctgtttggtctggtctggtctgtttggtttggtctggtctggtctggtctgtttggtctggtctggtctggtctggtctggtctgtttggtctggtctgcccacagcctgtcaggattctggtctcttcatccctgtgtcatgcactctccatcctgatgtgtttctggcctttgtcgacttcctctgtgggtgaggtggggactcccgcaggaggcggggtggccgcaccacctgctttcctcccgccagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgagaggaggcctggggctgggaacacgccgggaggcccggccgctcactccgctctggactcagtcctgggtggaccctggttcagcggctgggacaccggccctgctgcagagcccatgaggtacctttgacctgcaggaagcatcagggctttgggagggtggcaaaggcgggaggcgggtggccttgcgagcctgcgctgtgccggctgggctgtgccggcagtggaggctgtcagcgttcctgctccgcaggtgatgttcctgcagcgcaaagggcaggtgatcatgaccatcgagctcctggacaccgaggaggcccagacggaggaccctgtggaggtccaggtgaggccctggccccagtctgtgccacgcataccagggagcgcctgagggcagcagcatgggg

SEQ ID NO: 91179 - DNA, 1035 bp, Homo sapiens
ggatccttagtaacctttaactggggaaacccaaatctccagggccgtttctcacccgcatcaccattgacagttggggctgtgcactgtagaatgtggaatagtgtccctggctgtcacccatgagatgccagtagtattccatcccctccaaggggtaacaactgaaaatgactccagccatggccacgtgtcccctgggggcagaatcacctcccccgccaggtgaaatgtgatgctcattagtaaaacctggttcccctctagggcccatcattgccttggtgggtccttggtgtttgtggagcccctgaggaactgccactaagagtgggaacaggggcagagaccaggaactgaatcctgccatccagtcagttcttaatcaggagggagcgggtcttgataaaaaggaggaaccgttaggaacggactgtgggagggtaggcaacgtgcccgagggtggacagcgggtgcccttgtcttttctttgtcttgtgactgacctggatttctggaggaactgtcctcgtcttagaatgatctgttgcttttcttctgagattagaggtattagattctctcccaagagctactttggaggttgccccggataaacgtcgcttttgtaagctgcattatctcttccatgggccctttcgcccgcccgttcccaagcacatactgctgaatttttgttcttggtccatcttgctgtccccttccctgcttggccccctccttgaccgtgactttgctgctttaccttgattggaggagacgctctggggccacgggactgacggtcccttctgggtgctgcccccacaccccacccaccagccctttgtgtgcccggcatccccagcccagctgtgccaggctgcccctgctcggccggccattcagacggccccaggcggcctctcggcaaagcaagacaagcccttctcttctgccctcgtggtccctggagtggcagaacaaagggctctgtctccacaccagcccaccgccgcagcccagagccccgtt

SEQ ID NO: 91180 - DNA, 1026 bp, Homo sapiens
agattaggcatgtttcagaaatgcagctgacgagtttgggttctactcatttcctcagcgagactttctgagcccgagcccgatgataaataaagtagtgattcaagggttcagcccatgggttcgtcggagtgatgaataagatatccttgtctgactcacttgtttaaaacccatctctgccctgctgcacagggctgtatgtgcaagagaaggagccccgctaggggtgtttcatgactgttgttgctgggtgcctgagtttgctagggctgctgtaacagaaccgcacgctgggtggccagaacgacagaagtatattggcttgcagttctagaggccagacgtttaagatcacattcaagatcaaggtgttggcagggttcgtgccttcggagggctgtgagaatctgttccacgcctctctctgttggctcatacatagccgtcttcccctgggtcttcacatcgtcctccctctgtgcctgtctctgtgtccaaatttcctcttatgaggacagcagtcatatggaagggggcccaccctaatgacatcattttaactgaatcatccccataaagaccctgtctctaggcgaggcttggtggcacacgcctgtaatctcagccctttgggaggctgaggcaggaggatcacttgaggccaggagtttaagaccagcctggacaacatagcaagatcccatctctacaaaaaaatactaaaattagctagacatgatggtgaatgcctgtggtcccagcactttaagaagctgagacagacagatcgcttgagcctgggagtttgaggctacagtgagctatgatcatggcactgcattccagcctgggtgacagaacgacacccccatctcttaaaaaaaaaaaaaatcccaaatatactcatactctgaagttctgaggtttaggatttcaatatgtgaatatttctttgtggaggggagtggtggacacagctcagcccataatactgagaaaaggacaaattcaaattacattttt

SEQ ID NO: 91181 - DNA, 1074 bp, Homo sapiens
aggctgaggctgtagaatcacttgagcccaggagttggaggttacagtgagctatgattgtgtcactgcactccaacctaggcgacagagccagatcaaatccaggaaaaagataactgtctgcaaagtcacattccacagaggccatcctcaacagaggccttagacatttttcaaatttcatgcgttccgaccagaatttgctggttttatggattcagcccggttccctgggaagtatctgctgtcttaggaacgtagaaactacccaaatatgagtgccttttctttcccaggatttttgccgtcctctcggccatcctgtacctgggcaacgtcacttataagaagagagctacaggccgagaggaagggttggaggtcgggccacccgaggtgctggacaccctgtcgcagcttctgaaggtactgattgccacctctgtcccttctcaggcctggctcagggccgctggctatctctcagtacgagggaccatacccagaacttcctacgtcagctgaggtttcatcaaccaggacctcacgtcttccgctatcatctctacagtgttccttcctcatttctgatgagctctgtggacaggggcacctcctcctcccaccctcaagtgaaagcctctttaaaactacagctcaggggccgggtgcggtgtctcacctgtaatcccagtactttgggaggccaaggtgggcggatgacctgaggtcaggagttcgagatcagattggctaacatggcaaaacctcatctctactaaaaatacaaaaagaaattagccagtggtggtggtacatgcctatagtccaagcaacttgggaggcagaggcacgagaatcacttgaacctgggaggcagaggctgcagtgagccaagattgcgccactgcactccagtctgggcgacagagcgagactctgtctcaaaacaaaacaaaacaaacaaaaaaaaactacagcttggggctgggtgcggtggctcatacctgtaatctcagctactcgggagaccgaggcaggaggatcacttgaggccaggaggtccagactagc

SEQ ID NO: 91182 - DNA, 1039 bp, Homo sapiens
tcactaccaatatccttggtgggcgacctggaacatccggagccgaggcatctgcaatcaagaggctgtttccccacaaggacaggcccaggaaacaggacaggctacgaaattcaacaggcccagggcagaatgaaaacataaggccccttattcaaaaacgacagattctggcatgtacctgtggtcccagctactcaggaggctgaggcagaaggattgcttgagcccaggaggtcaaggctgcagtgagctgtggtggcgccactgcactccaacctgggcaacagagcaagaccccatctccaaaaaaaaattatggattccatgctggtaatggcaaagtgttctgccgagcaacagggactggggacctaacaggtcacagcctgtagagccaacccctctcatgaaggctggctccctcggggtgcacctgcgggcagtgaccattttctctgtctctcccagtgcctgtccattggggtcctggacatcttcgggtttgaagacttcgagaggaacagctttgagcagttctgcatcaactacgccaatgagcagctgcagtattacttcaaccagcacatcttcaagctggagcaggtgcggaaagggcttttttgtcaattttttgaacttggtaaatcagacatcacgtgaaatttaccatcttaaccatttgtaaatattcagttcagcggcggtaagtacattcacatattcgcattgttatgcaaacgccaccaccatacatctccagaactctttcattttgccaaactgagactctgtccccatgaaacactcactccccattccccctcttgcaagccctgaactcaccccattccacttttttttttttttttttttttgagacagggtcttgctctgtcacccagctagagtggtataatcatagcttactgcagcctcaaactcctaggctcaagtgatccttcctcggcctcccgagtagctggaaccacaggtgcacactaccatgcctggctaatttttgtattttttgtagaga

SEQ ID NO: 91183 - DNA, 1117 bp, Homo sapiens
ttcatgcctgcaaaggttccatgttctgttcccagcttcccccacgccacgagccagaccctgctggccaagttcaaacagcaacatgaggacaataagtacttcctgggcaccccggtcatggagccagctttcatcatccagcacttcgcagggaaggtgaaatatcagatcaaggtaggtgtctgcccatcaccactggtggaagcctgagggaagccacagtcagcccagaagcccatgtgggaggatcctcctgtgggcgaggttccaggtgctcagaacccaccgcgaatccccggctccaatgtccaaggcgccatagttcaagaactgccatttgcacttaggatgggccccaccccaccgtcagcccttcctgcgccagcccggggtctttggtaggcgccggtgagtgactatccccgagtgaccgcccacatccatcccccaccaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtgggagctggggcgtgaacccacaaaagcgtcactgtcgagaggggggcacatcctgagttcatcttaaagtgaacacttcagtggcatttagtacattcattatgttgtgcaaacgccacctgtctacctgaagtgttcctgtcaccctgaacagaaactcgacctgcgtgtgtaatttaacctcagggcatgctatcagcaactccatcaggcgtctcctttgcaaatgatgccctctgatcccactggccctgggagtttgctgattgtgataatgtagctcttcctagtgttttgcctcttgtttctctctctctgtcttgctctttttttttttttttttttttagagacagggtctctctctctctctctcttgcccaggctctagtgtaatgacgcaatctcggctcactgcaacctctgcctcttgggttcaagcgattctcctgc

SEQ ID NO: 91184 - DNA, 1106 bp, Homo sapiens
ttgaactcctgacctcaggtgatccgctcacctcagcctcccaaagtgctgggattacaggcgtgagccactgcgcctggccagctttggttttcttctttcccaccagcatgatcctgaaaggagctcccacccaggccccattttggttattttgcagggcaagtccctgccctgccagcagagggttccagaagggcctctgtgggcctgcttggcatctaccagcacatggcaaagacagcctggtcacctggtcaccaccaggactgctcaggctccctccgccccactcggcatcctgctgtgatctgggggatatgtcagttcctccatagcaagccccgctggatgcacgtcccaccctgtagattcctagccagcccctcctacttctcagacatccgaatggcccccagactaaacactttactcagctttggggcagccaccagcagagtccgggtgccgccaacccagggaaactggtgtccacagacagtggctgaggcacgccacggtgtgcagcgtggagaggtggcggtggccttgttgcacttgcgccttctcactctctcccctctctctgtgtctctcagtctaacccgccaggcgtggcttgctgaactaacccaaatcccgacactgtgttccttttgttcacaaaaccatttttaatattttgacaggaaaagtaaaggtatcaaacaaaagcagatcattccaaaggtaaaaaaaaaaacacaccccgcgcgacacgttccaagatatcttgcttctctgcccgtcttgagagctttcacttctgcaacttcatttcctcctccttcccactatctccccctccctccaagaaaaaaaaaatgttctcgtgttgagatgatttagagctgtctctttatgggtttcccagaagcagggtctgagatggggtatttgcacacacagcggcttatggaagagggcttacgtgagaaggcagagagaaggggtgagggaggaagctaggggcgtaagcatagctgaagtctggcctcagcctggtcccatggggagctctagtgggttcatagcaccacagagctcatcctgccccaacgtaatgg

SEQ ID NO: 91185 - DNA, 1526 bp, Homo sapiens
cggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagagtaagccccacaccctcttttgtctgagcaccagggtccaggccaggtgggcaaggccaggggcagtgccacacatcctggaaacacatgtgtaatcatgcccagtgggtgtgcgggaggcctgagggaggaggacgagcaggacatgctaaagaccaagtgaagacaaggcagccagccagggcccaggctgggacctggagccttgaggggtccccagaaggagctgtgctcacacagaaaggccccggccttgagagaggtggctcctcaggtcaaggtccctgctgcccagaaatcttgggccttggtttctaattggtgaacaggactaactgcactcctcggggttaaaggagcaggggcttgctctgcctgagccttagtaagccaagtgtcagtgacttggaatctccagctccctcttccagagggcctgcaggaccaaaggaaagaaatcagggaggagacaggccttccctgcagcaggcctgctcagcctcccactgctcgtattgggggccagatcattctctgcggtgggggctgtcctgtgtatcataagatgttgagcagcatccctggcctccacttaccacatgccaggagtattatcgatagatgatggatggagggagggagggagagagagagagagggaaggatgtgtgggtgggtgggtgggtgggtggatggatggaagatagagatgatggaaggatggatggaaggaagatagagatgatggagggatggatggatggaaaatgatagaggtgatgaatggaagacagatatagatgatggatggatggaagatacacatgatggatgaagggatggatagatagaagacaggtagtaatgatggatagaggcatggatggatggatgatacagatgatggggagatggatggatagaagatgggtagaaattaggctgggcgcgatggctcatgcctgtaatcccagcattttgggaggccaagagtttgagaggagttcgagaccagcctggccaacatagtgaaaccctgtctctactaaaaatacaaaaattagctgggcgtggtggcgcatgcttgtaatcccagctacttgggaggctgagacaggagaatcgcttgaacctgggaggcagaggttgcagtgagccgagatcaagtcactgcactccagcctggatgacagagatgagactccgtctcaaaaaaaaaaaaaaagtagagattatggatagaaggaagatagatgccgacgatagatggatggaaggaagataggtaggtagagacaatgaatggagggatggaagataggtagagatgatggatggctgggtgggtggatggatggatggatggacagacag

SEQ ID NO: 91186 - DNA, 1092 bp, Homo sapiens
tgtggcctctggttctgcagaacacaccattgtccccggttctgtacaaactccttgaggccctcaggcagggcccaggcctgtgtgtgtgtctcagctcccccagccctgctcatccttgctcctgagagagtcctgagccatgcagagggaggccccccaactctgtgcataaggttggggtcctgggtgctgggggtgcagcaagagtcagggtctacttctgtgaggtggctgtgggggctaggttatagctctctccccacgaaggaccacccatgccttgggtggcctacaaaggaagcccctgcccagtggctgccatgctggccttgacttctgcagccccacacccccaacaaccacgcagaaggagacagggagggacagaacagcagaggaagccctgagggccttgtgcgggaccaggaggcagaggcccccagagacagctggagaggaagacagccaggcccagacctgacccccaaccccggcactgcagggcgagccaggcgttgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacaggtgggcgctgtgggcaggtgggtgcagtgccaggccccaggcacagccgtcctgccagtgcgccgctcaccagacccaccccacccaccccacagaccccgcagcagtcaagctggagaacttccccatccacgccatcacaggggtgctgaagcagtggctgcgggagctgcccgagcccctcatgaccttcgcacagtacggcgacttcctccgagccgtcggtgagccccatggcggtgcgggtggcagcaggtggccacagccaggatacagcgttcgctgtgaccagcccaggaggcaggaccacccagttcacaaactgagaaactgaggcccaaagcagtcggcccagccaaaccgggtccccagtttggggtggggccaggacacc

SEQ ID NO: 91187 - DNA, 1046 bp, Homo sapiens
tctctctcccagccatggcctctcaaactggggttttcgtctccctatgagggggtcctggtatgtacgcgttcggtgggcccgcggtgcatgtctcccggtgcagtgcatgctggggttccctggggccctgggcccctcgtaggatagacagagcctgtcctaaccttccggaagtgcatgctggggaggccccttgcctgctgaccttctgtgctcaggacgactaatcggccacatgaccaccactctgtcccatgggattcctagagaagtctcactaagagcccagcacactcacatcacaactaacctcctgggatctgctcacacctccggcagtaacctcgcccactcagagatgtcagtgggaccccttgcttctttgtttcagaacaagagccccaagacccgggacatccaggaggaggagctggaggtgctgctggaggaggaggcagccggcggcgatgaggaccgggaaaaggagattctcattgaacggatccagtccatcaaggaggagaagcaagtggctcagtcccctccctcagtccttcatgtttagggcaagctggagtgcaggttccatccctggtggtccgcttgacctcgccaggtttggtcctgtcatccctaacactgggcaaacaacactttttttttttttttttttttttttgagacggcgtctcgctctgtcgcccagctggagtgcagtggtgctatctcggctcactgcaacctccatctcccgggttcaagcgattctctgcctcagcctccgagtagctgggattacaggtgcccaccaccatgccctgctaattttgtgtttttaatagagacagggtttcaccacattggccaggctggtcttgaactcctgacctcaagtgatccacccaccttggcctcccaaagtgttgggattacaggcgtgagccaccgcactcggcctttatttctgagacagggtctttctctgtcacccaggctggattgcagtggtgcgatcacggttcactgcagccacaatcccctag

SEQ ID NO: 91188 - DNA, 1181 bp, Homo sapiens
cgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacatgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcctgctcatatgggatcgggcttggaagaacagggccggtg

SEQ ID NO: 91189 - DNA, 1056 bp, Homo sapiens
aatcccaggctacagaaatcgggaagggtgtgtggacgtgaaatagctccgactgggaagaatccaggtaggagtggggtgcggggaggtactttgagcaggcaaaacagaacaaaagggcacactgcacgcgggtctgacaccagaagaccccggtcgtcctatcattcccgaagggttaacatgctctcgaggaaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaaggtgaggggatctcgcactgccgcgtagagcccgactcccggggggtgattcctagggttggaagccacctggcccgactccccggccccagtagcctctcgggcagcgccctttccggtcagtcccgccacgtccacctgtagcttccgcccccgtccctgggactccgcccctcccccactggccccgcctcctttacgcttgacccctcccatttgtcggccccgcccccccgactcccatgatcaggacatgggaaagacccccgggtgacaatccacttttcctccccagtacgtgggagccctagaggacatgttgcaggccctgaaggtccacgcgaggtgagtgcaggcagcctcagggctttcacatcagcacgtggctgtgctactggacatcccagtaccgctatcccagctgggacccttccctg

SEQ ID NO: 91190 - DNA, 1033 bp, Homo sapiens
tcacaccactgcactccagccggggcgacagagcaagactccgtctcaaaaaaaaaaaaagcaaaaaaattagccaggcgtggtgacgcacacctgtagtcccagcatacttgggaggctgaggcaggaggattgcttgagcctgggaggtagaggttgcagtgagctgagattgcgccagtgcactccagcctagttgacagagagagactctgtctcaaaaataagcaaataaataaattttttaaagctaggcactcccagcctatgggaccaaggctaggctggagggagggacctggggtctgagggaaccgagacaggagtaaggagaccctcctagaagagggggtattcaagcatggtcagaagccaacggggcagcagacaagatgaggaaacagcattccaagcagtagacccagcacaggcaatgctcaggatgccggaaacgggaaaccaacactcgccttttttgcttggcctgttttgctttcagagcctgagatggacgtaaggaagagaacgtgagtgtctgcggccctggggcagtagtggcaattgggcggtgcggcagggacggggtagcagtggccaaaccctggaccaccgaggcactaccacaaggatctaaaccaaccagaagccacttctgtggatgctcttcccagaagtcaaaggccaggcgcagtggctcacgcctgtaatcccaatactttgggaggctgaggcaggcagatcacctgaggccaggagttcaagaccagtctggccaacatggcaaaaccctgtctctactaaaaatacaaaaaattagccgggcatggtggcatgcgcctgtagtcccagctactcaggaggctgaggcaggagaactgcttgaacctgggaggtggaggttacagtgagccgagatcacgccattgcactccagcctgggtgacagagcgagatgctgtctcaaaaaaaaaaaaaaaaaaaaggtcgggcgcggtggctcacgcctgtaatcccagcactttgggaggccgag

SEQ ID NO: 91191 - DNA, 1046 bp, Homo sapiens
tggcacgatctcggctcactgcaacctccgcctcccaggctcaagcgatcctcccattagccttccgagtagctggaactgcaggcacgcactaccatgcctggctaattattcttatttttagtagagacggaatatcatcatgttggccaggctggtcttgaactcctgacctcaagtgatccacctgcctcagcctcccaaagtgctgggattacaggcgtgagctactgtgcccagccccagctgatttgtttttgcagagaagggatcatactatgttgccctggctggtctcaaatcctggccttaaatgatgcttctgccttggcctcccaaagtgctgggactgtggccgtgagccatcatgcccggccccctgttcttacccacagtggcgagtggtgtcccctagtcacccctgtgggctctgtgttctctagctgcctcccacctgtctgacttgcctttgtccccctagacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttg

SEQ ID NO: 91192 - DNA, 1074 bp, Homo sapiens
tggggtcaaatatcacttccaaagtcgctgtggctacggaggcggcagacggagggaggctggggtggcacggggcggccttcttcgcatgaggggcccagcggtgggggtgggggtgggagctgggcttgcccatctcagggaacccctctgggctcactctgggccttgggtcaccggaaatcgccactggaaggccggcagggccaccggaattgactgaaacgtccctctcccccaggggtgggtgcagacctggggctcctggaaaaatccctcaaactttgggtgtctctgagacgggcagggagtgaaacgtttccgagcaggagccttgggctgtcccaggtcggagacctctctggcagggcgtggccttgctagctgttctggcggaaggtccccagggaaagcgatcggggttgtccagcccgggagttcttttctcaccgttcccgggcgagcatccgatctgtccgtttataagcccctactctgcaccccaggaacatgcagggtctctgtggagcccgtctagacggtctcagttcccagctgcccaaaacagaggcccaaaggcccagagagaggtcctggtgcctgctttgcgttggacatggagggacgctgcccgagttgggggcactgtgggggaactgtggggctagggtggggaccgctgagttcggatcggagtggccccagggagaacggctgatggaaggcttgttggctgaggccaccaaatagggccccaggtacccgagggtggagtttggccccaggtcccgggtcagggctggcctggtgtggccatgtgtggcagagctgccttgctccctcctccagcacaaagtgggccactagactttggcctcattcttgctgctggaaaaccgcctgctctctggtcatatctttagggagggtaagggaggggggctcaggcagttttggggtcccaggagcttcctgagggtggtgtcagggagcagcaattttgggtggggggggccttgcttggagctgacaggtttgtgctgtgtcagttgtgtgacctggtgaaatcaccat

SEQ ID NO: 91193 - DNA, 1373 bp, Homo sapiens
gagtagctaggactacaggtgcctgccaccacgcccggctaattttttgtattttttagtagagacggggtttcactgtgttagccaggatggtcttgatctcctgaccttgtgatctgcccgcctcagcctcccaaagtgctgggattacaggcgtgagccaccgcgcccggcccacactggggactctttgggggccatgactgggacctcttcagatccttaacactgggtccatggcggggaatgtttgctgaatgtgtgaatggtttctgcttggcaaactcctcttcaccctttagaacccaccccagatgtcccctcttctgagaagccctccagggatatgaagggcctgttggggtaacctctgcctgaacagcccttcactgacccccgcctccccggcaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaccgaagtccacgccaatcactttgtgttaatggggatcatcttcattgcaagtgatggaaaacttagccactgagcaaaggtgagtggctgctttcttgtagatgaaaaagccccgggatgtggaggttgcagcgagttgagattgcaccactgtactccagcctggtgatagagtgagagcttttctcaaataaaaaagaaaaattcaaaaataaaaaagatgaaaaagccaagagaacagcttcaggcttggctgtgtccaggtgctaggacaacattgccatttgggagggtactacatggttgctagtcaatgtgccctgcttaccccccaaccaatggaaaggtgtgtgatggcttcaaccactccccagaccccaatccaggtcaaggcagagttctctcagcatctggatatgattggactcccccggggggatacatgaccttcaattaagagctagtcat

SEQ ID NO: 91194 - DNA, 1558 bp, Homo sapiens
gatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggtgagaatcctcaccccatcacacccttcaccaggcagttgtaccaccagcagctggaagaagcccagattgctcctggttagtcttcccagggcacatggagtccagggagcctccaggaatctcccggagaaccccagctctcagccccactttcctccccatctcagaatcatcccttcctccatctcccttgacttccaggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccaggtactcagggcaggaaagccccagaaatagaaactagaaaatttggggattggtttttatttgctgtgtgcccttaagaaagggactggccctagaatcatcagctgcttcttcttctttttttttatttttttaagacggagtttcactcttgttgccaaggcaggagtacaatggtgccgtctcggctcactgcaacctccacctcccaggttcaaacaatcctcttgtctcagcctctcaagtagctgggattacaagcacctgccaccacgcccgactaatttttgtatttttagtagagacgaggtttcaccatgttggccaggctggtctcgaactcctgacctcaggtaatccacccaccctggcctcccaaaatgctgggactacaggtgtgagccaccgcaccggcctctttttttttttttttttttgaggcggagtctcactgtttcgcccaggctggaatgtagtagcgcaatcttggctcactgcaacctccgcctcctgggttcaagtgattcttgtgcctcagc

SEQ ID NO: 91195 - DNA, 1059 bp, Homo sapiens
cctggcttcatgtgatctacccaaagtgttgggattacaggcgtgagccaccatacccagccgcctgctgtcacacacttctgctggatggggaggtgtccccatggctgcccctgtgaccccacatccaatttctccagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggcgtttgaacctgggcaactccacctggaataggagctgggtaaaatgaggctgaaacctactgggctgcattcccagatggttaaagcattctaagtcacgggatcaggtaggaggtcagcacaagataacgggtcataaagaacctgctgataaaacaggttgcagtaaagaagccggccaaaacccaccaataccaagatggcgacaagagtgacctctggtcgtcctcattgctacactcccaccagcgccatgacagtttacaaatgccatggctggccaggcgcggtggctcacgcctgtaatcctagcattttgggaggccaaggagggcagatcacctaaggtcaggagttcaagaccagcgtggccaacgtggcgaaaccctatctctactaaaaataccaaaattagctgggcatggtgg

SEQ ID NO: 91196 - DNA, 1050 bp, Homo sapiens
gctacctgttggtgtgtatgcagagcatccctgtgccccgcggatatagactggcgcgcctctgttgcgcaggcgcagaactacaacttcagggttttccccaacggcctcttttttgcacgttaggagaaactacatttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtaagtcctcagggggacccttccccaaatcagggaataagggcggcttcggaggctggcgccactcttcactgcccgcgtgacctgccagtgccttgcgcattttgcagccaggctctgtctccgggagccgaggctcagagaggttgagcgccaaggtcacccagcgccccgtctgacctttctcgccgtccctctacccacgcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcag

SEQ ID NO: 91197 - DNA, 1021 bp, Homo sapiens
atatatatatatatatatattagccgggcgtggtggcatgcatctatagtcccaggtgggaaaatcagttgagcccaggagctccaggctgcagtgagctatgattattccagcctgggtgacaagagtgagaccctgctcttaaagcatttatccatctggagcctgtggggtgggactgtgtggtcactgggcacagatatgcggtatgtgctcctagtcagcctgggagaaacataggcatgagagtctcagttgcggggcttggtcccccaccaagggtggaatcccttgcagggagccgggaccctgaaagcagctggctcaggcctctgggagtagctgcgagtgtgctcagaagcaaaaacatgggacttttggagatctctggagttgggggtactgagttccagccccaaaaagacctcccagggcagtgtcaggggaggagcctggggaggggaggcgtctgcgactttctctatctttcctccttagtcatcgtgacagaaaagacaaacatcctcctgcgctacctgcatcagcaatgggacaaaaaggtgaggcccacagggctctggtgcagggattgtgggtggacagagactgggcacctggcaggggcttctgagcacaggaaggactctagtgattggagcagggccttgagggctgggtaggagtgccctgggcgatccaggagagggaagagcgttccagtggagggaaccgctgtgcagaggccacaggacaccagtgctcaggaggctggaggccaggcccaagtagccgccaggcccagttttccatggctctggcattaggtagactgtattggtatgaactagatagaatattttctgaggccgagtgtggtgacgcatgcctgtagtcccagcgctttgggaggctgaggcgggcggatcacgaggtcaggagatcgagaccatcgtggccaacatggggaaatcccgtctctactaaaaatacaaaaattagctgggcgtggtggcacgtgact

SEQ ID NO: 91198 - DNA, 1014 bp, Homo sapiens
ttgaaggttgcggtgagcggagatcacgccactgcactccagcctgggcgacagagtgagactgtctcaaaaaaaaaaaaaaacatggttcctcaccagaaccccactctcccagttcctttacattctccccgcctgcccctgcacctacaatttctgaaggagaatcagatcttctatccgtctagaacttctcccctggaaagagctctagaggtttaagagcaggcaaaaagctgtgacttgggtttcagacaaagaggggctagccaggctaggcacaggtggaggggcggggatcacctgtgctcctccctccacagtcccggagctggcagcacgtgggatcatccagcaggtgttccctgtccacgagcagcgtattctgaaccgcctcatgaagtcatgggtgcaggccgtgtgtgaaaaccagcctctaggtgctgcctgggctggggggtgggagggagtcccagcagacaggcagggggtgactgagacccacttgtcccctggcagatgacatctgtgattactttggtgtgaaaattgccatgtacttcgcctggctgggcttctacacgtcggctatggtatacccagctgtcttcgggtctgtcctgtacacattcacagaggctgatcaggtactgggcagggaccctgcaaggtctgggggatccagaggcgccctcctttctggactggcacaaacaatgactcaactcttctctgccactcacagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcagggtcagttgggggctgagtccagggtcatggagacaggacaaaggtaaatggtggggggcactgcaggagcaaaggcagagaggtgtgaaacaggattgtttcatcaa

SEQ ID NO: 91199 - DNA, 2297 bp, Homo sapiens
acagatgaatacaggctggcacggcctaggcactcagtaacacacagcagaggcacagggacttaagatggagtgtcccaggcagccacagttggctggcacccagctgggaagggcccaagggcttttaaagcagggtgaaaaaaaagcccacctcctttctgggaaactgaaactgaaaacctaattaatcctctgcctgtaggtgcctcatgcaagagctgctggtcagagcacttcctggaacttgctattggtcaggacgtttcctatgctaataaaggggtggcccgtagaagattccagcaccctcccctaactccaggccagactctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtggtaagctcctcaactcctttggatggcctagtactaggcggtgggagggacaagaatctctccccagaaatctgacccagggtgggtctccagggagatgcaggggaggtcctgaaactgctcctgggcccccacatcaagggacctaggttcccctaccagggtttgtgggcccctaacccagtccagggcactggtgtaggggcagggtgttaaaactctccagatcccccaaatcggggacctcagtatccccctgggacttaggtgaatttataaattctttccagggcactggtgtcgggggccttgaaactcctcgtgggcaccagtcctgggggagtagaaatccctattcagggttgaagggggacctcaccagaccctgaaaaagggggcttttgaaattttcacttcatccctaagaaactgaaatattcacctgggtcctgatatgggggatcttgaaactctcgctgggcatgtcacttgggcggggaaatcccactgcattctggatttggtagggccctctaacttttcttgggccattgctcaggcaatctggaaatgtccactaaactttggttatcgatagcctccaagtttccacgtggggtggcctcaaaactcccattttgaggacccacatgcttatgggtggccctgggagagtgtgtggttgtggctgttctttaaggttggagaccatggtgcagagagggttggaagaaaacctgaaaggggtttgcatttaagcccctctgtccccaggacctagggaggaggcccaggtcccaggggcagcagccaaactccccaggccaaaaccccagattctaactcttcttagatggccctaatggcttccctggatgcagagaaggcccaaggacaaaagaaagtggaggagcttgagggtgagaaagggagaagggagagggccggggaggggtgagtcaggtatggaagagggggtgggggcagggagaccagggctggaggttggggtaagggggaggttctgtcccagagtggagcagggccccagcatggccacatgctgacccgccccctgtttctgtcctcccaccctaccaggagagatcactacattaaaccataagcttcaggacgcgtctgcagaggtggagcgactgaggtcagagatagccttcccccgctaccctccacctgccacattcctctcacccccacatccctagcccaagacccaggatctcctttgctcccaaaatccccattgccccaagggataaagtttgagtcccacaaaaggataacttagcccctagggtcacagagccatgggtggccgctgtccattccctccccggtgacttggattggggcggtgcggggggaactcccgggggcggtgggcttacagggagggcggcaggagccaggacgagcagatgcctgatttgccatctgtaccgcagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggtcagtgaggagggggcggccccgggagggagaagaaagctggggaagcgg

SEQ ID NO: 91200 - DNA, 1506 bp, Homo sapiens
ctataaaaaaaggaaggaaggaaggaagggaggaacggaggaagggggaaaagcagaaagaaacacaccagacagggtgtagtggctcaaacatgttggagaagcatttctgttcatagaaccatgccaagcagggcggcgggcagcaggtgaagctctgcagtgtctgacgtagctgtagtgtccacacagaggcatctacttcctgccagcatggagggttttgtggatcaggaagtgggtgccagccagaggtcttctcttgactgaatgcaggctgggaaggtgggaggaggggccctgagttggaggcgacgcttactaccctgcttttgcagatcagccaaggtcacagagcttagaatgacactggaggtgctaggtccaagccccagggcaaggcaggcaaagtgttactgagaaggaccccgcatatccccggctccttccaactcagttcaccccattccaggtcggctcctgtggtttcaacagccgcatcctgccccacgtgtaccccatccggctggtgaaggtcaatgaggacacaatggagctgctgcgggatgcccagggcctctgcatcccctgccaggccggtgagcagggcccccgcatggtccccacccggagcaggggtccccacgccctgcctgcctagcgcagcctgaacatggccttctccctaggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgcgcagcctgctaggccccggtgactggctgtgcggatggggatcctccacccatctgcccctctcccctctgccaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaagctggggttgcagggggtggtcctgaggcatggtcctgagggagctcagccaaaaggggcttagaagtacacatgcctttgggcagtgcacaacctggacaactgctcatggcagcccaggaggaagcactggatctggagccagttcacctgggtgatgttgagcctcagttttgtcatccagaaaatgggatcatgaaagcccacctgtcttagggcttcaatgagccaagcaggagctccacaaaatgtgtggctgcttccataaatgtcatcccaggttgggagagactggagattacagaccaggggctactgcttgacagtgtatctggtcctgctggtggggaggatgagaggcggggtgtcctcagctgagcctctgcctccaggagtggagggtaaggcagggatggcggccgtcgcagacc

SEQ ID NO: 91201 - DNA, 1024 bp, Homo sapiens
gcccaccttggcctccaaagtgctgggattataggcgtgagccaccatgggccttttttttttttgagatggagtcttactctgtcactctgtcacctaggctggagtgcagtgatgcaatctcagctcactgcaacctctgcctcccgggctcaagtgattatcctacctcagcctcccaagtagctaggactacaggtgcctgccaccacgcctggctaatttttgtatttttagtagagacagggtttcatcatgttggccaggctggtcttgaactcctgacctcgtgatccacctacctcggcctcccaaagtgctgggatttcaggtgtgagccaccatgcccagccacagctacttgtatttttttatctgacaactgtttctgtgtcctctgagtctcccctgcccctgccacctacaacctctcaaggctgtcttctccccacgcccaggcattccaaggggactccatcccggttttcgacctgctgatcctgggggtgggccccgatggtcacacctgctcactcttcccagaccaccccctcctacaggtgagcacaccaatgcggggttccaccctagtcctgagcccagtccctaacatctgggacttccagagggagagccacctgccgggtggggtgtctagagccagggttcaagtcagcctccaccaacatacctgcctgctgggctcaatcctttcaggtctcagttgagccccttaaaacagggaccttaaactacccaccatgggattgttagtaggatgggatggaacagtggctggaccaggcctggtgtgtgtaagtgtccaagaagctgaagtgacattgtccttctgcctccatccctgggcttcctccccaaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaaggta

SEQ ID NO: 91202 - DNA, 1101 bp, Homo sapiens
tggccaacatgatggtaccctgtctctattaaaaatacaaaaagttacccgggtgtgatggtgcacggctgtagtcgcagctactcgggaggctgagacaggagaatcgcttgaacccaggaggcggaggttgcagcgagctgagaccataccactgcactccagcctgggtgacagagcgagactccgtctcaaaaaaaaaaaggttttgctaccttcttgctcattggttgttcatttatttctcagggctatctcagtgcctagaattttctttgaaggaactgaagacctttgctttatttccatgatccaggggatcctgcaggcccccaaaacggggtccctgcttcatttcatccggtgtagggggtgcttccagaggtctttgccagacccccagggcactggcctttgccccagctgttctgaatggtagcctgacctggcagcccatgctgatgctttgtggggtgttctgcagtttgtagatgcggacaacctgatcctcaaccctgacacactgagcctgctcatcgctgagaacaagacggtggtcgcccccatgctggattcccgggctgcgtactccaacttctggtgtggaatgacttcccaggtagagtgagggcctggggactgtggggactgggctgagcaggggggtgccgtggctagagtgtaacttactgtcacacaacctcgtggtgtgtgttttacaaaaatcatcatggaagctgggcacggtggctcacacctgtaaccccagcactttgggagactgcggcaggcgggttgcctgagctcaggagtttgagaccatcctgggcaacatggtgaaaccccatctctactaaaaaaaaaaaaaattacagaaattagccgggtatggtggcacatgcctgtcctcccagctgctcgggaggctgaagcatgagaatcacttgaacccaggaggcggaagttgcagtgagccgagatcacgccactgcactccagcctgggtgacggagtgagacttggtctcaaaaacaaaacaaaacaaaaactcattatggtaatctttaaacagccctctgaggccagacaggagggaagaat

SEQ ID NO: 91203 - DNA, 1649 bp, Homo sapiens
gtgaggctgggacctggggcgagtccagggttgagtagcggggccttgggcgcggtgaagctggggcctggggtgtggccagggctgagaggcaggactgggggcggggtgaagctggggcctggggtgtggccagggctttgggctgctgtgcagggttcaaatgacatgggaggggctcctagagggcagcgctgatgtgggcggagccaggtcgactttgtgggccgagccagtctgactgggagccatggagtgggtggggaaagcgtgttggagagaggctggaggctccttaccccagcgactcctcaacgtctgtgccccacagtgaagcacccgcccgcagagccctcccgcttcatctcggctcccaccaagacaccggacaagatgggcttcgacgaggtgagctgggccttccctggaggcggggcgggggctggagggcccttgtttgcaggggctgatctggctggggactctccgggctgcaggtcttcatgatcaacctgaggcggcggcaggaccggcgggagcgcatgctgcgggcgctgcaggcacaggagatcgagtgccggctggtggaggccgtggacggcaagtgagtccgaggcctgggggtgggggggcgggtccgcacgtggatgtgggtgtagacctcgctggtagacggcaagtgattcagatgggggcgggcgtggtgtccaaacagatgtagacctcgtcagtgggcgtcctgaaggggaagtgaatgggaccctggggaaggggcagatcctcacagttgtagaccatggaaggcaagtgagtcctgacccaggggaatgggtaggtttgcatgctgccagtgtagactggtggggactgtggaggggtaagtcagtcagaccccaggagaggaggagagcaggtttgcccgcgagtgtataccatgtgcaggtgagtgaggccccatgtgcccggaaggggtgccagtgctacaagaggtggaccagctgctcaacgccgcagggggtggtggaatggccggggatggcagaatggcaggcagggtgaaccttcttcgtgaccctctcctcctcctctccagagccatgaacaccagccaggtggaggcgctggggatccagatgctgcctggctaccgggacccctaccacggccggcccctcaccaagggtgagctgggctgcttcctgagccactacaacatctggaaggaggtgtgtcctgagtgatgggcggggccagagttatgactctagatctcatcggagatttggacgggaaaggggttgaaagagttccccaaagccccggctaggcatccagcctcagccatgggacccatggcctctctttagtgaatgatgcgccacaccagctgtatcacccccaggtgtacctgccatccttccattgcgcaaatgtggaaactgagcctgggggtaggggtgagcccttttgagcagcaggtggtgtctggggcctgggacctgtaaacaaatcctcattactcccagcctggtctctgtgcttgatgtttagtactagaagtcatggccacagagccactttaaaccagcacctgcccagtgctgctgggggcactcaccagcccaggcatcctcatccaccctcagagg

SEQ ID NO: 91204 - DNA, 1097 bp, Homo sapiens
aaaaataaaatccgggcgtagtggcacatgcctgtaatcccagctgctcaggaggctgaggcagaattacttgaacctgggaggcggaggttgcagttgagatcgttccactgcactccagcctgggcgacagggcgagactccgtctcaaaaaaaaaaaaaaagaaaaagaaaagaaaaacttgttatcgaatgtgaagccaaatgggggtgtgcggctgcaaggcgggaggtgcatgaggcgtgggcatttgaggggctgggaggcctttctcttctgagatccattatggacggcagagggcagaggtttggatgtccagatgtccctggagctaggagaggcagggagatgcactggcttctctacgggtctttcaaaccttctcaaagcaaagctctgtgctttagggtcaggcctggccttggcctccctgtgatgtggcggggcttcctccctcaggtggtggaccgggggctgcagaaatcgcttgtgtttgaggatgacctgcgttttgagatcttcttcaagagacgtctgatgaacctcatgcgggatgtggagcgggagggcctggactgggacctcatgtgagtgggggtctgaggatggggtgaagctggggcctggggcaaggccaggacttagaggtgggggtgggggcagggtggagctgggacctggggatgggtcatggcttagaggcggggcttgaaggtggggtggaactggagcctaggtacatggccagggcttagaggtggggctgggaggcggagtggagctgaatcctacgggcgtggccacagcgctgcagctgagcctagagcctgtatgtctgggtgtggtcagggtggcaggcgtggccaacccttggaagcgtagcaggagggctcacgtggttcctgggcctgaaggcactgtcagggctgtagcctatagggaagggcgttggaaggatcacccagaactcaagggacctggccggaagcctgcaggcttggtcaaggcttagagacttgactgaggcctgtggaggtggatgtggctaaaatttgaccgggcagcctgtgggcgtggctgaagagcatggggg

SEQ ID NO: 91205 - DNA, 2360 bp, Homo sapiens
ggcctacgtgatctccctgcaaggcgcccgcaaactgctggctgctgagccgctctccaagatgctgcctgtggacgagttcctgcccgtcatgttcgacaaacacccagtgtgagaggggcaggcggctgctgggctggggtttcacggtgggtctgtcctgggagaatggggatgtgagactcacggcctccgagaagatgtctcttcttttgcctacttctccctccgtttgccccctcgcagatctgtctccatttgtatcccctgcacacttacgttttaatctgtccccgctgacttcttcacccccaatttttcctccagctgtcccgtcccctgaagccattgctgcccctcactcccctcctcctccccccaggtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcaggtccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccaggctggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttt

SEQ ID NO: 91206 - DNA, 1017 bp, Homo sapiens
cgtcacaggcctggaggtgatcgtcaacccctgggaaaatctgtgatgtcctggggccagacaatgattaacagctctgggatggaatgtctttgacatcaaggaccagggtaggattgatgactcttaggtgtggaacctgtgacgtcgtagggccacaaggtgattgtcatctcctgggaaaatcaatggtgtcccagggccaatgaatgattgtcagctcctgagggacctggacagtcatgggtccagggaatcgttgacagctctgggagacttcaggagtgattgacagctcaggatgggcaggacctctgatgtcaaggggtcaaggaatgattggcaggtccatgggtgggaactttgacgtcatggtcccagagagtggttgaactcccctgaggagggacctctgtgatgtcatggggctaaggaatgattgacagctccgagggcgggagggacctcgacttggtgggggagggtggacggagagggagttcccatttctcaaactctctctttctctctgtattttgcttcggtctcctgtccctctctgagcgcacacacacggcagctggggctggatggagggcaggattccctggggacccccccttttcaaaattggtcccgacaaggggaagaagtttggcggcttgaactcaggagggggagggagaatcgccatcgacacccagcctggggcgaggggagcaaagccctgtggcctccaacggcccccttctcccccgatccagccagcccaagggccctccgtgggcgctgggtctctgagctcagcttcccttccagtcctggctgcttttagtgtccctggtgtccctggagcaggaggctgtctgtctctccgtctgtctgcagctgacgtttctctctctcttgtttttcctccctctcactcgccgtcccctctccgcgcctcccctgccccctccacacacactcctccatcctcacctctcactggctcgtctctccccgctccccatg

SEQ ID NO: 91207 - DNA, 1053 bp, Homo sapiens
ggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcg

SEQ ID NO: 91208 - DNA, 1041 bp, Homo sapiens
caccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgcgtgtcaccccagggcctctggtggtaagtgtagttagcacagatgggtaaaaccaccctcgaccctcagagactaagctgtgttccccaggccacacgggaatgggggcgaatgtgggagtctcacatggctcagcccttaggggtctcttcggactctgattctgtcgtgtcactgttgtcattggctgtgctggaagcctgggggaggacgcagggcctcgtgaagcctcatggttctatcccttccccagacaccttgtcacttagccattgttccgctgtgagaattagtcgggatggaataggtgggctgggtggtatctgtgcggctgagaaccctcccccatggctgcatgaagctgagagactgaaaccaagccctgcagggcgaggtgcatgtgggcagagggaggaccgcctcacaccgcggcccctgccctctcatagctgctaggctggcttcaaaggagtgtccctgtagggtgcacgacccaggaaaaggcccagaggtaggaaagaggttggtgtgttcaaggagcagggggagatccaagtgagtagagaggggtctcaggccaaggaaggccttgcagaggaggagctccgtctcctgtgtgctgagaaggctctttgggtgctggttgggaggaacagggacctcacagacgggctgaccacccattgcagacctcaaggtggagcacacaagatcagggaaaagccaggaggggtctcaaatgccaggaaaggaaggcgacttgggcccaggccagaagggcagggggcacccccctcactggtggtccactctccccacacaccccccctcc

SEQ ID NO: 91209 - DNA, 2796 bp, Homo sapiens
ggctggggagagacctgaggtcttgtcctagttctgcctggaatgggctgtgagatcccatgctggtcactgggcctcagggtgaaagaagatgttggctggatgttttgaggtgcagagtggctgtttgacggcgactgcaaagcaattcaggactgcagcatgaagaaaggaggctgtgggtctaagccacagctttcctggtctgaaacccttagcccaggcaaaggagaggcaggcaactcaattaatcctccctggagacctccctctcctcagttcattttgtgtataaagttgtggtcgggagtgtgacctacagtcaccaagaatccacatggaggccctagggtggccctgcctcctgcttcccgaatctgtggtcactagatgtaggaaagggagtgaggtggatctccacagttgcctctgggtgctggccttaccctcactcctgtttcctttcagctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtatggagaggccggggctacgtggggtctggagtggatttgcgcctcttgggacatcgtgcatctcaagaattaatcagacatcgaacgggtgcggtagctcaacgcctgtaatcccatcacatcagacatcagagccccgggttgtgtttctgcctgggtcacgggactggagcagagcttatgtgccatttccctgattagaaagccagggacccagggagcgggtgggtggcatggtgggacaccttggttggtgctgtcttccctgggccctgtctgttaagtgaggagaggtgatggctatctggtcagtgggtggtagctaggttggcccagacaggttccaggagacttgagttcaggaactgcatctggggctgggttggtgtccgtggcagaagcctggacttcaggctgttgccatgggaagttcccttacctcacgctccctgaggatgcctgaaggtaggtggggctgggaaactgaggcacaagagtctggccatagagtaggcctggagcctggggtgtgctttagaggcagagggttcagtgaggatggggctagggcacatcggcttgctgctctcacatctccctgtggcctctccttggcaggtgtttgagaagtcccccctgcgggtgaagaacttcgggatctggctgcgctatgactcccggagcggcacccacaacatgtaccgggaataccgggacctgaccaccgcaggcgctgtcacccagtgctgtaagctgcctgtcccgcctccagctttttagaccctccttgactccctcacactgaggcagggcaagtgccagaggttcccagtgcaggagagtctcaggactggtggcggggcacaggaagacaaaaggatgccccaggccccagatggcgcttttctgagagccctgccaggctcggttgtaaatcacatcacatctggaaactccctttttgggtctgcaccttgtttagactgggatccacatcaccactgttttctgggacccactgagaaccgaattgaacccctgcctagtgttgggagctggcaccttttccctggctcacctgccagggtctgtgagacccccacacctccctgattgcacctaaacccaagaatcactgtttcttatagcggtggtttaaacagaggtgcaaacagcaagcggatcttgtcgcctttggggggctgtggccgtgcccctcaaagtgaatttggaggttccacaactctagtggccagtgactgcagggacccaggccttgggctatctcgcttccccaccaccaccttcccgtgagccccgagccctcaggcagttgctgtgaccaacaggatgtgtcaggtcattgggcaggcactcaggaggtttgctgaatgcccagagcccaggcaacaccgtcaccctggccccgctcctttccacagaccgagacatgggtgcccggcaccgcgcccgagcccactccattcagatcatgaaggtggaggagatcgcggccagcaagtgccgccggccggctgtcaagcagttccacgtgagtgccctgggggactcccctggagggaagtgcctgctctgacgcaggagcccagtggggggcggctacaccttggtggccccacaggatggggtgttaagaggcttccaaccccctcaacatgcctcccttcctcacaggactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgctcgccgcatgttttctttgcacactgcagagctcaaaggggtgctatgagaggccggcccagtcagctcctggggtgcagctgagctgccatttctttgtcctgggaggggtcttcagtgcaaacaaacaaaccctcacatcctcctgtcctggagtgggccctccaggcgcccccacccctgagctccctcttgcttggtcagttctcagccctgctggcagccctgggctatgagctgcaggggtactgtctgtcctgggccctaaatctgtcccaactgccttgtgagacacaggcctcc

SEQ ID NO: 91210 - DNA, 1032 bp, Homo sapiens
cgatcttggctcacttcaacctccacctcccgggttcgagcgattctcctgcctcagcctcctgactggctgggaatacgggtgcacaccaccatgcccagctaatttttgtatttttagtggagatggggttttgccgtgttggccaggctagtctcgaacttctgaccgcaagtgatccgcccgcctcggcctcccaaagtgctgggattacgggtgtgagccaccagacctggcctaaatgagctcatttggtgtcatgatgtgaattttgccttaataaacttttacaaggagagcgctaagtccaaagcccttgttttatacagagaaggccacagaggccccaagagggtcatggctgcccaagtgtgattctgggggtgctgagtgccgatgtcccctccggcccctgctcccccatccccatcctcttcccgcagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggtgcgtgcactccgagtccccgcggcccgcatgccttgtggccaaggccagtggtcattatgtcaatgtgggtgaatagcgagagggccctctgagctttggtctgaaaggccaggagggaccaggcgctgtcgctcacgcctgtcatcccagtactttgggaggccgaggcaggcagatcacctggggtcaggagttcaagatcagcctggccaacatgatgaaaccctgtctctactaaaaatacaaaaattaactgcgtggtggcgcacacttacagtcccagctactctggaggctgaagcagaattgcttcaactgggaggcgcaggttgcagtgagccgaggtctccccgctgcactccagcatgggcaacagagcgagattccatctcaaaaaaaaaaaaaaaaaaaaaaga

SEQ ID NO: 91211 - DNA, 1058 bp, Homo sapiens
gagaagctgccggggctccacgtggtgcagggtgggtgggtaggccgcctcctggtaggcctggccgtgagcagacaacctcagggcttgtgccccgcggggtcctcttgtttgcagggctgccggaaagtaaggcagagaactgggcgccgggagggtgggacctgtcccaagagggcttatcagctgaagtcgcgattccatcccccctcatctctcccgccttcctcccgcccctagcttctcttgccagtctctatctcatctccttggaactgtgcatctttgcttatctctctctgtctctgtcacccacccacccgcccagccgagaaagccaagagccatctggaggtgccgctggaggagaacgtgaaccgccgcgtgctggaggagggcagcgtggaggcgcgcaccatcgaggacgccattgcagtgctcaggtaacggggcggggcctggggctttcccaggggtggagctggtcatcgggggcggggctacctgggggcggggccgggcttttcggggcaaggctgcgcccaaggccccctgacgctcatgtccacccccagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggcacttga

SEQ ID NO: 91212 - DNA, 1128 bp, Homo sapiens
catctgtaaaatgggcatgatggtgaagccaggttgccagataaaatataggctactcagctaaatgtgaagttcagatcaatattgaatttggttttactgtaagtatatcccatgcaacatttgggatatacttatactaaaaaaaaattattcattgatgctatggtttgaatggtcccccaaagttcatatgtttgaaacttaatcctcaaagcagtcctttcaaccttgtcaacctgtcggcgcggcctctggtgcagtggcggcggctcctgttcctgccgcagctctctccccttcttacctccccaccagatcccggagatcgcccgccatggctttacttactgcggccgcccggctcttgggaaccaagaatgcatcttgtcttgttcttgcagcccagcatgccagtgcttcctccatgaatttgaaagacatattggctgacctcatacctaaggagcaggccagaattaagaccttcaggcagcaacatggcaagaaggtggtgggccaaatcactgtggacatgatgtatggtggcatgagaggcatgaagggattggtctatgaaacatcagttcttgatcctgatgagggcatccgtttctgaggctttagtatccctgaatgccagaaactgctacccaaggctaagggtggggaagaacccctgcctgagggcttattttggctgctggtaactggatgtatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccaagcatatgcacggggtatcagccgaacccaagtactgggagttgatttatgaagactctgtggatctaatcacaaagctaccttgtgtcgcagcaaagatctaccgaaatctctatggagaaggcagtggtattggggccattgactctaacctggactggtctcacagtttcaccaacatgttaggctatactgatcatcagttccctgagctcatgcacctgtacctcactatccacagtg

SEQ ID NO: 91213 - DNA, 1049 bp, Homo sapiens
gagtttaagaccagcctggacaacatggtgaaaccccatctctactaaaaatacaaaaattagccgagcatggtggcgggcacctgtaatcccagctacttgggaggctgaggcaagagaatcacttgaacccaggaggcagaggttgcagtgagctgagattgtgccactgcactccagcctgggtgacagagcgagactccatctcaaaaaataaaaaaaagaagtgacatgtgagcagagacctgcaagaacctgagaatgagagaaagccatagagacagaaaagagaaaggtggctctgagcatagggcacagctgtggcaaaggctgtcagtgggtaccaagcctgccacgttgcaggggcagaggaggccagtggcttggagtacagtgaagtgaggggaaatggtggatggtactagaaaggggtaccctgccttctccctccctccctcattttacctccctccctcattttagatgagatcatgtggccagagggagatgaggcccttccagcagacgcccaggacctcatcaccaggttgctccggcagagcccgctggaccgtctgggcactggtatgtagtgtgggggagaacccaggtgggtggctccttcaggccctgggacccagggaatggagggatagcgcccggggtagacaagagttctacttgggaagctgcatggaggagggggtttgcagctagggttttgaaggatgcacaggagttctccaggaactatcacaagaccttggaaagaatagaaagtagctgggtctggtgcccatatggagcactgagcctgaataagtgtgtgaggctgtaaagtcaccaggacctgtgtcaaaggcccagcccagaagatcccactgtcccagttttcccagccacctggttaatcattaagggaccgtttgagactcatgcagccacccatcacgtggccactatggctcctgttcatgactgaggctttgctatgggagacggttgggtccaaggtcggggatcatcacctgctctgtggagcagaagtg

SEQ ID NO: 91214 - DNA, 1058 bp, Homo sapiens
aacacaaggaaactgaggcacagagtgggaaagccattttcccagagccacacagtgaagctgaaattcaaacttgagcctcgactgggttttctggcttgaacttcatcccagagaggctctgacatatggagggaacccctaacaggtgtttcagacacatcacggccaagggcttactctgctgggcctcaaacacacggcatcttgtccagggtagactggacaaggccaggccaaggcagagcctgaggggaggggacactgagtgtttctggaagtagctggacgtaatcccgcaggactggcatactggagcgtgccccgagacagccgagcatttctggaggctgccttggcagttccaggtgaggcctgtaccttcctttatcagtgcccacctggggagcggatgacccctctgcccagatccggtgaacacctattcatccatcaaagctccagctcccatatcccttctccaggctgaagccagcaggattggaggcagactctatatatagagcaggcactgcctgggcatggcagctatgatggtgggaagtggccttcagaatccagtccatcgctgggattacattgttttgtgggtgagaggaattgtttacggacactccaggttgtagccgaactgggccggtacaggtgaccaggtgacttcaactccatcccctcaaatgggtaggtgtggggaggggaatgagaccaggtaacacaaaacacttaaaaagtacagaaaaactggaaaacacaaacacagatgacttgtccaaagtgcatccttctcagcccagagggcagggcctgcaaacagagtcccaggtgcctggggcaagacctggcagccgccttcagggggcggctcagtacggctatcgcttataaaaagtaataaattaggctgggcccagtggctcacgcctgtaatcccagcactttgggaggcaaaggcaggcaaatcatgaggtcaggagttcgagaccagcctgaccaacatggtgaaaccccgtctgtactaaaaatacaaaaaattagct

SEQ ID NO: 91215 - DNA, 1027 bp, Homo sapiens
agaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaagatgagctccaacgtctggatttgtgaggggctgagaaaggaggaagggaagagtggggaggggagcggagtgaaatagacccatggctcaaagtcattgcaagtgggttttgaggactgcatagcagttcgctgttgagattcttcctgatgccatcgctggtaccagcctcctgctaccctctccctgcgagtactccatcatagccctgcctttaaaagcttcctccagacatctgggccctgagctatgttttttatttttatgtttttgagacaaggtctcgctctgtaacccaggttggagtacagtggcgcaatcacggcacattgcagcctcgacctcctgggcgccctgggctatgttaataaaataaataagcggcggggcgcggtggctcacgcctgtaatcccagcactttggaaggccaaggcgggcggatctcctgaggtcgggagttccaaaccaccctgaccaacatggagaaaccccgtctctactaaaaatacaaaattagccgggcgtggtggcgcatgcctgtaatcccagctgctcgggaggctgaggcaggagaatcgcttgaactcgggaggtggaggttgcggcgagccgagatagcgccattgc

SEQ ID NO: 91216 - DNA, 1050 bp, Homo sapiens
gctttgaaggatgaataggagtttgctagaaagagaaatcagaggaaacagcatatgcacaggctcagaggctggaagcacatagtctggtgcaaagtaggtccttgagaaaaccctggaggccgggtgcagtggctcattcctgcaaccccaacactgtgggaggctgaggcaggaggattgcttgatcccaggagtttgagaccagcctgggcaacatggcaaaatctacctctacaaaaaatattaaaatgttagccagacatggtggtgcacacctgtggtcccagctactcgggaggctgaggtaggagggtcacctgagcccaggagtttgagggtgcagtgagccgagataaaaccctgaggtctctgcgccaccccacccctcccacaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtaagtggcggctccatacttccctgcggctccctggcgactgctgcggcacatggagatctctctaggagtctcagtctctctctctccaccaagtggcccttcctgggccccgagaccccttaaactcggttcctcccgggccccttgaaagttttcccataggtcagcctcagcttagtcagaggtgtgtgcaatgggagtgtcactcctatcccattccattttgtggaaagttggaagccttccacaaaaattcctgctgggctgggcgcaatggctcacacctgtaatcccagcactttgggaggctgaggcgggcagatggatcacttgaggccaggagttcaagaccagcctggccaacatggtgaaaccccgtctctactaaaaataaaaaatacaaaacccggccaggcatggtggtgggcgcctgtaatcccagttactcaagaggctgaggcaggagaatcact

SEQ ID NO: 91217 - DNA, 1065 bp, Homo sapiens
gcctccacctccctcttgggcctcagggagggcactgtcgcgtgccaggtgctgtgctaagcaccgtgctcgttatgagttcatttggtccttttcaagccctttgtaaagtttgccctttacagctggggagactgaggcacagaaccgacagctgccctgtgcaaaggccagcagtgctggagtgagcctctggtgatgatgaggggcctgggctggcatcttcttgggggactccataggcgttaacagaaacaaaaaaatgaggggtgtgggtcagggttccccagcagagctgggcgagccaccctgggttcaggctgccctgagccaggtcagctctgccctcttgtggcaaccggagatattgtacccagaaccctctctcctcagccagaccctgcctcccaccggacaggcccactgtgggctcagcacccacacaactgcacaagcccacctttcctgttccttctcaggtggctcacccagaaaggcgcccggcagaagaaaatcaacgagtggctggggattaaaaatgagactgaggagtgagtgaccgtctggagggaggcagggagggcttcccagaggagggggccatttggggtgggtttcgaagaatgagtaggagttcaccagggaggaaaagttgtccaggcagctggggagcctcggaggctggcaggtgagtgaccagggccctccccgccaccgccccccaccccagccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtgtgagtggaccgcagcggtggggattcccgcgtccctcccagagctctcattgaatgcctgccgcgtgccaggccttgggaaggagtccctggtggggtcatccgggacaggggagcacgcggccctggaacggggaaagcttggcggggaggccagccttccg

SEQ ID NO: 91218 - DNA, 1323 bp, Homo sapiens
caaggtctccaggtgaagtgacaagaaatgagcatgggccaaggccggaggcggtggctcatgcctgtaatcccaacactttggaagtctgaggcaggcagatcacgaggtcaggagttcgagaccattctggcctacatggagaaaccctgtctctactaaaaatacaaaaattagctgggtgtggtggcatgtgcctataatcccagctactcaggaggctgaggcaggacaattgcttgaaccagggagtcgggtgttgcagtgagccgagatcgtgccgcagcacaccagcctagcgacagtgagactccatctcaaaaaaaaaaaaaaaagtctcaaagtcaagattccacctggcaagttctggaaggcgtgcaagatgaattgcgtatcacagccccctttctacaagactaccaagtggggttgagagaagtggggaactgcccagggctacacctgcctcccacgccttcctaatccacagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggtgtgtgggcgctggggaaactgaggcacgtgggcaggggagcaggggacccagcctaccagcaggctctcaccctgctgccttgcaggaacaaaatgtcagtggcaggtgggagttcaagtgccagcatggagaagaggagtgcaaattcaacaaggtggaggtgagcggccccagggccccacactggggtgggggaaaactgtcccacgtacaggaggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccaggcctgcgtgttggatgaacttgacatggagctagccttcctgaccattgtctgcatggaagagtttgaggacatggagagaagtctgccactagtgagtgacgcccctcactccacccaaggagggggacatgggtggtaaccttccctgcatccaggcagacccaaattcaagtcctagccctgaccactgctgtctgtgcagcccaggaaaacaactacccttctttattttatttatttttttattttttcttgagacagagtct

SEQ ID NO: 91219 - DNA, 1201 bp, Homo sapiens
tgctctccagccaccacacgagtatgtgccctgggtcaccgtcaatggggtaagaatctttttagccctcagcttgacactcatagtcccatggagtcagggatggacaagacagagggaccagagataaaggaacccaggcggaggttgcagtgagctgagatcatgccactgcactccagcctgggcaacaagagcaaaacttgatagctttgcatagggaaagagggcattgatgctggggttttgaaaggtgagtaggagtccatcaggcaaaaaaagtatgtattaattcgaagtattaaacatccctagccacccccattgggaaagatgtgccactgatttgcgaggcgggaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccaggtaagctgggaggggagcagtgggattcaggtggtgggggtagggtctccttccaggaccccaactcatggccttcacctccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaattttaaaaaagtgactggttgtggccgggtgaggtggctcacgtctataattcctgcactttgggaggtcaaggtaggaggatt

SEQ ID NO: 91220 - DNA, 1007 bp, Homo sapiens
gacttgctctgttttgtctctacaccagctaccctaattctctgtccatcccatctgaaagtccctgtccctctgcccggggtgggcggcgtgggctctcaggggcccaaccccgccccctccatcgtcagcccatcttgtcgtctcaacagtacttcctggcctctaacactctcatttcttggtttgcttcccaggccttggctgcctggagggtcagacagtgggtgagagctgccaggagctgcgggagaagttctgggaattctacaaggtgggagcacccgccccttgcacatgtccggccccgccccctgatggccgctccgcccccgcccagctctggccccgcccctcatcccccgcctctccccgcaggcagactggtgcgtgtggcctgctgcgcagttcgtgaacttcctcttcgtgcccccccaatttcgagtcacctacatcaacggcctgacgctgggctgggacacgtacctgtcctacttgaagtaccgggtgagtgtggagggcataccaggcacccaggggactccccagggggctacacgtgtgagctccaagtggcagtgtagccagccaccctggagggtgggagtctcctgtgctcctgacaacccacacccaacagtgggctggcggagagctcctcactagcagttaagacccagccgtggctgagcgccgtggctcatgcctgtaatcccagcactttgggaggccgaagcgggtggatcgcctgaaattggagttagagagcagactgggcaatatggtgaaaccccttctctactaaaaatacaaaaaattactggtacgcacctgtaattccagttacttgagaggctgaggcaggagaattgcttgaacccaggaggcagaggctgcagtgagccaagatcatgccactgcactccagcctaggtgacagagcgagactccgtttcaaaaaaaaaagacccatgccgggcgcggtggctcacgcctgtaatcccagc

SEQ ID NO: 91221 - DNA, 1067 bp, Homo sapiens
gcactttgagaggctgagatgggtggatcgcttgagctcaggagtttgagaccagcctgggcaacaccccgtctctacaaaaatacaaaaattagccaggcatggtggcgcatgcctatagttccagttactcgggaggctgggctgggaggatcatttgagcctgggaggcagaggttgcagtgagccaagatcttgccactgcactccagccagggtcacagcgtgagaccctaactcattaaaaaaaaaaaaatcggagagggcctccatttttgcaattctcatttagcttcatttatgaagtgccgactggatgccaaacttgaagaaatggcaagagtcacatgcctgtgccttaaccatttcttcaggtctcaggcctcagtttccccacctgtaagatgaatgtgtccatggcaccaagcctgtctgtggaggtgccaggtctaggtgtggctgggccccgccagtgccctcccaagcctcgatctctgtaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggttggcaggggactgggctgaaccggtagacactgggaggaagtaaaaggaggggctgagccaaccccacgagccctggtttggccctggctggctagccagggagtgtgcctgaagggtgctgtctgggccgagttagacctgggatccattctctctgggcttcagggagagggacatgcacttctggggtttggaaacatctgttctaggtgacatgcgggaccctggaggggcttccagtctgggggacacgtacattcagccctgtggggttagggttggggttggaggaggccagaagggttaagggaggcattctagagaatgagttatttgaaaagggttttgaaggatgagcagttgttgggaagcggcattcca

SEQ ID NO: 91222 - DNA, 1020 bp, Homo sapiens
ctggaggctggattggttctagggtttgctgtgactcaacgaatgccttccgccccacccaccccacaggtgggtttcattgactacaatgcccacccactgtgggagactctgtctgacaagtcccaggcgcacagatttgatcacctccccactacaccctgtcacacatgtggaattcatggccaacccagatgacctcccaaaaggggcccctgactgagcccctcttttgagcagagtttgcagtgaatgcagttgcatccttccatttcacagatgagtatgctgaggcccagagggctgagtctgagccagagtggcatctgggagttgggagtgagggttggggtgggcagggtcctcgcgcctgtcaccttcccttgcctgcccccaggtgctggccacagacatgtccaaacacatgaacctcctggccgacctcaagaccatggtggagaccaagaaggtgacaagcctcggtgtcctcctcctggacaactattccgaccgaatccaggtgtgtagctggatgggcactggggcttcctttttaaattttggttttactttatttatttatttatgtatttatttatttattgagacggagtctcactctgtcgcccaggctggagtgcagtggcgccatcttggctcagtgcaagctctgcctcccaggttcacgccattctcctgcctcagcctcccgagtagctgggattacaggtgcccggcaccgcgcccagctaattttttttgtatttttagtagagacggggtttcaccatggtctcaatctccatgagattgagatccgcccacctcggcctcccaaagtgctgggattacaggcgtgagccaccgcgcccggccggttttactttaaaaacaactttagcagccgggcgcagtggctcacgcctataatcccagcactttgggaggccgaggcaggcagatcatgaggtcaggagttcaagaccagtctggccaagatggtgaaaccccatctctact

SEQ ID NO: 91223 - DNA, 1034 bp, Homo sapiens
tcctgtagggtcagggatggaccaccaaataacacagagtggaggagttcaggagagcacagagggcatctcagaggagcaggtgcttgaggcatagataggagttcagaagagaggggtaggaacagcgtgtgctgcagccccaaggccaaggccctgagccagggtctgtgatggaccaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggtactgcgccatgactgcaggcaggtgggcgggtgcagggcccagagaacccgcccctcaccgcctgtgccctctgcctgctcaggctgtgttcacagacttggaaatcctggctgccctctttgcaagcgccatccacgacgtggaccatcctggggtctccaaccagtttctgattaacaccagtaagtaggagtgggaagtgggtgcaggagaagaggtggaccctgcctccaccctgtccaccaggtgatctcagggggttcccatctgccctgagcccagtctccctgtctatgaaatgactatgacagttttccctcccttcagggtcttggagcaggtctgggtacacagtaggtgccaacaaatgacagaataatgagctgtggcagagctgatctggttccaccaagacctttatttatttatttttaaagacagtgtcttgctctgtcacccaggctggagtgcagtggcgcgatttcggctcactgcaacctctacctcccaggttcaagcgattgtctagcctcagcctcccgagtagctgggattacaggcacacactaccatgcctggctaatttttgtatttttcgtagagacagggtttcgctctgttacccaggctggtctcaaactcctggcctcaagcgatctgtctgcctcagcctcccaaagtgct

SEQ ID NO: 91224 - DNA, 1030 bp, Homo sapiens
gggcgggggcggggccggcagagacaaggtgggcggaaagcgggctgcaaattgaggctggggctccggcgcctccaggtgggtttgaggggcggggcctggtggacttgggggcggggcgagatgggcggagcagccacgcctgaggctgctgtaccgcaggcagggacccgtcggaaacccttcatccagcaatcagctccctcctgcaggtaaagtacctgttccttccctcccccgctgaggacagctgggagcttcctttccatagtgacctccccagtccatgagccccttatactggggctaattgtagccccgcccctgcaaaaacaataacgccctcggggatggaccccaccacactcatattacagatgaggaggctgaggcccagagatctcatggtcacacaggcactcggggaacagatctggaacttgggtccaggagtcctgggtggcccccgtgggaacagtttcagggtccagatgaagagacgaagtcgcgagaggcgtggggtccctgagcgggggggttgggcaggcccctgactgcctcggctcccagaggacacggggcagaagctggcattggagacgctagacgagctggactggtgcctggatcagttggagacgctgcagacccggcactcggtgggggagatggcctccaacaaggtgaggtggggcagatcgctgagctcacctgcctcggcccacggtgccccatcatcacggtcttcaccttctctccgccccagttcaagcggatcctgaaccgggagttgacccacctgtccgaaaccagccgctccgggaaccaggtgtccgagtacatctcccggaccttcctgggtgagctttgttgagtcactgcctggacgacattttaggagtactaagaaacaaaagaaagattcctatgatagacctcagtctgggggagatacagccagacacagacaccttcagcccccatgagtcagggctggatcagagggaggaacaaggggaacttccaggag

SEQ ID NO: 91225 - DNA, 1432 bp, Homo sapiens
attgcttgaacccaggaagcggaggtttcagtgagccgagattgtgccattgcactccagcctgggcaacaggagcaaaactctgttctcaaaaaataataataatatgtaaataaaataaaataaaataaataaaggcaccagagactactgggcacctctacaggagatgcagtaatgcagggatggagtcagggtaggggtgcttctgtccaaacctctttcagcttttgtcccttacccagcggggcttggagagcctcccagggcctggtaggagccaggctgtgaatgctgagtcctggctctgtggccaccccttgctgtgactctttctccatccgaacagctattaattaacaccttcctgttagaactgttaataaaatatttaaaattaaatatatggatgaaacattaatagtaaacctattgataaaatattaatgtgagactcgcccctgggactacagaggggatgaaatgagttaacgcatccagtgcgggaggacccaggctgggaagaacactacctgtccgggttcaaatgaccccagtcttgcaccttatggctgtgtgtccttaggcaaatgactgtgcctttctgtgcctcagtagccccatcctcgaaatgggaatagtagtccacactttgtaggtttcgtctgaaaatccaatgacttttcccttcactgctgttggctgagtgctgcatgtttttgaagcactcagtttacataattttgtttagtcttagcctcctattttatgtctgtgattttgggggaggggctgaatctctgtgcctcggtttctccttggggacatgtaactattgtcacttctctcacagtggcggggaggtggtgtcaagactgctgagaccttggctccagtgtccccacaaggccaatcctagcagcatgtgtcccctagggatggctataattaggtctggccccagcagacaacgatggtatttttgtcttggggacagcgaggtctggttcccgccaggtgtctggttgcaagactgcgggggttaggggggcttcctggccagatacctgaggctctctgtttttctgggctgtgtgactcctcctctgagcctctgttttctcatctgtagaatggggagactctcatgtatctggccttagcatggttgcctcaggatctcctgtgggatccctgatcaatgggcttctccaggactgccagaaacatgggtaccatgtctggggacaccaagactgaggcagccgccccggggggaaggcccaggctgagagacagaggtcattccacagcaaggggcacggtcaggcctcagttgctgggaggtcccctgggcctctgcctgtgacatggctgtttctaggtccctcctccttgtgtgacacatgctaagccttggtttccttttctg

SEQ ID NO: 91226 - DNA, 1067 bp, Homo sapiens
tgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggctctccgcctccttcttcccccgccggggcctggcgggctgggcggggcctggttcgcttcccccctacacccccgcctttctctcctccctctgtccctagctcctccccttgttggagggagcagagagcgggtgtctgagagcggcccgcacatctggcgcgcagcgagcgccccctagacgcgc

SEQ ID NO: 91227 - DNA, 1333 bp, Homo sapiens
gccctggggaggaatttgaggtatttgtttgtttgttttttgagaggagtctccctctgtcccccaggctggagtacagtggtgcgatctcagctcactgcaacctccacctaccaggttcacgcgattcttctgcctcagcctcccgagtagctggaattacaggcgtgcgccacgatgcccagctaattttgtatttttagtagacagggtttcaccatattggccaggatggtctccacctcttgatctcgtgattcgtccgcctcagcctcctaaagtgttgggattacaggcgtaagccactgtacccgggctgaatttgaggtgtgttaagggaacatccaggaggaggcgtggcgcagggtgaggagagatggaggattacaggggcctccagatcctaagcagggagggtggggggtggcttgagtccttggccagcccaggtggagcctgtgactgctctccctgcctcacttttcctaccattatgcatgctccagaagcagcaggggaggctttggggatgtggaggttgcccagggtcacagggacccctgttgtgccctccgtcagtgcccctctggcctccccacaccctctgtggctccctgctgtggccagtcttccccatcatcgcccctggctctcttctctcctgcagtccagccactcagcccttgtacatgtccctcatctgttctcacaatgcccaccccaggtgacaacatcctcccaagcccccttcaggagatggtggggctgacactaacaggggagggggtgtagggaaggtgagcaccctggcccctgagtgctgcacacaaactgtgtaaaaatagctgctccccctgccccctgtgaggaggcggctgtgacggtggtggctgcagtgacggggatgtgcccagagaagcatccggcagggccagttgccatggtgatgctgactcagcggcagaggcaggtagcagcatctggtacccggccggcacgcctctgcttggcctacgctcatagcaccctgtccagccccaactttccagcctccaccctgggggtgtcttctgaggctgcagaggggtgggtgagacctcgggaaggactggacaagttcctccaccagacaccactcagtcatctgctggaaggtgggagacgctgcttctcatggagcggacctcagtgtcaggtcttcctccctctatcagccatccgcccatctacctactcacccatccatccactcatccaccatccactcatcccccatccatccaccatccacccatccatctaccatctgcccatctaccatccatccacccac

SEQ ID NO: 91228 - DNA, 1061 bp, Homo sapiens
tgcgatctcagctcactgcaacctccccctatctcaactcactgcaacctccgcctcctgggttcaaacagttctcctgcctcaggctcccgagtagctgggactacaggcatgcaccaccatgcccagctaatttttatgattttagtagagatggggtttcaccatgttggtcaggatggtctcaatcttttgacctcgtgatctgcctgcctcggcctcccaaagtgctgggattacaggcgtgagccaccgcgcccggcccagtatcattttttaattgcacaaaggttggcgtcatgatagactgtctaactgccagcgaagtgtctagcggaggcagagcctgtcgcctgtaaggaaggccatttaggggtctgggaactgtgggctgaggcccggaggtggtggtccatctcagggcagagctacacctcctgaggggcccatggcgcagggctccagggctacagccaacctctagcctgtctctcttctagttggtggagctgaaaaatggggagacgtacaatggacacctggtgagctgcgacaactggatgaacattaacctgcgagaagtcatctgcacgtccagggtgggtgctgcacccaccaacgggggtgggatgcagggggtgcacactcagcctcctccctccctccctgggcctcatgggaggagtcagtgggggaggccgcctaggactgctcgtccttccaggggtcagtcaggagggacagggcagggtgagctaggccaccaagtctcccagtgtgccctggactttgaccctgtgggagactttcctgctgtgtgtctgttggtgccacccctgacctggaaggacctaggactggggactccctgtggctcaggctggggcagccccctccaggggaggcccaagactcccggactctgctgcctttagtccagcctggatgttgcctgcactctgcgggccatggtagtgtggccctgggatgtccgggatgcccaggtcacggtgggcaggagcagcgccagggcccggtgggtcaggagccaccagccagag

SEQ ID NO: 91229 - DNA, 1073 bp, Homo sapiens
tgagattacaggtgtgtgccactgcacccagctaattcttgtatttttagtagagatggggtgacaccatgttggctagactggtctcgaactcctgacctcaggtgatccgcccaccttggcctcccaaagtgctgggattacaggcctgagccatcaggcctagcctgatactctgttattcccattttacagatgaggaaactgagactcagagagattaagtggattgcccaaggtcacacaggcaggattgagtccaaggagcctgggatttaaccccagggaccatagaatcatgtcaccttccatagagatacagagagactttgaggcaagagggtggggaaggaaatgaggggctttgaactaaatcaacacacacccttgccatcctgcagaatgagtctggagaacgcctgtttgtttcaccccccagagagcgcattatccccatagctgtcatctggggccatgacactcccactctcctctcttccaggagctagaaaagctaggccttggcgacagcgtggacctgcatgtgtacgagattccggttgagtaccaaacagtccagagactcatccccgccctgtgggagaagcacagtccacaggtgagtggtgccaaggggcggcacttcctcatcaggacttacaggttggcacccttcatgtggaggacttaggtggctttggtcctgatcagatcacgtgaccaatgccatacagccttgtcctcaaaagggcttttcaggccgggcatggtggctcatgcctgtaatcccagcacgttgggaggccgaggcaggtggataacctatactcaggagttcgcaaccagcctgggcaacatggcaaaaccctgtctctactaaaaatacaaaaaattagccgggtgtgatggtgggcgcctgtagttccagctactcgggaggctgaggcaggagaatcgcttgaacccgggaggcggaggttgcggtgagccaagattgtgccactgtactccagcctgggcagcagagcaagacctgtctcaaaaaaaacaaaaaaacccaaagggctatccag

SEQ ID NO: 91230 - DNA, 1033 bp, Homo sapiens
cagagaatcgctggaacccaggaaggggaggttgcagtgagctgagatcgcgccactgcactccagcctgggcgacagagcaagactccatctcaacaaagaaacaaaaacactgcattggcattttaacacttgcatagcagctcattatttattgaactaactccgctggatggctagttaacttgtttgcagtatttgattttgataacaagaacagctgcagtgaacagcccttcatgtttcaaattcttgcctgtcttacatggcatacctttttccaagagtgactgcagggtctattctagcagcaagaggtcagaaacaacacaaccccaggcagagctcattaaggatgctgccttttccctggcctcagggggacccctctgagtcccacgggcaggccatgttaagtcctgcccctgtctgtgtgcagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcaggtagggccctgtggggtgggagtgagtggggatttccctcctccacccactgagcctggtgtagaacaagccaagcgtgttgaccttggcctctttggaccaagcactcagtgtatactaggcacagagccaagtatttgtacgtagcaggtgccgttggttctgctcctgggactcatggatctgcccacttctccccaccatcacggtccccaccaaggcccccagcatctcccacctggacactgccccagcctccatctcagtcttcctccctgctgcctccaccccaacccaagcagtcagtttctgtgttaatttcctggagctgctataacaaatacccacaaactgggtggtt

SEQ ID NO: 91231 - DNA, 1031 bp, Homo sapiens
atcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctttctttctttctttctttctttctttcttgctttctttctttcttgctttctttcttctctctctctctttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggccaggcgcagtggctcatgcctgtaatcccagcactttggaaggccagggtgggcggatcacctgagatcaggagttcaagatcagcctggccaacatggtgaaaccctgcctctactaaaaatacaaaaattagccgggcatggtgatgagtgcctgtagtcccagctactcgggaggctgaggctggagaatcgcttgaacttgggaggcagaggttgcagtgagctgagattgcacagctgcactccagcctgggtgacagagcgagactctgtctcaaaacaattggacttaagatggcatgt

SEQ ID NO: 91232 - DNA, 1091 bp, Homo sapiens
gattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggaggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttccctgtggtgtccaggata

SEQ ID NO: 91233 - DNA, 1004 bp, Homo sapiens
tggtgggtgcctgccctcgggggctcgcagcagatggcagtgactgtggagtgcaggggcagcagagtgggctgagggaggctggggtctgagtgggccacttgcaagaagaggggcatgtgtatatccttcagcactcaagtgttgccaggcaggttgagaagaggtccatgaatcacagccatggttggtgttgcctggcagctcgtgggtttctcccgggcttgattttgagccggcacatggatgtcggtggcttgttcatcagcctggcaggtaagccagggatgggattcacgattggacgtggtcattttggcccctggctggaaatggctatgaggggcaggtgtggagggtagtaaggagaggccgccactttgccaagaagctgccagaggcctggcctttagggttggcagaggggagggaggacggcgagggttggagggtcaggagtgagacctggtgacggatggcaaggtgacacaaagccatgagtggcaggtgtctcctgccccagcagcatctgtgtctaggaaggcgctgagcagggagcatccattgcagccattctgggtaattatggtaactcgcgtcattacggtggtagctgtggtacatttcaggccaccaggcgctagcaccccatcctggctctgcttccctgcacagcctcatgctcgctccaggtccaggcgccccatgtcctccgagtcttgtgttccttctgcagggagagctgcctgctgctcttccgggtgcctccctgttttcctttctggccacctgcctgtgtgacacagggagccctcataggtgacaggccctgagaggttgtaccggcccagggcaggtggccggtggggggcagagggcatgggtgatttgcatccagagcccttccctataactgagctcagggccccaaccggtggcgcccccagacctggcccccggagcagtcctctgggaggggaggaccttgtaggtcccaaaactcc

SEQ ID NO: 91234 - DNA, 1021 bp, Homo sapiens
ggtccagggactgcaggggatgtggggtggaggaccccttccctccttccttcctgggccggggaggctggggatgagtttggaggtgggccctgagcacactacatggcccagggtgcccagtggtcgtccccaccctgcacacacacaggaatgacactcctctatggaggagacctccccagcgctgaggcctctctggagtctcagtgttggcaggacatggccaggacttggtcctcgagggagcgtggaacacagccgaattcggcccggaattgggggtcacggatgcctgggaggggcctgcaggacatagatggataactatgagctgtccctgctgagcagctggtggggaggccacctttccacccgccctcctgagagatggaggggctttggggtgggcccttgccttggagagtctgagctccctgggccgcctcgcccccacaggttggcgctgtacgtttatgagtacctgctgcacatcggtgcccagaagtcagcccagaccttcctgtctgaggtaagccaccacctccaggctggccctccctcctcacccacactccgggggtccttcatttccactggggatccagggggtgggcccgcgttgcccctctgatggccctgggaactgagggctctgcagggtccaggccctgggctagcatccaggcatctggtccacatgcccagccgggacctgccacacatcctggggccctctgcccaccctgttacccttccctccccactccctccctgcccagatgttctctgggcaccctgctgggtggtggggcagggtcaggtagggccaccccctcaccaccttcctttccctgcagatccgatgggagaagaacatcacgctgggggagccccctgggttcctgcactcctggtggtggtacgggctgggctgctgtgggtgggctgtggaagggggttgagggaggcacgtggagcaaccatcttcccctttggcccacagcgtcttctgggacct

SEQ ID NO: 91235 - DNA, 1032 bp, Homo sapiens
ggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctctttttgccccaccccgcgaatccaggcctcacttgacacccggggaactgagtagcccaggcctctgtgagtccgagagtatgtacaaccaacttccctacaccctctccatcctccccacaccctcaccatccaacccacagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgaggtgggcgaacgcccgggtggagcgggtcaggcagggccagtcacagacacagctctgtgctgactgcccgccttgcccacagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaaggtgcgtgggcctagggagctgccgagtgcaggaagggggcctgggccgcgagcacctggcttgtggggccgcagggcctgcagctgctggggcttcccttgtacccacagaccatgtccat

SEQ ID NO: 91236 - DNA, 1067 bp, Homo sapiens
ccagcgcgggagaggcggggaagggggcggggcgggggaggggccgcagcgcttttctccggaggtcgcgcgcccgagagcccgcgctgtccgccgccgctgcctgagtcgactctgcgccggtgagtgcggttcggggcagggacggcctccgtggggacccaggctggcttggccccggccgcttagagtccccgctgaccccctgctcaccccgggcccccagcccgccgcgatggaggccgccgcccagttcttcgtcgagagcccggacgtggtctacggccccgaggccatcgaggcgcaatacgagtaccggacgacgcgcgtcagccgcgagggtggcgttctcaaggtggaccagggggctgaggaaggaggcgtgctggggagagcggggcggctcggggagaagggcacgggacccgggattcactgcgcggcctgtcttcaggtgcaccccacgtccacgcgcttcaccttccggaccgcccggcaggtgccccggctcggggtcatgcttgtcggctggggcgggaacaacggctccacactcaccgccgcggtgctggccaatcgactgcgtttgtcctggcccacgcgcagcggccgcaaggtgggggcgggaggggcgtggtgggtagggaggcttggtgggagtccttgcgggcgggggcgggagcctgcagggggcggggctctgcgggaccaggggggctgtagggggtggggttccgcggggcgaggggctgcaggggcgagggacctgcccgggtctggaggcctgtagtgggcgagggacctgcagggggcgaagctctgtggggcgggagggcttgcagggggcggggcctggctgcaggcggaccccgtggaagggtttcgcgaggtagcggggactcctcgggagtcttacaggggcggagcttaaggtgccggaggtctcaggggaggggcctgggggcagcggcttccgtcctggctgtgagcctggaactgaaaaatgcccgaaagtggggcggggcttgagagtctaggtggggcccaggccgggtcgcggccctttc

SEQ ID NO: 91237 - DNA, 1101 bp, Homo sapiens
ggtaaaccgaggcccaaacatctcagggcaaggatttcagcctgagggctgtttgtcctctctgagctttggttttctttctttttgaggagggtggggagactgggttcttgccattttgcccagacgctgggctgaacttgtgattctcccacattggcctctcaaatagatggaaactcggcaagtctcagttttcttaaaaaaaaaaaacaaaaaaacaaaaaaaccagaccaaccattgttcactgagctggtctctagcaccagcactgtcaccctgaagtctgtcccatcctgcccagtgtcctgcacgtggggttccccactctggtggcagagtggccattggaagtttggtttgtgccccagtgttgggccagccccctctggacagctagtgggcagagctgagggtaggagtgggggctcaggggagcgggtgcctgtttgagctgccaggtgacaggctgcatgtccctggaccctggcagggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggtgcgggctggggcgggacagggcaggggcgaggggcgtgccttgctgggtctgagtctgcctgacagctggctatccccacacaccccaggccctggatctcagtgtcccactcatggacgtgggggagacggccatggtcactgctgactccaagtactgctacggcccccaaggcaggtgagagtcagccacccttaggtctctgcaggtctcaggagggggatgggtggagtgggtgtacccctcggctcaccccatctacttgcccattttatagacaagaaactgaggctgggtgaggtggctcacacctgaaatcccagcactttgggaggttgaggtaggaggattgcttgagacctggagttccagaccagcctaagcaatatagaccgcatctctatacaaaaaaatttaaaaattagctgggtgtg

SEQ ID NO: 91238 - DNA, 1031 bp, Homo sapiens
aggtgttaggtgctttcccagccccgactcctgcgtcctggacccgcagtcctctgcttaatacctttgctttattagaaaacattctcctctactccgttcagctattcgctgagggcccgccaaccgccagcggttgtcagtggcctagaggcagcggacgcaaacacggggagaggtgcaatcgtctcaagtgactcggcgggcggggcccacaaccggaagcgggtgggcgaccttcacccacgtgcgctgcggcttcgttcgccagcatccaagatggcggcagggcggggcccaaggcgcggcgcgaattgtgacgcaggcgtccggcgtgctccgtgcgcaagcgctttcggcggcgattaggtggtttccggttccgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatt

SEQ ID NO: 91239 - DNA, 1009 bp, Homo sapiens
cccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtgaggccaccaccccttccccgccgtgtctctaggaccctggccggctcctctcatgacgcacccctggttggggggtggtcccagtatcccatacacagacctcaccccttcctgtcccaccccaatcctctattaaggcttcacttggggattctcggaccttgccctctgctgttcatccccaatttttttcccaagttttgtccttattcccagagcactcccgctttctcccagctccgcctaaatgctattccaagatgcccagatcccgccccaacaatgctccacccactctggttgttccgcgtctagggtcccaccctcaacctcccgtagatacaggcgaggggggtcccaggccacgcctcctccgtattattcctccatcacagctttagttctttgcctatttctctcttgcgatccgcctgct

SEQ ID NO: 91240 - DNA, 1095 bp, Homo sapiens
ttttttttttttttttttaagacaggctcttgctctcttgctctctcacccaggctagagtgcaatggcgcgatctcggctaacggcaacctccgcctcccagattcaagcgattctcctgcctcagcctcctgagtagctgggattacaggcataatttttgtattttgtattttttttagtagagacggggttgtgccatatgggcaaggctggtctcgaactcctggtctcaagcgatccgccctcttctgcttcccgaagtgctgggatttcaggcgtgagccaccgcgtccaggctttttggcctacttttatcctgggtccccgtccctgggaccatgaggcgcaacctaacccacccctacggccaatgcctggctaagacgtcactgttgttcccaggccacgcccacatcgcgctcagcactgcctctggcctgcctgctgtctcctttctgagagagcctctaaactgaatttcggactcttcctacacaaagcactgcccctcgtggttctacccgggcactgcctttctgggtgcctctgttttttcctgaacatccttggagggcagggggtgggttctgctcgtggagacatccttcgtgttgctcattcccccaccaggtggccctgctgcagttgatggagacgccagagctggcggggcaggaggacgctgtacggatgcagcagctgaaaatgaagtgagcgctgctgcccaagccgcctggctatgctcgatttgcaccagggttggcacggtcaggacgctgccagcagaggaaccctctgccagtgcacaatggtgttctcacctggtggccctcagatgtacacttccccagagggcacagccgtgaaacttcacatcagtttcgctgtgcattgctgggacactgctgtatacctcgacacatgccaatcctgcacacgtggctgtccgtggagcttggacatgccccactgagcacagaccttcagatgcctgtcctcagcccccaagcacacacactcatgtacacacacatttgacaaagtcacacttcataacctcctaatggtacacaccccaccaagatggccttt

SEQ ID NO: 91241 - DNA, 1052 bp, Homo sapiens
ttgtgccctcttgtgtgcctggaacatgaatgacacagaaggaggaagtgtcccagagacgtggctgagagggaggaagggagggatgggggtgtgcaaaagcttattgctctctgaggcttgcagtctggcaggtaggaattcccttctatgggatcaggtcgatcttttgcctttccagtgaggcttgtggggctgctggggggcagtgggggctggccttagtctctagctgcctttctagcctgccaggcaacgcccgcatctgcctttttgtcccacgaaggttttgtcttttggccaggggcgggggcagttcctgtcttccccctggcccttccagcggtaccacaactcaagaaactgtccccaggagggactgcgctcccccacccccgaccgcccccaacgttatataacttgtttgttccaacttctgtcttctgcaaccgagggggaaaaaagaaagagaaaagcttattctccttccttcctatctcgagggatcaacaaaaaacccgttgcctagtagaggtggtcattaatgactgagccgaacctcagggatggacagagtggggctgccctggctggggtgtgcggagaggaggtggggtccttgctgcaagcacaaaggacacttgttcaccagctggcctcctcccagctcgggccgcggggtctagactccttggagggaaaggaggcttgggccacttggggtgtcgcaaggggaggcaaaccctctggggagtcgcacctccccagctaaaattctgtcactgtgaggtacctgaccggcagagttttggaggaaccttctggccttgcagcctctccgacatgggcctttggcatccacgctttttggcccacgctccctggagacgcctgggtagggcccaggctcactgagtcatgctgttcctgggggtgaggtggggggatctgggtgagggatgtgccagcttcaggcatttgcataagaagtggtggctaggctgggtgctttggctcactcctgtaatcccagcactttgggagcccaaggc

SEQ ID NO: 91242 - DNA, 1048 bp, Homo sapiens
tccctgtccagctgtctgaagtggaagtgggggccaagcccgctgggttcccgctgccggcagccccgccctcctcctctggtagccgctctgcagctgtgcggaccagctctcttaacacttgttaaccccagcctccagtcccttcctgccccccaccccgccccttccacatgtctctccggagagggccgcacagaattcacaggactcgtctccaacggctgcgccagcaattccctagcattcctcctctgcagagtggattttggtgcatgtccagcgtgatttcagacccctcactgcgcagcggagtgcctgatcgctctgtgtgcaccaccacggtgcacactgaaaatattgtgatctgggaggaagtaaccagcaccttgggggaatcacagacctttcctgcgagggcaagggcttccggaattgaacaggctgggcctggaggagatcttgaggggtggaccttcaggcttgtaaaggcctggaggggggtcacccgaggatcgaggccgaagatgtttactgacgccacaactgtgaaattccacaggggtcaaagacggacccgggcgggagcggtctgggctggatatccggagagttctgctctccacgggatgttagaatttgaggcagtctgcctaaggaggcagagcagagaggcatgtgatcacccagatcgtctgagagcgggacattttcccggagcggggtggaaggagtgtcaaggtgactgtgagatgacagacacgtaggggagccccacagaggacccccaagacaccctctctgttgccatcagcctgagtcatcctctatctgaaaaacttccaggactgaagttcgagttggaagcacgcgttctccttggtgaagtccgtcctgtcccaggagggctgcgctaggtctctcctctggctccccctcctcgggtcctcgtggctctctgtcgtgtgaagcggggggtcaggagcgcacaaatgtttatactccacgtgagtcacttgcacagatgacgggtgatgttttcctcgcc

SEQ ID NO: 91243 - DNA, 1012 bp, Homo sapiens
cgggggttcgagggccccacgaaagaacagcgtggggagggaaggagcctccacagggtgtgtcagtagtgagcaggtggtcccagggcaacccttggagatctcgggaatcccataacaggtggtccacctgggggagtttaccccacccaggctccctggatgttagccctagcacatccctgcactgggacatctgagaggagcaggggtggtgttgccagggcagacctgggcgtgtccttgggtccagcacaggcctgggcctggctagggtgcccgatgacattgctggggggatacagcggcaagcgggtgtcagaatggcccctagcccgggccaggcctgtagcgggggcgtgtggccactcagaggccagattcgggcagagggtgcagccagggcgggcagcaatggcctcttgagacggccctggccggggctgctgacgcattggctccgatgactcacgtgcgggtgaccgtcactcgagtggccgtctggagactcggaccggctcagggccaccgccttcctgggggcctgtggccccgccgtgccggccgccccctgtctggaccagcctgagtaatgggtccttcccctcctcccagtggccggctggagaggaccttagtcatcagccctggccccggccctccctcctccgcctgcccacctccgcccaggctgcgtctcgcttctccgtccaggctgggggactcctgcccctcctggcctcctccctccttgagttccccaggaggggctgcagtggggtgggtttggcttcacaggggcggcagtgagggtgacgtcaggggcctcagggacagttgtcccatccctaagatgagaggaaggaaacagccatgtggaacgcgtcaggcatcaccagggcatgaggaggaggcctggggaggacaagctgcttcctcccctctttggtccagcgtgggccctgtgccctgtaaccagcagtggatgggcctcaccctgctttctgggcct

SEQ ID NO: 91244 - DNA, 1101 bp, Homo sapiens
tgaccacagcccctgccctctcaggaccagggtggagggccaggtctgcctcaggtggctgggcgcatttggtgtgcaggggcaggccaggttctgccaggctcctgtctggcagagcagataccctgcaaatctcacctgggaagttgctgtgggccaggagcaggggcttggggctggtgtctgagcacggcaaggcacccgagttcctcaggcctcagtttcttgtcaggcattctagcaagaccttcctcttggggcagggtggtgagcacactctgcaaaggtgatgctgaatctccactttgttcttgcagtgtggtgagacctctctcctgcatcctggggccttggggagggtttgggtgggctttgcagatgctcgtatccctggtttccagattcagccactgatgtgactggctcaggtagacttaacctcagtctctgattccttaggtagcactttcagtctgtgttactttgtaactagttgtttgtttctctgagagattgtgaccttatagactaggatttgtgtcttcatttctgtgttggtaatgattgggagctcactgtcacccaggtactgctttaggcatgctcggtgagtgtgccacatctgtcctcccagctccaagcagctacattcttgctcaggatgtagagaaagagatggctggtgaatgaatgaatgaaaaaaaaataagaaaatggccaggtgtggtggctcatgcctgtaatcccagcactttggaaggctgaggcagtggatcacctgaggttaggagttcgagaccagcctggccaacgtggtgaaaccctgtctgtactaaaaatataaaaattagccggacgtggtggtagctacctgtaatcccagctactggggaggttgaggtgggagaatcacttgaacctgggaggtggaggttgcagtgagccgagatcatgttactgtactccagcctgggtgacaagagtgaaactccatttcaaaaaaagaaaataagaagaaagtgtgcaacttgagcatccttccacgtgagtgtcccccacatatcagggcttctgaggcaggagtggccacttctttttgtc

SEQ ID NO: 91245 - DNA, 1161 bp, Homo sapiens
tagagactccagctctggggcctcgtgtatgactaggaagtgggaattctaggatacgtctttaaatactgtgtccagagcagaggtgatgggaggagctgctttttttgggggccgggggggggtttgggtttttcttttttctttttttttttgagatggagttttgctcttgttgcccaaggtggagcgtgcagtggcacggtctcagctcactgcaacctgcgcctcctgggttcaagcaattctcctgtctcagcctcccaagtagctgagattacaggcacgtgccaccacgtccagctaattttttttttttttgcctttttagtaaaaacgaggtttcaccatgttggccaggctggtctcgaactcctgacctcaggtgatccgccctgccgaggagctgcttcttggtgaatgcctgggatgggtacagggaggccttgcccctccagagcctccctggtgaggggataagttgacagcctcaaaggactttattggagtggcagctctgtgccagctgaagatgatgaccctcttgtccttcacccatcatgtcccctggcgtgggctgtggaacttctctgtgccaggcactgtcccctactgctgttttacctcatttcatgatagttcctagggtcaaatatatttttgaaattaatgttttatcttgaaacttttcagagagtgaagggagaagttaacccagaagtcagcttgtgttgtgaccagatcactgcagggcagcattgggcccagtgtgcatctgtgcgtgcaggtagcacgtgcccatgcaccccagccaggcgggctggaggggcctctgtggggtgctgctccccatgagcacctgtccctaggctcgcacaggtgctgcatcacacagcaagggcattaggccgaggggctgtctggggtgctgggactggcagtgggagatttggtgccgtccctaggggagctcccatcactcctccctggcccttaattttgtgccaccttgtgttctgccatgacacagtgctcccgctgcctgaccccgtggtggggttaggtggcctatgggggccatgccagggactgttggccatgtcatttgaggtgctggtacttgggagtggcatgaggagccccagtggctgtgtggtctcc

SEQ ID NO: 91246 - DNA, 1016 bp, Homo sapiens
catttccacatctgcatgggtggcagcttcgtagtgtttgatgagccttacactgtggtgggtctggcatcatgaagctgtcctcagggcacactgctgtcagtctgtaaaagtcaccctgctccttgtggtcctcagtcatgggaaagaagcatcttcctaagcatcctggttgtgggcatggacatggctctgtggctaggcgggggttagaccagctgtgtgggggaccggggggtgtagaaggccaccagtggcccttttttggccaggtaggtttgctagagaagagtgaaatccagtcagaacaagggaaactgtctcaaagcagagatgaggccagggtgtcacaccagagtcatcgaggctggttcttctgcactgagtcctggaagctgcagcctcactcaggtgacactgcgttctgctgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcaggtgagctgagctcagctgggcctgggcatgtgctggacaggtgggtgcctctggcatgggcctgggacactcacctcccaggtacagggtggcgcccttgtgctgtgactctgggtggcggtgtcctcgggagtaaggaaattgctcaggccatgtgcacagccaaggcctgttaccggtcaggaggtgggctcagcaacctccgacaccctgaattcaccagctggtgggaaaagttttccttcctttggcctcctcagaccctgggggcattgcctggtacctgcgcactcactcatagaaagaatttgtcatggcattgggtgagcatctggggtgggagggtgagtggagcagctgagataccctcacaaagcagttgctgcagggttctggggcatccctgcctcccgctgccttggccgtgcctggagaattggatg

SEQ ID NO: 91247 - DNA, 1361 bp, Homo sapiens
gattttcagaaaaccacagccagtggtggggtgaggctctcccgaggctcctcgcttgggcttcggggcctgagcttcagggcgctgctgctgcagggtctgtgcccagctccctgggagcacagtgccctctgctggagcccagagttcaccatgaccactgggtctgaggctggattcctgaatttcaggccaaagaacggggactagaatggccctggaggagtgaggcctccttccagcaggactctccttggaggtggctttgctccttatcccctcggagcttctgccacataccccttccctgcattcttggatttgagaagccctggttaactggtttgatttggttactgggattgttggggttgagtatgtgtttaatgaagaacttaaaaatgttgtcagaggaaagaatttcacatcttgccaaatgaaaaccagagagcaagcttccagctgtaactgtcgctgttttgattttttagttactgtggaatacacgatcctgcctgcgtggtttactgtaataccagcaagaagtggttctgcaacggacgtggaaatacttctggcaggtagataatcagaccatgcatgtgtgtttaatcagtgctgtgctcagatttgtgtgtaaattatggaaatgttgaagcaaagcgtaatataaaatcacgctaacaaacctgggttttttcctcctctgtgactggtttaacttgaaacagatggtggtgtgtgaatgccttaatgtatttacccttgatttattctctgtggctctttttattatgcaagtagggttggcttaattctccttcccagtttttatttcgatttttctgcaagatgagctcttggcacacccgctgatcttcattaacgggaggatgttcccaaggcagtaacgggcatccaggggcgctggttcctgagcaagcttgctctggcctgagctcatcggagctgtccggaggctaattcaggccagatcctgaatcatcggcttcaattaagttcacttgaccgtcggcgctgggcttgccttcctgatgttgatcagctgcagctggactgtgtcgcttgttctgtgtttgggacaggacagtgttctcccagtgcccaaattccaaggggggagttcgatggtcttgcccgagtggtgggactctcgtcctggtgggtcccgtgctagcggctccccttcccctccaggttgctgtgtacaggtcactccactgctggagaggatggagcagagcctgggaggcagagctccgaggtgctagcaaggaagtgtggggtctttttctgaggttcacgttctggagaaagaaaatgaccaaagcccggaggca

SEQ ID NO: 91248 - DNA, 2917 bp, Homo sapiens
ccttgtgggaaatgtctctgaccccacagcagccctgggccaacaatgggttaaattaggcctgataagttggatttaagaaagcaggatttttaaaaaaggcaggaactatgtgaaccgtgttaaggaagttttccttaaagtggttcaagttgggattgatttttgtgctcagtggggagctagtttgggggagggctggcccccagagatgccagatggatgaggtgtgactgcctctgctaatggaccgtgaacggtaccggaacttttaacaggggcccgaaaattggaagtggtgaaaagccaaattttgggtgttaaccgtttatcatttcctggtttcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggtgagtggtccccagatgtctcctgggggtgacctttaagctccagccgtctcctcacaagccttggcccagcccagcccagccgtggctctaactccagggagttgtcctccaaagatggtttttgctgaagggtgaggcatgagagcgtttaggcgctgaggcttgttaaggagtcggcagtgccgtgtaactcttttggggcgttctggctaagtcataaaaacaattctgtaaaaacaaagtctgttctgagttttaagagttcagagctcaagtgcacagggagatgcgatttattactaacagtttgaaggtaatgtgatcacataataaaatgcagggcatgcccctttgggtgaaaggtcagcatgggagggggccctccctgctccggggcttcagggacgggagctggtcctcacggccccctcccgctctgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggtggggctgcccagcgggccgacccgtgccttcgtgtggtttctggttgcggggaggggagtgtcttcagagacggcttgacccagtgagaccgctggagattctctgaaaggaattcaggcagacctctgccacctctacgtggaatgacctcagggcaccttggtcaccttccatccaggcagccttacctgaccgagaagatcctggccttggggaaaggaaagctctggctgctggaatttttcttgtcttgccggggtgaggatgggtggtgggaggggaagaatggggctggctgtgggcagacttgtcctgcagagcctgaacctgcccagacaggtgggctgcgagaatgtcctggggaaataggttggtgtcgaggtcggcacagtcagctgagacagaggggagaggagagggtgccgggtcaagtagtgggtgcctggccctccttccacagacagccctcacttttccccacggaagcctttctgtgcttccagctgtttaggattttgtgataaagtagttctaataactaggctagaagttttcatttgcctcccattcagtcagaaatctcacataggaaatgaagtgcaagttaaaatatttttttaagcattgttcagccgggtacctttccacttggattttccggttgccagatgatttcatgattcccgtttatatctgaacagcccagaaaatgtcctgtccccaccagcatggcactcactgagggagctggcccccaggggaagagctgcgggcccatgttggtctggctcagggttagcagacgtgggagacaggcctcccgggctgtggacacagcgagagaaaccggtggtctttgtggcagcctgcgaggcgggttagctgctctcgttcacaagctgggcatacttggaggaagcagctggctctgaaggtgccctctgctgtggacagtgtgtcaggctggtgcctggggctttgtaggcaggttcacccaagtaccggaaccccgctggggtgcggagcagcagctgaggcccaggcatgggccaggccggtgtgcagctccctgtgtggcatggagttcccgttcccagggttctccttgcaggtggggctgcgccagaacccctccatgccacccaccgtggcccattctgagaagcggcatgtgtgctccatccctctggtgcctctgcgccctcgttcatttgcatgtagggaaaaacaggacgagtgtggcgcggtgttgttgtcttctaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccaggtgatgtgtgcgagagggcttggcctggggtgggctctggctctcacagctctctcctcaggcttccagagggaggttttctctccaggctgtgggagctgatgtgggctgcagccgcgacacctgagagttggaacttgcggatccgggcctggcagcccggtggtctgagcccccgccctcagatctgacatcagcctcagtgttttctgtttaaatccaacacatctttcccagtggggtccacagctttgcccacagttgcgagagttagactcgggcgtgatccctgtgaagaccacatttaggcaacgggagccctggagcgctgacctcccctccctccc

SEQ ID NO: 91249 - DNA, 1049 bp, Homo sapiens
ctggtgtgcggtgaagcctccagacgggattggcctgtgtgtgttccggggactcctaatggcttctctttcagatgtgcccttggtggcatttggggctgcaggtgccactcacggcgcctgctctcacggcagaggcttgctgtagggcccgcctcatggggcctcgggcatgtggaggccaggcccgggcctgtgctggaggctaaccggggctcttgtttttcatgtgctcagactcaagataacatcactgtcaggtgggacctgggccttaacaagaagagaatcgcctacttcactttgcccaagactgactctggtaatgaggatttagtcataatttggttaagaggtgattttaagttttaaaatatttgtgaccataagtagcataaattcctagttccacccttgtaaagtgccccttaatttgaactctccctggtggaagcgacggcgtgggttaaaatggccacctctctcacttttttacctcaagacatgcggctcatgcagggggatgagatatgcctgcggtacaaaggggaccttgcgcccctgtggaaagggatcggccacgtcatcaaggtccctgatagtatccttcatgtgaagagggtgtggccggctggtgggagaggaaagtgggggcatcaggtggaggccactgtggatttgatgctcactgctgggccagcatctcatgctctgtggtgggtgctggttggcatcgccctccactgctcttaggagaatcacagggccttcaccttcaggggacagctggttgtatggttgcttcccctctgcccgaatggtgatgttggtgatgccacttgtgtggcgcgtccctgggctgactctggaagttaatgtatgccgcttgtgtggcacgtccctggactgactctggaggttaatgtggctgcaggagcgccttacctggacgctgactctgcacacggaggttccagaagccagtggtcacatgcagaccctctgagcacacacttgctcccaggccatgtttgggaatgtgcagtgac

SEQ ID NO: 91250 - DNA, 1318 bp, Homo sapiens
tttgcttgtgtatgtggagccttttgcttggccgtactgggaggggtgttgtttctgtggaactgtgagaagagctgctgtggccaaagctgggttctgcgagctctgcctgcccctgctggccacatgtgcaggagctcccggtgaggtcctggggcccaggatgtggctgctccctgctggtgagcgctgctggcttcgctgccgccctctgcgtctctgaaaggggcctagatgggtggctgggagtggcaaggaggaactccaggctggctgggggtgggacaccggctcatggtgaggtagagtctttcttcaaggatgctgtccttctggtctctggtctggtgttggctgcacgtttttagcgtttggtgcagagccagcggtgtcttaagtaactaaattttaaaaacgctgtttaaagagcgtgtaccaagggtggcccagaaaggtcagcccggcttttgacaaggatgcaaacttaactcagcacacagattatggcgatgagatcgccattgagctgcggagcagcgtgggtgcacctgtggaggtgactcacaacttccaggtggattttgtgtggaagtcgacctcctttgacaggtacgtcttctcccatcactgccccctgttccctggttgccacctgtggcatctttatgagccctccccgtcactgtggagtggggttccccacccagctctgcaaactcaggatgtcggagaggcggccacagctgtgcgtgtcgccaaccccaaaccctcctcacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtgcgcgccgtcctcagcgcgcggggcctcgcccatgggccgggacgcaagcggaggctgcccctaacggccgcttgtattgaaggtttatgccgtgaagactgtgctgcaaagaccactgagcctgatccagggcccgccaggcacggggaagacggtgacgtcggccaccatcgtctaccacctggcccggcaaggcaacgggtagggctgacacggcccttgcgggcaagacccgggagggctttagggtggccagatggaaggcctggtgctgggagccttgggctctgtcacaccgaagagagcacgtggcgggtagtgtcgccatggtgcctaccgctctctatgtgacattattcgtgtcagctccaacctta

SEQ ID NO: 91251 - DNA, 1600 bp, Homo sapiens
ggcttaccagcatggcggggtgacggggctgtcccagtattaaaaggcaagcccccctggagcaggcctggccccaccccagcctcaaggagaaggatgggagggggctctccccagggagctgcactggaggggtggtatctggaaatgtgtgctgtgcctggtgggggtcataggccctcagggccagcttggcctgtgcccttcactgctagtcagggtggctcctcaccccaccctaccccatcctgtctgctccggggaccaccgcgggacctcagtttcctcatcagagtcggggagggcagctcgggctctccctcactgtcctgtgtgctgggtacctgtggggctcaggtcgcagcctctcaccgcctcctgcccttctccctcctgacaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggt

SEQ ID NO: 91252 - DNA, 1994 bp, Homo sapiens
ctggccgggtaaaaggagccagggggtgtgaaacggccagagaagaagcgggaaagagggccaggcggccgcgtggggctcccaggctaacctgcgccggttctgacccccaggaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccagttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgagtggggctttcgctggggacactggtcctggaggccagacctcgcagggcgagcctcgagagtggcccggggatgcccgagcagctccgagggtccccacccgccctgtccaggctactagcaacttcggccaccgcacctcaccctttcctcgtcatctgctgcacgccggggacacatgtcagggggttcccaagaccagtccttctgcttgatgctgaagccctgtccccaccccatgcccacccccacctcttgacactaatgccttcctgcagatgccatccccacaccctagcatggcttccccaggggcccaggttctggctcatgtctcccacttcggccacccctcctcctatgccccccgccgagggcagcccaccccccccgccgcaccccgcagggcgccttccttggaactcatgccctgcccccactccatcagcccaccccgccgcttcacacccttcccacagacggtgcgccccgagccccagcgttcaccttcctccctgtccctaaccgagaccccatgggcaggccggggacgcagcgcgagccgagttcctgttcctacctccccaggtgcgcccacccgggcctcggagcctgcctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgc

SEQ ID NO: 91253 - DNA, 1048 bp, Homo sapiens
tctccagaatctcccactgagggggcggcttcctcacaagttcttcctctcccctctgtgtcggtcccatggggctctctgtgtttcccaagatgcccccatataaccccctccatgttcccttcaagggtcacccccaccagcccaactcccttgggctgacgcatccatccgtctccctcatcgtaagcccaagtgtcccccttctggcccccagagccctcctgctcccctcggggcctcccccctcactcccctcccagcaccgcggcggccggacagctgggcactaagtttagccttggcaggcgcctgtgggctctgtttatgctccaggtggctgtgggcatgggggacaggccttcccagtgctgcccggcctggggagtccctgggcctcagtttccccaccccaaaggagcagtctctggcccccagcaccaatggctgcccgcctgtcttctcccccatagcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacggtaggggccctgaggggatggccgggagggctctgcttaaaacacaaagacgccaggcttgtggtcccagctactcatgaggcagaagcaggaggatcactggagcccaggagttggaggccaaggggagctatgagcacgccactgcactccagcctggacgacagagtgagaccctgtcttgtatcaaaaaagaaaaagagggccaggcgcagtggctcacgcctgtaatcccagcactttgggaggccaaggtgagtggatcacgaggttaggagatcgagaccatcctggctaacatggtgaaaccccgtctctactaaaaatacaaaaaattagccgggtgtggtgggcgcctgtaatcccagctactcgggaggctgaggcaggagaatcgcttgaacctgggaggcag

SEQ ID NO: 91254 - DNA, 1045 bp, Homo sapiens
aggagcgagggctccaagaacggtgaggtcggagcgggccggggcgatggagcgggagcggcgtggcgtgctggagggccgggagaagcgggggtcgccagtcgaggggactgcctgctagtgtcccccgtgccccccgtcacgggcacggcgcggtggggtgggggagcggggggcgcgcggggcaggcatgggggcgcgacacggcggtgcgcggggtctctcggggtccaggtccaacgggcccccagctccggcccccgcgcctgggtttctctgctgggaaacgggcaggggcgcgggcccgcctccagggcgccccgcgtccccgctggccgccccccagccgcgcccccagcggggcggagcttgcgccggtcccgcccctccgccctccgctctcccgcccgcgcgcccccggcccagctgcggcgcgtgacgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcgggtcagtgtggccgggggccgggacgaggggaccccggactgggggaagccgggaccggggacctggggccgccggcgcgttcctttcttccagcgctggctgctgcggatgaaggggtcgccggaacgtgggtgggggcctcgggctggagaggcccaggacgttggagccccaggataaggtctctcgggccgccgcgcgcccccttcagacagtgctgcgtgggggaaccgggtagatgcgggggtgtggccgggctggggtgagtctgggacatggggggccc

SEQ ID NO: 91255 - DNA, 1022 bp, Homo sapiens
ggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggtgagccctcctgcccctctccacccgcactgagccacagcccagagcgtcacagcccagagcgtcacagcccagagcgtctgtggtgctgtcattactcttgttgtctttcctttccatgggggtggcttgctgtcgttcagcccttccctgcagtatgttgccagggaggagggccatggctctctgtgcctcagtttctctctatgcagtgggtggcaggcctctcccacagggtgagggtgggcttcatggagggagagtggaggttgtgcctggagcaacatgttacttgaccagcttgtaactgtgccgtggggctggcggggcctgcacgtggcatcaccaggtcggaggccatggctgggggtccaggactcccctgctgccgtttccaaagcccttgcctcagagttgttcacactgtagttccgttgcccttccctgcgttccatcctccatggagtgagtctctcctgagctctaccttgtggtggccaccctggggggccatagctggccccagtcccaccttcccagggcctgcacgtggtcagacgggcagggtggctcgggcacttagtcgtggggtatgagcatgcagtggagcacaaagcaggggccatccccaggctccggtgggccccaagtggggacaaggcagggatggccagg

SEQ ID NO: 91256 - DNA, 1072 bp, Homo sapiens
gaaagaaagaaagaggcaggcagcagaaagggtactgggacctgggcatattggagccagtttgagaaaggccttgaatgccaggcggagggttagaattgattctgggggtgtgtgagcaggaaaggtcatgagccagggagaggccaggacagagttggttgggggcagaaaggaggctgatgcttgagaccctctggctggggcaactggctggtggtgaggccattgctgaaaggcgaactgggggaaggcacaggtttgggataggaagagatgctgaggtcagcttgggtcgggctggtgaaggagggatgttccaggctgagcctggcgagggggcaggggccacaatggcctccaaggctcagcatcagagcctttgtgaacaggactgggcaagtcaggagcctgggggctcagggaggaaccctggggatggagaggggaatggggggcaggtccagaaccactacctgacccagcctggccccttcacacccacagggagctggcctaccagatcgcagagcagttccgggtcctggggaagcctctagggctgaaagactgcatcatcgtcggtggcatgggtacgggagctgggaggcgggggaagccccagcatgggaccctagcagctttggaccacctgcccagccctgcctctcatgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcaccatctcatccatttaggaaacgtatgtccgttagactgtccagtaaaacgctaggaacagtgacaaggaccgttcaaggaccaacaagagggggcccagtcctagcaatgttattcgggggtagggccttgctgagacttgggtgaggggcaggcctcccttggaaggagggtactccagggcctag

SEQ ID NO: 91257 - DNA, 1052 bp, Homo sapiens
cgtgtggggctcagaccaggccctgggaggggactgggcctgagtgggacccagacggtgtcctgggtggacgccccttgtggccagccctgccagccttctgtcgcttcagcgtctcctccaccttctccttgaagcgccggttcttctgcttgatcttggccagctcagccttgcgcttggcctccaggtcagggtcctggcacagggaggaccaggggatggctgagctggcggcccccgccagggaacctggccacccaccccctacctgcgggctcggccctcaccttcccctccaggatcagctgcttccgtttgttgatctccttcttttcgtcaaagtgggccgcctccagtttctggtggagggaagtggggtaaggagatgctggtcacgggggccccacctggaagggagcacccccggccctggagagcactttagttcctgcccgcctctgacactcacgatctcacactctcttcgcaccacgttgacctgtgtgaggatctgtagcacctcggcctcttccacggagaactcctccagcttcttctctgtggggacagcaaagccgggggtgggggtggggaggagacgtgacatggagagggagttcagccaagtagtgagttccccatgctgtggggtatgcaaggccatctggggccatatcaggtaagggtcagctgagcaagatcagggatttctgaggtaaggaaggtatggaccgctgtctttcagagtctcacggtcacccaagctggagtgcagtggcactatctcggctcactgcaacatccgcctcccgggttcaagtaattctcatgcctcagcctccccccgccattttttttcggtgttagcagcattatgagtttaaccatgaatattaatttcttgcaaacagtgtcctttaaagtccagatatttctttctttttttttgaagacagggtcttactctgtcgcccatgctggagcgtggtggctcaatcaggtcactgtagcctccgctcaagcaatcttccaacctcagcctcttgagt

SEQ ID NO: 91258 - DNA, 1035 bp, Homo sapiens
actaaaaatacaaaaatcagccaggtgtggtggcatgcacctgtagtcccaactactcgggaggctgaggcaggagaattgcttgaatctgggaggcagaggctgcagtaagccgagattgtgccactgcactccagcctgggcaacagagtgagactttgtctcaaaaaaaagaaaagaaaagaaaagaaaaactcaaatgtaagatcagagctttagggcgccacaggccttggttccagggagctgcaggacctctgtccacaaacgaaccaacggcgccgcaccgtgtgattttggagacggtgccagagagggggcggcaccaggattgacaagtgggacacatgggcttggggctggggaggtggatcctagttcaactccggaaggatgctctcctggcaagtgtgggaagggggtgctccctgtgaccagaggtgacaaacgcaggccagtggaggctgaggggatgcaaccatgcgttggagacatttcctcagcctttggattttggaaccctcaaacaacagcaaagataaccttaatccaaccattgtgggcatttttaccatcgtcttgggagggacagaggtggacagacgtccctgcttagggatgggacgggcaggggaacagaggcttctctctctttgtcttgcttcccgttccctcccgaagttgatctcttccgtttcctggcaacacccattgagcacttactgtatgcagaccctgagacccactgccccctccccaacctcactgggccacccatgtcagcccgggagggacctgacctccctcacaggcccaaagttatgacctcaggtagtggggacagaggcagctgtctcctgagaaggtgacaggagggtgaggtcacatcgctgtccgtgcaactctctccatctgcttcctatctctccgcctgtctcccccgtgtctctgtttctgggtctctttctcatcccagatgtccctctccgtctgtctctctgtccccaccctctgctcccaacccgaccccacgca

SEQ ID NO: 91259 - DNA, 1082 bp, Homo sapiens
caagtgctctgaagtggggctgagcagcttgaccaatgggcaatgaggagcttgagcctctctctgaggtgtccaggagagccacggaagatgctggagcaaggaggtgggcagcatcgccagttagaggggtcccttggtgtgtgttggtaggggggatcctagagggcatagccagggcacaggtggccaaaccagagaccccggcctgtgcctggggactaggaatactctccctctggcagacccagggaagaggctgtagcatgtgagtcacctggctgctgtgagaacattcggcgcgcggcagccccacgtgggctgtcaccaagcaggaacacggcccccagaggccctctgagctgccttccccacgggcttctgctctctgttcccacagctgctcccccaaggccacagaaggagcgtgggatggggggacaggcggggaggaggccgtgtaggctgcacagccagcatttgggagctccagggtagagtggggcttccccggcagagggctcactgtgttctggggctgccctagtctcaggactctgctcagggtggggaaactgaggctcagagaatggtagggtctgcgaccattctgcacatggacagacacctcgttctttcctaagagctgaaaccctgcccagggcctgcagtgtcaatgtgaccactccctctctctctggctccaaactccccatggctccccagtgccttcagaatgaaacccacacaactcaccaagacccacaaggctctgctcagttcctgtgaccccctaggtctcagcagtcccataagcttttctcccacttactccactctagacacctgtctaatgtaccagcaacatgtcctgcctggccccacctcagggcctttgcccatgctccgacccccagtgcctaaagcaccctttttaaattacacctgtttcatccctcaggaaaggtgcaaagagttcatgaaaggttatatgcccaggaacacacagcaagctggtgggacttgggatatgaaaccaggcccatctgactacccccactcccaccccctggcagcccctt

SEQ ID NO: 91260 - DNA, 1299 bp, Homo sapiens
gggtggttcagggagggtgctgccagccagttctcacccactgtctggcccccatcctgcctgcaggcctgtgccctggtgccccccactcttccctgggctgcgccctgtggtcatcacagggccacccttctttatccagggttccgctgagggccttcctactgactccttgaccccgggactggccattcccttacccagttttcctcacagtcttggcaccagggttatagtggtagctgagaggcacgactgacctcaggccagtgacctctgacttagaagttccatcccacccagggatgttgcagagaactggggaagtgactggagcttgagcctgagcatctggggagtcaggagggcatttgggggtgaggggctccaggcatagcctaggacagacccttgatccaggcatctccctgtggcccacatgcctggactctcctctctcctcagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacggg

SEQ ID NO: 91261 - DNA, 1065 bp, Homo sapiens
cctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactcca

SEQ ID NO: 91262 - DNA, 1055 bp, Homo sapiens
gcttgcgcacagtaggtgcccagtttgtacttgttgaacaagtgaactaggatttatatacgactttggcttcctgtggcctcttaacctattgctacctcctggcacctctccttccctgttcatttgattttttttttaactaggtcatcgattctgattgaaaagctagaaagaaaggcattccatgaaaactctccctgaggcccactgttctcatatgcccgtagttcacttctcttcctcgcttcttacagtttctccatgtgtgattaagcaaatgcaagtacatcttcccctccgcccttttttatttttgacagagatagggtctcgctatgttgcccaggctggtctcaaactcctgggctcaagtgatcctcccacctcggcctcccaaagtgcagggattataggtttgagccactgtgcctggcccatttccccttttctacatggagaaggacagaattgggcactgttcagtttccatcatggcctctcttgatgtatcttgttaagcttctgccttccctcctgcctgcctcggtctgtggtttttcagctccagagagagggttgattggcctggccgacctttccgagggatgggttcagccagctttgggtcagctgtggtgggtgtggtgttagctatggttcctctagcctcacggtggcactgtgggctgagacttccttctaagaggcagtgaaggcaggtagcctcaataaaacctgtctgttctgagatagaagtagaaacacagaagtgctccagttgcagtaaaaatatccaggttatttggggaccaaacaccctttcctcagactaaaagagggattgtcaacccagatggctagagagtagggggatctgaatgagcgagggctgttggtgccaacttagagagtctgtgtcttgcccgtcaggctgctactgcccagcctgggttgacgtcatcagggcaaactcaggcttggtgcttataggtcttctgttttagtaagtagtcgatccagatttttaagtgacaccacacgcattttaaatg

SEQ ID NO: 91263 - DNA, 1057 bp, Homo sapiens
tttttttgagacggagtctcactctgttacccatgctggagtgcagtggcatgatctcggcccactgcaacctccgcctcctgggttcaagcaattctcttgccacagcctcccaagtagctgggattaaaggcaggcaccaccatgcccggctaatttttgtatttttagtagagacagggttttgccatgttggccaggctggtctccaactcctgactttaaatgatccgctcacctcagcctcccaaagtcctgggattacaggtgtgagccaccacacccagcctgaattttttgtattttagtttcatcatgttgcctaggctggtctcgaactcctgagctcaggtgatccgcccacctcgacctcccaaagtgccaggattacaggtatgagccaccgcgcccagctccaagttgttgctcttagtgtatttttttctctctcaccatagggcaaaataacatggcagccagacgaattacacaggagacttttgatgctgtattacaagaaaaagccaaacgatatcacatggatgccagtggtgaggctgtaagcgaaactcttcagtttaaagctcaaggtaaaataaagtgttgttgttgtagttgttgttttggtaggggtgtatcttagggccaaggcaggaagattacaataccttgggcaaataataccagtcctctgatccttagtttccttatttaggaggaggtaaaggtttttattttggtttggtttcttttttgtgatagggtcttactctctcccccaggctgaagtgcagtggcgcagttttagctcactgcacccttgaactcctaggctcaagccatccttccatctctgcctcccagagtgctgggattataggcatgagccactgcacttggtcaggggataatgttttgatctgtcagtcatcattatgtagttatctggagcttctcactggatatcctccccgacccacctcaagacagttttgtttattgtttgtttgtttgtttgtttgttttgagacggagtttcactcttgtctcccaggct

SEQ ID NO: 91264 - DNA, 1016 bp, Homo sapiens
cagccgccgtttggggagacgcgtttctccctgtgcgtattgggtggggctaggaggtagctggggctcccctgggtgccctagcctctgagattcagggaggagcctggggaagatcctggggggtcgggggcgaccttcttagtcccttgcccccggccctctccgcacaggctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtatggacgccccgatgacctaggccagagggaacctggggctcagggtggggttcctggtcctttgggcgtggagtcgtcccaaaccagaaggcctcctgctgcagccacccctgctacctgcccacaggtggtccgagtctactgctatgtgaccgtggtgagcttgcagtacctgacgccgctcatcctcaccctcaactgcacacttctgctcaagacgctgggtgagatgccgcggtgtgggggtggaggaggggcggagttggaagataaaacagagtggaggtggactctggcggggaccgcggtggggggggagaggcggggcctaggcagggggcggagactgtggtaaggcagggtctgagcaggaagcggagcctggagtggggcttgccttggacaggaagtggagcctggggatgggtgcaatctgagcaggaggcggggcctgggtagggggcggggactgtggtgaggcagggtctgagcaggaggtggagtttgggatggcgtttgccttaggaggtggagcctggggaggggttgcgtcttggcaggaggcggggcctggggagggggcagggcatgtattgaggcaggatctgagcaggaggtggggcctggggtagggtttgccttggacagggggcagcgcctgaggg

SEQ ID NO: 91265 - DNA, 1090 bp, Homo sapiens
gccaccatgcctggctaatttttatattttcagtagagatggaggtcttaccatgttggccaggctggtctcaaactcctgacctcaagcgatctgcctgcctcggcctcccaaagtgccgggattgtaggcgtgagccaccgcgcccggcctcttaagcagcttttgatgccaggctatgaggctgcaagtgggggcagaatggaggtcctggagtcatgtcaggagcagcattaggacagcgccaacaggcctgcatggatctcagctcctgctgtgttgatctgggcaggtccttgggcttttcggtcccaggggaggaaactgctagctggtaactcaccggggtttggtcagtggggtttggctagagcaggccatgcctgcattcctccccactcatggagctgggtggggatggtctgtcccctctcccatagaactgggttccctgggtggggtaggggtaagggtctaccctgttgtctcctgtccccatagacgctgaagcggaggggcattggcctcgatgggccagagctggagccggatgaagggcctgaggagccaggagagaagtttcggaggctggcaggcgaagggggtgatccggccttgccccgaccccggctgtatgtaagtgactccctggccctgtgaatgaggcattcctcctacttcctaggcccaagtcgttgaggctggtactgagagaggggcttagagccagggatcctagagtttggaggcaggtctctacctggttggtcaggaaaggcttctttgagaagtgggcactgtagctggggctttgaaggatgaataagagttcaacaggcaaacagttccttccttcatttcatctttgattcatcaaacactctgtgcagccccctcagtgccaactctacactaagtgagaggtcttggctctggacctacctgtcaaggacaggcagagccagacagaagctcccccagcctgtagggttagggcagggggaggagcaggtagggagcctggtgggaggtggagcaaaggcttcctgaaggtagagctgggcccctgaactcatcaggattttctccc

SEQ ID NO: 91266 - DNA, 1050 bp, Homo sapiens
tcctgacctcaatcaatcctcctgcctgggcctcccaaagtgctgggacctcaggctgagccaccgcacctggcctgctcattttcatgatcattattcatttattctccctgatgactggaaccccagccataggggagatggagcttgacacagccacacctaactcagagggccagaacagagggaggcccagaactgggaaagcccagagagagcatgtggactctgcctgggaagccaaggcacacttcccagacatttgggctgggttttgaagctccagtaggagtttgccaggttgtgacatgagaattaccagctcagccagaaagaatcctgaggcatgttcgaggaagggttaggccctgccaattcccctacaccaccccacattcatctcttcttcttctctcccctgcccctgtgggtcctgggtccaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgaggtaccccaggtcctcctccccagccccacaaggccccgtgcacgctgctttctcagagcccagggactcttggtttgcacaaaagatgagtgtcttcatctggctttgtggctgacgtgctttatttctgctgtccctagaagggaccctccactcatccaaacatttgggagtgggggagcccttctggggacagcagaaataaagcacatcgggcagggcacggtggctcccacctgcaatcccagcactttgggaggccgaagtgggcagatcacttgaggtcagggattctagaccagcctggccaacatggcaaaacccagtctctactaaaaatacccaaattagccaggtgtggtggctcatgcctctaatcccagctacttgggaggctgaagta

SEQ ID NO: 91267 - DNA, 1029 bp, Homo sapiens
atataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaacctgcccgtcaccacctgataccttcattcattcattcattcagcaagtatttacccgagcagctattgtgatccatgtactgtactgggtgctggggagatagtggtgaacagagaaggtttggtctttagtgggtagtcacagaaggcttccccgaggaggggaatggaatctaaagaagaagtcgcattaactagatgaggagagaaagaaaggaaaggcattccactcagaggaaagagtgaaagcaaaagtcttcttgcagaagggagcgggcgcagtggctcatgcctgtaatcccagcaccttgggaggccgagccaggcggatcacagggtcaagagatcgagaccatcttggccaacatggtgaaaccctgtctctattaaaactacaaaaatcagctgggcatggtggcatgcgcctgtagccccagctactcaggaagctgaggca

SEQ ID NO: 91268 - DNA, 1037 bp, Homo sapiens
ctgcctctttccagggtaccccactcacccccaacccgcgtccctcaaacacagacacacaaaatacttgagctgaacggactgtgagtccaatgagggacaagttccaaagtcatcagaactgaaggtagaagggaacccagtgggtactcccttggacaatgctgggggaatcaaaggggtcttcacctagggccaatcttccagggggtcctagtctaggagagtcagcactgaacgcaggctccgtgggctcagggctggaccagagggagggacccagtactggcggaatgtcagaggcacacaggactcaatggaagagggtttgggagttggattttgaaggatgaataggagttcaacaggtagaataaggtggaaagagcatgagcaaagtcctccagaggtggaaggggatggacacaaatagtatgttaagggggagggtcaagtgaatcccaagcttaaagtgaagggagacagctatatggggtgtgagctggggaggatcgtggtcaggtctgaggccagagtgaggaggaatggactgaaaggtcccggttgaagagtcacatagcaccccagacgtcaggtgcatgagggtgggctggggtgtacctgctgatcccgtgcgccccccgccaggcgtggtctttccctaccacccccgtggaggccgatacaagctgaccttcgcggaggcgcagcgcgcgtgcgccgagcaggacggcatcctggcatctgcagaacagctgcacgcggcctggcgcgacggcctggactggtgcaacgcgggctggttgcgcgacggctcagtgcaataccccgtgaaccggccccgggagccctgcggcggcctgggggggaccgggagtgcagggggcggcggtgatgccaacgggggcctgcgcaactacgggtatcgccataacgccgaggaacgctacgacgccttctgcttcacgtccaacctgccgggtgcgtaggcctcaccccaagactggcctctgctgcaacactaccccaaccccggg

SEQ ID NO: 91269 - DNA, 1264 bp, Homo sapiens
cggggagcgcagtccgggtgcgtaggggccgctcggcgggggccgcgcgggcaagatggtaagtggggctgcgggcgcgggtggtgtgtgccccgtctccccaatcttggattctatatctctctgcctctgaatctatatccctctgagtttcttctgtctcttccttttctctgtctctcaccctctttgatctctctttttggcactctaggttctctccctctccatttctccctgcctctctccatctctgtcatcctctctgcctttttcctctcctctccgtttctgtctttccctgtccctatctctccctcctcttctctgagtctctctgcctctggcactctcctgtctctccctctccctttctgtctctccctctccctctctgtcgctccctctgcctctctgtctctccctctgcctctctgtctccctctgcctctctgtctctccctctccatctgtgtctctccctctccatctctgtctcttcctctgcctctctctctctccctctgcttctctgtctcttcctctctgtctctccctttccatctctgtctttccctctccatctctgtatcttcctctgcccctctgtctctccctctgcctctctgtctctccctctccatctctgtctctccctctacatctgtctcttcttttccatctgtctctccctctccatctctgcctctctctcttcccttcccctttttctgtgtcgcgcactctcttctctgcctctccctgcctttctctctgtccctgttctctccccgcgtctctccctctttctctccagctctcccccctccctgcccgccccggcccggtttgctgcagtctcctggcgcacggataaccttgctgccgccgctcctccagctcttccccacccccctatccccggcccgggccagggccagaagggggcggggcagcgagcctcgggttttggggtgggggggaatgaggcgggatctggggcaggactgagggcgggggggagtctaggggcgtgggttcttgcagaagctaggatgtgaggtcccaagaggaggagggggagttctccaggaccccggaaagggtggggacatgggcgtgagagaggtcctcgctgtggggaaggcaggcccgggagggagccaggcctccgaaaagccaaggctgggaggctggactgagcgccccgtgcccgccccccaggtgtgcgctcgggcggccctcggtcccggcgcgctctggg

SEQ ID NO: 91270 - DNA, 1125 bp, Homo sapiens
gttgatgttctttgtccgcagtcctctgtcgtgtctagtgcaggaccatcctggtcagcacagggcaccctgagggacttgaggcctcccagttgtagttgggcagtgtcggtgttggctcccctgaggagctgcaggcgcttgcctgtcagtccctggggtcagctcgctgtgacccctcctccaggcccgcagccccgtcacatcacccttgaccctcccaggggtcaggaccctgagtcaccctcattcagtggccaagaggtcctccgtgctccacactgggatttagagaacccagggcagtactcagtacttgctagagtccttgctccagtcctgcccaggggtccagatgagccacgttccggcgggggatgcccagcactggaggcggggagcaggagcggggctccggcaggccacagcaccgtgccctggctcactggcgagtgtgccctgcagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccaggggtatgtggggcagcggggtgggccgggctgggctgggcatggcccccctcacctgccctggaaggttacctggatgcgccacacgtggtcttgagctgccatcctggtttagcccccagcctgcttcctgtggctgtgaggcctggagtgagaggctcagtctctctggggcctagttttctccgtggtgaaaaggagcagtcctgacatcgtgagggtggagagctgcacagggttcactaaatgctgggctgcctcaccaggcagaggctcgggctggggtcatggcctagccgcctccttccctgggggccccaggctcccactgagcctcatacctgtgccctgggagccaccaggcctgctcccctccttcctgcttctccctcttctcacctttctgcttctctgagcagaatgggccgagcagctgacaaagatgggccggggcaagcacttcatcggagacttcctgcctccag

SEQ ID NO: 91271 - DNA, 1012 bp, Homo sapiens
gcctccctggccccaagggcctcagagattctaggtcaaggagaaaagctactgaatgaagattcttatgcttaccagggctgtagccagcaactgcagccagggtggagggtacctaggattggtttgtcactcaagtgccgaaccctagtgcttagatccgggtgcttcaatgcgcacacaccccagctctgagacacccagcaggtgaagaagtcgccctgtggcttagttggacagaacaggctccaaagtctgaggcccaggttcaagtcccactgatccatgtcctcagggagcatggcagccctcacccgcccgctcatgtggtggagtgggcctgggggaaagggactgtgggcatgctctaaggcaatcaaccagatgctcagacttcggctcctgcgtctccccaacagggctcccccacatccctcagtgccctgtaaaccaaggaaggactaagagtgcaaatgtgggccattcttagcggcaaagcccgagtgttgatgagctggaaggacccaaatcttttcccttcccagagggcccgctgcacccctttgctcaccttctcccccgggaagcaccgcaccgcccgaggggtggtggtttctgccacccggatggggctgttgcagcatctttctatgtgtcagtgttactggagcctgccaagttccacagctgatgccaaattaaatgtcagctgctctgaggatggttggctgcctcccctgaaggagctaagggagtcgcacagctgagtcttacgccagactctgaatctgtgcgcgcttacacctggtgtctgttagcaacggagctgccttctgagagcccgtttgtgcgtgcgcccatgcatgctgcccacatgccgtctcagctctcttgtctctggctctgcaaattcctgccctgtcactcgttagctgtgtgaccctgagtgagtcccggaacctctgattcttggtgtccacatctgcaatgtggtggtgcgtagagcctggct

SEQ ID NO: 91272 - DNA, 1932 bp, Homo sapiens
tgtgtgaagggctagccggtgaggtcacatcaccctgacagcacagactgaagcgactgtggagttgtgccatgacagccttgagatcccttgcttctggctgtgtgtccgagcggatcagaggccagcttggcccccgggccattagaatggagctggcgtgtgtcctttccttaaaggggtgccccagcagctccaagggtaccctgttgggaactgctgcattacaaggggtattggccatctcggggcccttgaagcccattatgacccactgtctgcatggcctcagaaacgcacctgttcctgtaaacagcaaccaggtcaggattgttgctgggcccatggcaggagggcgacctagggtgaaagacagtcacggaatgctctcgggacctcacaggggccctcgttgggctacacactccccacctctcccccattcccagcagcccaagcaacaaggggaataagattagccacaggtctggcatgttgcccagttgccaggcacttgctggcagcgagaaatttctcttgtgcatctcctacaaggactgcagtctgtgtagtagctgacaaactcacagcctcagaaacaggccaagggaaaaatgcaaaagcaagttccacatggctcagtggggaggctaatccgtatataaaaatatatctttatagctctgttcactgaaaaggccccgaaataatgattaagcctgtggcattgagcatccctagctcccagatgctggtctggagatgcagtttctcatggaaaccgacttcttggagaagtggctggctctgggtctgggcaggaagtgtatgagatgatcttggagcgcctgtcctggcagatggcaaggaggccatcagagactcctggggccatgtccagagccctcaggagccagcttgaagaggttccaccggccgcagagcttctatgatgacactagttgccatggatcgaaacccacccagtgtgtttaaatcagagctcataatggtattttttaaaaaagaacgtgtcatctttgaaggatgaaagggaaccgatgtattatgctgaaaactggtaaagaaagaaaagaattaagcatttcccccaccaaaaccaggggaagctggatatattttctgctagcttccagcctggagctcaccacagcctcacacacttctctcccacctagtgtgtctcaccaagacagtgagaccgactcccccctcgtcatggtgttttgtgcctggactcgggacgcccgacagcctcctgcatctcacactcttctccccccaccccctctgtcgttgtggtccatagagagagtgtgcctattgactgtggggtgtgtgagttgaaccccagtactgacagcctccttaaagtttcacccccagagggagccgagactcggaaagtgatagagaaattggcccgctttgtggcagaaggaggccccgagttagaaaaagtagctatggaggactacaaggataacccagcatttgcgtgagtatctccggggaagggaaggctgtgctgttgaatgcgtttgctgcacagtcgcacgtgtggggctgggtgcttgctagtgtgggccggatgctgttccaagcgttttctgattctcaccagaagtgacaagtggctcccatgtggcacggagacttgctttcgggtccctgctcgccagcctgcctttttttgcacgatagaagctgcagggatatgcctgtcacagatacttattttcccctctcttctgcaaacttcctcctctccagatttttgcacgataagaatagcagggaattcctctactacaggaagaaggtggctgagataagaaaggaagcacagaagtcgcaggcagcctctcagaaaggtaggtggacggagcgggtgggagattctggggaggc

SEQ ID NO: 91273 - DNA, 1065 bp, Homo sapiens
ttagccaggtgtggtggctcacgcctgtaatcccagctactcaggaggctgaggcaggagaatcgcttgaacctgggaggtggaggttgcaatgagccgaggtggtgccactgcattccatcttggctgacagagtaacagttcgcctcaaaaaaaaaaaaaaaaaaaagccactggggcacggtgcctcatgcctgtaaatcccagcactttgggaggccaaggtggaaagaatgtttgagaccagcctgggcactatagcaagacctcatctctatgaaaaaatttaaaaattagccaagtgaggtggtgcatgcctgtaatccaagctatttgggaggctgaggtgggaggattgcttgagccggggaggcggaggctgcagtgagctgagatcacaccactgcactccagcctgagaaacagagccagaccctgtctcaaaaaaagacccaatggatcttgcattcttcatcttagtgcttctccatcactccccaaagcccttataataaagcacagatgctctgacatgcctcacctctgcctgtccctggagcaggcccctctgacactgggcacttgctgctccttggatgtaccaggcttcttcctgccttgagctttcacatctgctccttcttctgcccagatcatctcccatttggcttttcatgacgctggcttcttatttgttttttctggtttaaatgtctcctcttctagtgtttattttctgcctgtcctacctgcatatgtactctcctgttactttttcacccttttttggttttcagcagagctcttaccacattgtgcacttacttttttttttttttttgagacagagtcttgctctgttgccaggctggagtgcagtggcaccatctcggctcactgcaaccttcacctccctggttcaagcaattttcctgcctcggcctccctagtagctgggattacaggcacatgccaccatacccagctaatttttgtatttttagtagagacagggtttcaccacgttggccaggctggtctcgatctcctgacctcaagtgatcc

SEQ ID NO: 91274 - DNA, 1001 bp, Homo sapiens
ctccaggtggctgcgcgcctgctcgctgttcttggtgtggtgatagagaacggagcccagctgcaggtgtgtacgggcctcgatgcgctgcggcggcttgaaggggaacacggcctgcaggcagtgcacgcacaggcggattttgggcgggctggaagtgcggaagtgctcagcgaagcccagaagcgccaggtaccacgagtcggccgcctcggcctgcgcagcctgggccgccgccgcctgggccgctgccgccgcctgagccgccattttggcctccacaacaacaagccgccgccacagggaggcggaagcaggcgcgcgagacggggccgggctctcctcgcggcttccgcgagatctgccgcccaaagcatcctggaacatgtagtttgtatttgggatgactgccgctccgggaaggtgtaaaagggcgacgccgtttggttatcgtgactgggacttaggcatcgctgataggctgaggcttccgtttctggaggttaaaaaaaaaaaaacccagtcgttcacgcagtaatagggcgagtctgaccgaggcggactacatctcccatcaggcgatgcacactataacagggccccttaaggggcgccggagcattgtgggattggatgagtctcaagatggacaaccgggatgttgcaggtaacagcccccgcctcctctcaggcggccgcctgggtccctggggctaggtgtctcccctgactcctcgggtccgtcctgctgcgacccgtggatccctcgcttcagccccggggcagcccacagcgtcggcttctgcacctcttggtttctcgagaccccagacccaggttgctggccgcccccgcttggtttgctgaggacgcacggatctccgtagaggccgccacccggctcggccctgcgtcccgtttccgaaacaaccgccttcagggctgctccaacctccgttccccaatacggcgacaaccttgggctgtccctgcacccctct

SEQ ID NO: 91275 - DNA, 1037 bp, Homo sapiens
gcctgagaggaggcgggggctgttacctgcaacatcccggttgtccatcttgagactcatccaatcccacaatgctccggcgccccttaaggggccctgttatagtgtgcatcgcctgatgggagatgtagtccgcctcggtcagactcgccctattactgcgtgaacgactgggtttttttttttttaacctccagaaacggaagcctcagcctatcagcgatgcctaagtcccagtcacgataaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcggtgagcgcgggccgggccgcgagggaggagtcgcgggctccttgcaagatctgggctgacgggtcgcgaccgcggcgggtggggggccgctcctcggcgacctgggggcgcgacctccgtcaaagccgcaggacccccacccgcctctgccggaccccaaagccaccagcctctcaagggacacgaaagcctcgccccccacgccttatttcccgtttctggtgacagggctccaggagccccgtcaccgtactctgaaagttgcctgttattgggagcaacaggatccgcaaatcgtctggttttcaggaggatcccacctgttggtggcgatgggg

SEQ ID NO: 91276 - DNA, 1050 bp, Homo sapiens
ttgccttgcagggtcaagccaggcatgtgcctccctttcagcctgttcagactttgacacttgcctctgagggagtccctccttgtcggccctggaacacactagggacaccccactgaagacagaccccacaaagcactcagaacagccttaggtgctcacacagccttgggggtctgtgccgtgagccttggctgctggttctatgctccattaagtttagatagtgtccactgcaggcaccattcagtttagatgacatatatactacaggccaactggagctgtgtacccaaagcaattagcgttgataagataatttggttaatttagctcaaaactgacacaggcagtttcactgacgtggggaggtttggttgagtttgctaacagagcacgaaggcaggtaccgtaaaactgatgggtttggcagcaaaggtcactgctctctttcctttttagcaactgcacacgcttgagaaggacctggtgtcggcctgtgacctcctgggtgtaggggccgagtacgcccgggtggtgggatctgaatacacacggtaggcacccactcccctccttccctcctgctctgttaacaggaggggcttggccatcttggtccaggacaaataacagaaatggcatttcaggtgaagtacagtagctcacagtatattcccagcactttggaaggccaaggtaggaggatcacttgagcccaggagttcaagaccagcctggggaacatagtgaaaccccatctccacaaaaaatacaaaaattgggtccgggcacagtggcttacgcctgtaatcccagcactttgagaggctaacgtgggaggatcacgaggtcaagagattgagcccaccctggccaacatggtgaaacctgtttctactaaaaatacaaaaattagctgggcgtggtggtgggtacctgtaatcccaggtactcgggaggctgaggcaggagactagcttgaacccgggaggcagaggttgcagtgagccaagatcatgccactgtactccagcctggcgacagagc

SEQ ID NO: 91277 - DNA, 1050 bp, Homo sapiens
ctaggacctgacccctgcctcttgttttgcagggcgctgttcctcctcagcaaggggatggtaagttgaggctgggcatggctggatgcagctggtgttgtggaggtgaggcagggcccccacagagtctgctcagaccccacccactctccatggcatggccccttaggcgcccagacccttaggcacagtgagcagcctggaatgtgaggcccgggccctgctgggttcaggagggaaactcaggctgcaccctatgggattcatgctgaggcaagagcctggttaggagctgcctgggctggggtttcaggctggccttgccctctggattggtggcagcagtcccagggcaggtgggcaggtgaccctgtgctcccggtcctgggagggcccctgcaagccctgtaccctacacctgcgcctctccctccccagctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgtgtggcgcctctcaggcgagctgctggttgtgaccagtgggtatgggtggtacccaggccaatgggtcttgggctgtgaggtcagctgtgtcatcgccttaccttgccacacaacagggctgtcataccagtcccggacacacacactcctgtcctgctctgccacgagtgctggtatctgggaacagggtctgtcctggccaccccacctccctttgggagtactatgtgtgacattgcatacactcgctcagtgtatggatgctcagagattccaatggcagttcagggaatcatgagaataaaccacagaggtgctgggatggcacctgcacacagcagatgcccaggtgctgtctgtctggcccccggctgtggggttgagtagggactgatgtgctcagccatgtccgagactggactcatgaccctgccgtgggtggggagcggctg

SEQ ID NO: 91278 - DNA, 2891 bp, Homo sapiens
agtaacttgtaaccacttcgtgtccacgcacaagtctcaagctaaaaatgtggggagagtttgactgaagtagagttctgaagtataggctgcgctagtgtttggtttagcatttcaacaagttcttccctctgactccattggaactgcagttcactttacagtttgactgagggcagtctctctcctgttcatttccatctgggtcttgcttaatttgagtcctttgtgaagactcctgccgaggctataatttgagttctaaatctgtcggtggaccatgtggacacaagtttcaactcgagctattttcttctggggagaagtgcttggagactttcctgggccctctgctgctgggctaagtcaagtccaggcaggaggctgctgcagacttggttgctcttctcctgcctcttcctggtcagctgtaggcactgccctcaggggaagggaaagttggaggggagtttgggactgagatgagggtagagaagtgcctgaggtgagggtagagaagtgcctgcacgtatttactattttattttatttttttgagacagggtctcactttgtcactcaggcgggagtgcagtggtgcgatctcggctcactgcaacctctgccctactggctcacgtgatcctcccacctcagcctctgaagtagctgggaccacaggcgcatgccaccacgcccggctatatttttgtatttttggtagagacgaggtctcaccatgttgcccaggctagtctcaaactcctgagctcaagtgatctgcccgcctcagcctcccaaggtgttgggattacaggcgtgagccactgtgaccgacctattattttaaataaaacctataggaccagcagatgggatgttaaaaagggaatggacaactttgaagtcagaaggagccagttcagattctggtgctgcccttcttagttatgtggccttggacaagtgatggcacaaaattggcatgttattaaatattcgagggaacacattgctgtgaatgtgtgtgtcaagttgcttactgatgatgggaggtgcttactagatggatgaatgaatgaatccgagatgatgaactggaggtggacagcacagctcctggcacacagttggtgtgcagtaaaggctgcttgttgtattcctggcctggactcacagaccaggaagcgcttgatattctgccaaggctaaaaatgcccaaagagaaagaaacttggtatgtctcttggaaaacccactcccctactgcgtctcttagcaagagttttctgtgttctgataccagatgtgagatgggtttactgtatggcagggcatttgtgtttctcttggccttggtgtctccccctgtaaaatggggtaatttgtgaattaagggcaagtagggagatgtattactctaattagaccacaggcaagatagaagattataatggacttgaagaattgtgggaagaagaaaatagatgaactatgtacgcctaagggatcacatgcgtattatgagactgcttgagtgagtgagtccagcagttacctggtgagtgatctgttcttacactttagaaccttgaaagaagagccattctttcattgtaatagatcagatttggggacaaaagactgggaaagtgatgtacaaagccatttgacgccacacaataatagtactttgagagggccagtgtgtggcttagtgcccacgaggagatcagaatgcacctcaagctcccaaggcccagagggctgtggagatgctaactcagcttagaggctggggcaggggtcggggggcagtggaatagaggggagtggacaggacattttacaaaatttttttcttgagaggatttttttcttaacaattagtaaaagccatagaatcatggctggtgaattaggcccagccttcttcacttactagtatgggaatagatggcattctgcccctgacggctaaaacccaggaggaaataatgggtgaaaatctgaactaggcccctggtgggctgctcctatgtttgaagaaagggttgtgggtttttttgtttgttttcttcctggaaatataccctctctcttcctccttccctcctttctttctctctttcatgcacacatatatagacacacactgactttggtattgaagcaaagaaatatgcaccaatcttaaatttctttcaattcttttaaggacagttattccattacatgggaaaggagcaaaatttattatatttaaaatataagaactaaggtaaacaactttaaagggatcactctcccctttaaaattatgctatgtctcttgtgtaccacagacttcactttggtggatggtggggccaccaccaagtctctatctaacaggaagttttttaaacttgtttttttttacttgaaggatccttacagcaataaaaaaccttggatagttagaaatgatattgatctaggtacatttattagatgtaatgtaatgtggttatctgttggtgggcaggtctaaaaggcatgtgggtccaaacactgcccagcttctaactctggacgataaaaactgttgatttatggaactgaaatagctagggaagtcagggtttccttcctgttggagacagcactgggggcattaaatccctgtgggatcttgatgataagaaataagctgacctcttttggaattgggaaataactactgtgtcaagtggttccatccaaatgaatggatggtgttatttttgatttctagttttaagtttgacttcatcctctcagaaacttgactgcctttgtttatactggtgtgtcttttgaataagagtttttcctttttttttttttttttttttttgagacagagtctt

SEQ ID NO: 91279 - DNA, 1063 bp, Homo sapiens
tgggaggtggaggttgcagtgatccgagatcgcgccactacactccagcctggtgacagagcaagactctgtctcattaaaaaaaaaaagaaaaaaagaaagtacagtattaattaacaacggctatcactaagggttttttttttttgtttttgtttttttgatttttttttttttttgagatggattctggctctgtcggccaggctgtagcgtaatagcgcgatcttggctcactgcaacctccgcctcttgggttcagcgattctcctgcctcagtcttctaagtagctgggattacaggcgtgcaccaccatgtctggctaatttttgtatttttagtagagatgaggtttcactgtgttgaccacgatggtctggaactcctgacctcaggtgatccacatgcctcggcctcccaaagttctgggattacagacgtgagccactgtgccctgccagcactaagtattgactgtctttgttttcagatcagagagaaaacttttagaaaacatggttctagccctagttgtttcttaattagagtttcttcagctttagtatggcatctgaaggtgattgcatcatatttcataatcacccagctgaactatttgctgtttagtccagcactgggcactgaggctaaaagatctttaatccaaacagcctcagcattcacccaacctgagcctatgggaccccaagcagatctggattcactgtcacttaccatctacccatctgaccctgtcttcctatgacagacagaaataaaccctgtagctatttcaccccacctacataccctgcacccctcctactccccgtccgactttcctggctgagaagttggcactgccctctggagcaggccctgtcaccagtgcacccctcactccacaggggtgtgtcattaatgtgttgcagttgatgcctccctcttaaaaaaaaaaaggggtggttgtcaccctggtgactcacacagggcttgctggctcaaactctggaatctgtatatctgtctcaagtgtcaggtctcccacctgaccacactttg

SEQ ID NO: 91280 - DNA, 1654 bp, Homo sapiens
caggggcgggggtccggggcgggttgggcagcaacgctgaaccccgcggcggcggcggcggcggcggcggcggatcccgtgtcagaataagagtccccgcgcgcccacgcctggagggccggccctcccccagctcgcgcccttcctgcctaacccccgggagccgcgggaccctttcccctctctgatctccggcctttctcaaggcccgacactttaaatttgcctccccatctaggcggtggctccattgatttcttttttcccacctagagtgggtcggcatcagtgactagacagcagcagctggccttttaaagggattattgccaagaatcggaattgatcacttcaacaaggaaaggcttatgggcagggcccaggctgagagcctgacggacacttggattgtgcgcacactgggacccagaaatgaatggtgacccctcccttaggaagtgaatgacaacccttaggtgcgtgtttctgccctgagaattttgcacagggcaaaattttgtaggtctgacttaacgtctttaggtgtatagttcatccttatcttaagagctgtggattctttagatcaaagtccgagtgagtcacttgagcctttaattttctttcttcctaccagtttacttctttcagttttcttggagtacatagtgctggttacatctctggttctgtgtgcccattcacacagtgacacctcctggctgtggcagcacagaaactgagagccctctgtgcgggtgtctcagtcttggactgtagtcctgttgactgacttaactcttctggtagtcgttacaagttttcttttaaactagattacatgaaataatgtttgttggcaccagtttgttaacatatgctaagcagtagtttgtcagacctgaccacaagctgtggagggctgatagctcatactagccctcgggtttgagtgcctactgtgtgctaagctcccctgcacagacatattcagtgcctataacaatcccgtggggagtagggaagtattatctgcgctttacaggtcaggaaattggggctgctggaggccaggcggcttgctcaaggcctcttagtagtgaggcagagccaggcagcccgtacttggtgctctagagcccacaaatgctgcagtttgcgaaccctagtgagcatttccctggcgcttctaaaatacaaggccattttcttgtccaggatccagggcacctctgtttgcggatgtaggggataatctggtgacatggggacaccatgctagccctgctttgttctagtggagcagcgttaccagctggattttaaggaactgaactacagagttagttgctactttgcattcgcttcttcagctttggactcagaaaagttggcccttttctagaggaaacagtttataggatgtgggaaatttgcaagggattttctgtatcctctgtcttcacttattccctcccctccttcatctttcagttcttatttgtctcataaaattccgaagctggtttttatgaagattgcttctcatcttggaagggctatagagaatggaaagatttggatgcagtgtgttttgtttgtttgtttgtttttttgagacggagtctcgctctgtcatccagtctggagtggc

SEQ ID NO: 91281 - DNA, 3469 bp, Homo sapiens
cctctcaggttcaagcaattctcctgcctcagcctcccgagtagttgggactaccatgcccggctaagttttgtatttttagtagagacggggtttcaccatgctggccaggctggtctcgaactcctgacctcgtgatctgcccacctcagcctcccaaagtgctgggattacaggcgtgagccaccacgcctggcggatgcattgttatttccactcagatgacatcattttttaaaatgtcaagtcatctctattaatgcagtatcatttggcaaatcctataatcttatattttgatagtgagggaaaaatataatgctactttcggtaggaaaaaatcctggaaggatttgtaccagaatgtcaataaaggtctctacattaggattagcaatagtttttcttttttagaaaactttttagtgtctctgtattttgcgtgtgtgtgtatgtttttaatgaggaaacatgttttaaatactctaattttcaactcttcagtagctcctctgacttgttttgcatcatttattttctgaatttctggcattgcaggtagtgatttctagattgatatattcaacaaatatcagagtgcatactgtgccttcgacactgcgaggaatccctcctcagtagagtttatagtgagattagtgggccaggagtcgtaattaatcttataaacatggggaaacttacagggatcaaggagagaaggacactgtgacctggtgagcccgaaaggacctttctcctactggggtcagagaacaagaagggggaccctcttgaaggggattaaggcaagggctggtgcagtgaggctcacagccgggacctctttgggtcttagcagatgactaaaggatgcctctgaagaatgtggctggtaaagttgtaaagccattcttgaaatgttggctttttttttttttttttttggtgtttgttctcttggaagaaaattaagaatgaccagcagagttttggatatatgaattcccaacagagacaaaaatgtaatggcccttaccactgaatttgtttaaggaccatcattagcatgtactgacacctcaaagcctgggcagctcagatgcttttctggagaactacctgcttggactcggggtgtttctgtgccatcaaatggaacaggcagggctattttctctagacctttcccccccataattgagttaatttatgctggttgtagaaaactaggaagattatgaaataggtgagtgggtgaagtcttctcgagcagctgtcctggggtaatagagcatccctgggatttcctcctaacccttgtctggttgggaagtgtggcagaaccagaagaacaagttggcaatgtcatagtttgaggcatacagaactatgctgcctgctaagtgtggtcgtttgttagaatggatgcttttgagttatctgagctgcttcgggaggtagctttccacagtctggcctcagactgtgggtcttccaggttaacaggacttaagtgctaactgtgcaaaggtatgtctttgaatggaattaggaaggcagtgtattaaaaataagaaggttgagataaaaaaagacggatcttgaagtggttggtggttgcagcgaggtggaaatagtgagacccgtactgtcagaaacaaaggtaccactggggacagatcccgctcgagcatgggttccccagcatccccgcaaacaggatctgggacttttttgtcaagagagtgtcagaccgttggcttcttgcccctcccccaccttgtgctttccagactatatttgtgacctctttttgtctgatggaaatgtaggttagtcttttagaagacaaaggaatttaccctaatagaatacctttaggtagcctcaggaagtgattgggaatccacgaaaccctctaggtgtgggagagaggggccctcagtgagaatgtcacacgtttgcaccagtttgcacagttgccagggccccttgcagctcctctgtacgctgtaccccctttgtctctcctcagcctccagaggcaccttcacaggtgagtttgtcagggaacttgcctttctgtctgattcctgattttagggttccttatatggaagggctgaagacctgcaatttccgaggatgctggaggctagcttctgagataggatttgctggcaggagatgagcagtactctaaaggagggctcccagcaagtcaaagtgggagttcttggggcagggggtgggggatgggggtggtgggtggagtggtcaaggcttcagggctttcctgctgcttggcctcaaagatagtagctatgcctgtggggaggggtgtggccatgtggtacaggattggggagaaattccacttgtttgaaggatttgttgaagaatccctcagctattcctcctgcagttccgtctcaggacctggcgctgcgtggcctgccttgccggttagatattctggtttgaaccttgaaacgtagcctaaataaggtggtgccttcgagcacacactttaaaaatactgctgcattatggtggcacagcagctcctcctgtgccaaggaggccactttgagtctagggggcacctgctttttgccaagtgtggccgtgtgcctattgctgagcagcctgtctctagtggcatccaggacagccctggctttgcctcaagacagcctggtgtgagctctgcccagccacttcctagcgaaagaccttgttgaacatcacccctgtttcccatttctgtcaagggggtacttactatctcccgtggaaggctgtgttgggagtgagataacaagtgcaaatgatcgaccccagtgcctgtgtgttccacatgttgcagttcagtgagtactgttatgactgtaacagatgagccagagttcacaagcattaacaactgccccacctcttctgtgggggatgacaccaccctcatggcaaactgtcactgtctgcatgccccctttggagccacactggggcgcatgcctcagctttgtgccccagcctattcccctctctccatgttcctgtgaagaaggcaaagttccccacaggaggtgatacttgccatagtcaccttgctcattattcggcggctgggacccaacccagcctttctgatttcagacgttgtctattttttccactgccttggggccttcttgacgatactgaatgcctgggttggttgtgccccaagccaggaggcagcctctttcctggcccagggcttgtggaagccagcatccggacttccatctgtgagatgggaagctgtttgccgggcagatctgtcatgggagccttccttagagaactgagaggggtccctgtcactgagtggactctgggtggaggctggaagtaggtggtttgatggtacttgcagtggtgtctgggagcgccagggtgaatctcatcctcctggacttgc

SEQ ID NO: 91282 - DNA, 1028 bp, Homo sapiens
ggtttcgtcatgttggtcaggctggtctcgaactcctgacctcagatgatccacccaccttggcctcccaaagtactgggattacaggtgtaaaccaccgtgcctggctgtgtttgatgtttttattaatacgttcgtttgatgaactgacctcggtagtttgtatgtgggccatctgtctcctgcctcccttccccaaacttttggtcaagtttttagtgttgagtctttttgttgttgtctcttttctgactgtacaagcaacatttcctgatgccgaagtctggggagggggtgggagcctcagatgttggtggtaggagttgcctggtctgcttttgaagttttcttgggcaagtatattaacatatactgagtataggttcaaatgtaattgcagtcttattgttagtttgtatctgtcaggttataggattagaaatataactatttttgggagttgggtagcagacaaactgaggattctacctgggactttcttctgtgtactgtgctctgctgaacccaacactgggcacaaacaggaaactgaggctcaagcggaggaggagtggcctgcccaaggttgacttgcagaaggaatgaggatatatccctgttttctcctggaattagactttcagatctctgttgttcttactgatgtctttgtggcttggtgaattttgttttagcttccttcttactttatttatgtaggtccattggtcagtttccttcctcagggccttgtctttttttttttttttttttttttttgaaacagagtcttgctccattgtccagtctggagggcagtggtgcaatctcggctcactgcaacctctgcatcacggttcaagcgattcttgtgcctcatcctcccaagtagctgggattacaggcgcacgccaccacgcccagctctttttttttttttgtagagatggggttttaccatgttggccaagctggtcttgaactcctggcctcaagtgatttgcccaccttggcctcccaaagtgcta

SEQ ID NO: 91283 - DNA, 1738 bp, Homo sapiens
ttcttgtgacattttcttctggtgtcctttaatactgcaatacatcaggcatctgaaatactaaacacttaaatgtttcagacacttcctaaggcctcagtgtcatctgcacgtagacatttggtttctgggcacttaagatctggggtcgataggcagtttaggactgctgcatgcactgcccaggcagctgctgggagcctgggtggaaacaataagaggagcatccagatagaggtagcaatgttttgaggaacaacattaatcataataataaaagaaagaagtagttgcttctgtttgagaagctgcctggtgccagggcctgtcactgggttctcaggatggtctggaggcctgaggtaggttccacgcaggcaggcaggctccccgggagggcattgggcccactgtttaactgccaggtgagccaggctgggcagaatgtgctaggaggaagctcgtgagcatttgggatggtttggagggaggcctggagtgccagggagcgagaggggtgtggtgctggagtctgagcttaccagagggcagggctctggacccgcatgagaactgtgaatggggttttagggtgggacacagcctctgccataagaaaggatacggggagtgcagagtgtgggcaccactgacactggggcaactctcaattctcagtggtggcctgagggaagcccttcagacacagggtccccacagctccccaaatagcatgccaggggtggggcaggagggggacattggccgcgccccgaagctctggactcaccccaggggctgtgccgtgcccatggctgtagtcttgcctatctccatgtggcttcttcctggcactgattaactattttaattaaagacagcatttgtatgtttttttttttttttttgcctccagccggtggtagaaacctcttggttgggtcctgacaactcgtggaggtccccattttgtagtctcctcctccgtgcccacgtgggtgttagatgaggtgatgcgcaagcgccttgtgtccatggagcatggagcctttgggaagtgggatgctcgatttcaagtagcaagtttcagcaaaaagttccagcatcgtggtccatggtgaggggctgggggggagagcttgcctgagtaacaggtgcttgaacccaaaggatgggtgggagctaggaggggctctcctggccatgggaacggtgcgtgcaaaggtctggcacggggagtaggcaggcgtgctgggtctgaggaattgaaaggaggccaggtggttggagcgggagcatggaacgtgtatgctccttcacatgcacgtagcgcacttgcggctgaagtgggccgggccttgaaggccgtggtgaggtgctctgacgctgggtggacctgggaaattaaggagggccgtctggtttattatggggagtagaagatggtggaagtggaagacagccagtacatgccttaggctgccggcctgcccctgcctgtctcctccttcaaggaggctgtggttcccatggctgagggaggagacaggcaggggcagaccaggggcctacaacatgtactggctgtcaccctaatgggaagctcagtttgagagcagaggtgggaactccggcctccagtgccagctctggttgccaaggatgggcttgtgtggccaacctcacgattgggtcttggtcctcccggggctgattctccgcatctctagtctgccaa

SEQ ID NO: 91284 - DNA, 1004 bp, Homo sapiens
tttctttatccttaagtatttcaccttttttgtgctaatgtagatgacttttttcaggttttgagttctgattggtttgtgcctgtgtgtagaaacacagctgattttttatatatagaccttgatcctgcagcagaacagcacaggacacctgcttctgaggcttcccaccctcggggcagagaggtcttggattggcagatacaaaatagttaggactaatgctgcccattgggtttctcagcttgaatggggctaaaaagagcggcagaaagggttcttcctgaggagctagccctgtgcctcatttaggaggtgcctaaaggtctttccatagagttcactggtgttgtcccctatccttatttttgcaagttctcctgtgggagtgtttctcgccatccatcagctgtgaattgccgtgaacctagtttaaaaataaaggtttcatatcagagcaagctcctggtagtcctgtgggtgcaaagaatgacaacagaggtgatgttgacactatttggcaagctacaactgacagaactgcttgggaatctgggatttggctggttcctaaggttcagcctctggcccatagccctggacgtctgatgatacaaaccggaagtggaagtccgaggcattttctctatgaccttggaagagaagttcctgaatattgtagagcattagttttcctgtctgtaagacaggcagcctctttctctctggacagcatcccatggggatgaccatgacctttggttttggaggtgaagccctctcggtctggagggtgaagtccgctcattcccaggcacatcatgccctcatcttgagggtaaacctagcactgccttcaccaggaatggtggctggtttccctggggtccatgacagacaacatgatggtgaggaggttacattgggagaatgagccctgcgtgctgcctgtgtgctctgtgaccctgggcaagttcctgaagatcagacacatcagatccctt

SEQ ID NO: 91285 - DNA, 1001 bp, Homo sapiens
attggtcattcatttgaaaaccctaggtctaaataagatgagcctgtcctctctgaggggcaggggcagaggataatcctggccagtggcctttgccctctggccattcccatgatttcccagcagtgatagatgccgttagactttttccttattcaccgcaaagcccagggccccacactggttcttggagctggttgcccttaccttgcctcgtgcctcatggcaaagctaagctgcccccgctgcgtggagctcttaggcagagactgtcaagagctgtaccagggcattgctgggtaccttggattttctctgttaccatcaagcctggtcagcgacgttttggcccaaggctacctacctggagaagaacgcagaactgaaagatgtcttagaacttggaggcagcccctgggtcagctgctccgttttatagatggggacacacatgggccagagttggcaggtgacttgcctagggattcatgccccatcgaacaggatcttgccggtcacgcagtgtgagatgtggctgctctgctgaccatggcacagaacaagtgttgcggtcagttttgtgaggtttcagctcttcatatggcaagaaaatatgggcatagtcaggtaattctgttgtcaggaaaacatttccagaatgttctccaaacaaaatgaaactttcgtggtacttatatttttattttttatgttttgagacagggtctcactctgtcacccaggctggagtgtaatggcatgatcatagctcactgcagcctcaaactcctgggctcaagcgatcctccccgcctcaggctcctgaatagctgggaatacaggcgtgtgcaaccacacccagctaatttttgtattttttgtagagacggagtttgctgtgttgcccaagctggtcttgaactcttgggctcaagcgattctcctgctttggcctcccaaagtgttgggcatacaggcaaattacactcaaaaaaattttt

SEQ ID NO: 91286 - DNA, 1114 bp, Homo sapiens
ctgctgtgtctagttgtaggagctgactgcttggaacacctttctgtctctcaagttaagttgtatctctcgtacttggccttaatgaagtttgacattgagaagtccagagctgctgtttccggtgtggcttccttccggaatgagtcctagtcactgttactcagagatgtgcgtcaggaagtggctcgggccacagttctgagcagatggaggtgtctgttctgcatgggaaagaagtatgcttgtcaggcaggctctgccaatgccaaaacttggcccacctattctctccttaccccctcaacaggtccttctgggccacaacaaggtaccctggtttgactcttaggaagtgggagagccactgaagggggtacagatccaggatgtggctttgggagcttcctcgggctatgctgccgggaggagagtagacaggggttctgggtccagaggcccatctgtgctgtgcatcaatctgtgtgaagggcagggccacaggggcgctctggaggtgggcacctgggcgcaggcttgctgcagctgtgtgcctacagggtccttgtgtcttgagtgttgggcgcagctcacagctagcgaggctagcacctggaccccgttgtcatcatctgactcagcactggttgcttcatgggcccttcttccttcctgataggaagaggtgccctgaggtgccctgtgcctcctgaggacagtggctgcccccaggttcagggctctgctcctcagcatctccgtggggctcatcgtgggcctcgcactcagcacatccgaactgtagcccaaccttccttcctcaaatctgctcctccccatctcagaaaagccagccccactggtccagttgctcaggcaaaaacaagtgaaagaaagcaaccccctccggagtgccccaactcccctctgctctgtccccttccccagtgtagctgcaccataggaaccgctcccctgccctgcagtcctccagccaggtgatcctttagagcaagccagattcctcccctccggcctgggccagtgcttcccccagcacatgtctccgctcaggccctgtctccttcagggctggcttccggtgccgcccgtt

SEQ ID NO: 91287 - DNA, 1023 bp, Homo sapiens
cacataaaatctcttgatcactacgttttacattaaggcttctcaagatgggcaggacgggcttatgggatttgtcctgaactatcacatcacttccaaataaacttggtgcccgggacggctgctgtggagtgaatggcagacgctgtccctgggccacgatgccatccctctcagcatgttgggctagatttccactggttttgtttactttagacagtttttataattaaatatttccctgaaataatgcctgcaatcattttgagccacatgctctttttcctgaattaaagatctcttttagaaagtactgagactcttaaagcctctctcctttaaaaagtgagcttaacaaagtttttcattttagaaacttagaggggccagtgaccctgctgtgtgcggtgtatgtagaggtgactggagcctgtggtgcagcaacagtcccctgtgggctggcgccacacaggaagtgcctgcagctccacagccctggggtgagcctggcgcctccattttctgacagtacctgaacctttacctcccttctcaaaatgaaggctgcgtgtcacaaaccggttggaactggccgttgccatggttttcacgttggaaggcacagttaaagggtcatgtgaccaaggagggaaatgcctttgtcacatgactttttggtggcctgattagcatacaggaagttcactccctgctggctgctgggatgctgagtgatcattgatgggtggtgacatcatctcttggatgagttattgattagtcgcaggccaagatggggccagggagcgctgtgggcagagcagccctctcaggcagcttcagctgctaggtggtctggacccctcgcctaccctcttccttcaggcaggtttgaattttattagacatctcacctctggaagaagcacacgccctcaataagatgataagaagggttaagtcccttagagcttggctgtcatttcatttcagctcatgctagcccaggaattgtgtctgtaa

SEQ ID NO: 91288 - DNA, 1352 bp, Homo sapiens
tttctttgtcacttgtcgaaaactcatggagggacaccaagtctgtcactggcccttctctactggaacatgcagctttaaaaagtgcccagagtcaccgttttctcactgagattgagatctccctgtctgggccatgggtcctttgcctcagcagtgctgccaccatcagccattctgtcccctagagggcacagcgggtgccaggatactgcgtgggtgtcagggagcagccaagaagtgatgctgagagtagggggtggggctgctggaaaatctcttctaggcccatgtagaaattgtcacttcccactgcagatggggtcactttcagccttcaagcagaacctctgagcgcctgatgccgtagaggaggaagacagtcagtcctcttcggcagcattaaatcttggcaactccgtgtgaggagagggaccggcccggtggcccctcacctcctggtgtcctgctctcttgcagcccacaggttctgttgggagcaccgtgaccacccctcccccgcttgttcggggcactcagaacattcctgctggcaagccatcactccaggtcagtgtcctttctgcgtctcactgggtgccctgctggcactgctgctgtcaagcacaggctcctcgggctcccaaacagccctggcccaggttctgcaagaggttgcgctttccttctgagtaggctggagtgaggccctccagcccacagcctaggggaagaagcacacgtgcactttccaagccccacggcccaaagtaggccactgttaatgtcacagacagaaatcatggccaacactggaagggggctttccagtgagcgcccctagcaagcctgatctcccttcgtgttgactcttccggccagagagcctccttccagggcctccaggtgaggggcagaggttttctcccagccatatggctgaggtcagaagaggccctcctgcccctccctctcaaacaggcctgagccctcagcttgctctagggggtgaccatgcccatcctgccgtgggccggccagtgtcacgtgagaatgaactgccacgttggtgggactcactcaggagtgagcccaggtttgcacggctctgggtggagtcactattccttgttccagtatctagaatcagtagtcatctttcttaattttgtgttatacgtttgccttgttagtttgtttgagacagggtcttgctctgttacccaggctggagtgcagtggcacgatctcagctgactgtagcctctgccttctaggcttaagccatcctcctgcctcagcctcccaagtagccaggattacaggcacacaccaccatgcctgggtaattt

SEQ ID NO: 91289 - DNA, 1101 bp, Homo sapiens
tgcaggctgccggctgacaagtactgcttgtcttcaaggtcttttctgaaagccacgttgagataccaaaggggcgtttggaaaaatgttcttgctaaatttggagaggaacaagtttgaaatcaagttttttgttctcgtgttgttttattttaatgcttctccttcccaccctcttgtagactcgaagctcccttttggcaatttttgttttcttggaagttctttgcaattcactaaacgcattttctcaagatccccacttggcgcctaaagtccccaggggacgggcctgtcctgtggggctcaccctcggtcaccctgggccggccagcggaccgcactgactttgctttcaacccccgtttgtgtaggtcataaaaccccggcgtaagttggcgttccgctcaggagaggcccgcgactggagtaacggggctgtgctacaggtcagaaccgcactgggcgccgggagcctcgcgcccccaccgcagcccgtgaccacgtcagtcgccgactgtcacgctgcctcttctgtctgtctctccctgtttctgtttcactctctcccctcccccacccctctgtgtaacttacctggtctcctgattttggactttagggaccccatgtgggtgggaagaggtcagccagagcaaggagaggctgcgctgagtgtctcgcctgctgctgtcttttccctgcatgagccgtcacccccctttctccactgcaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggtgggtgacctccacagggctccccaggggacctgcccattgtggggttcacccttccttaaccgaaacagaggcacatgtgcagcgggtgaacccccaggcccgcttcccaagctcagcctcctcggactctggctttccctcttgcccctaaccaggataccctgaa

SEQ ID NO: 91290 - DNA, 2315 bp, Homo sapiens
ggctggggtctaggcagctatggctgggctcctcccaggagccctcctgacgagggccttctcagctggtcgctctgttctgttgcaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccgg

SEQ ID NO: 91291 - DNA, 1205 bp, Homo sapiens
tagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactggacttttcttttgtcccttctgccctggcttctctgtattgtttcgtcctagcttcccaggcaggttggagggagatggaggatgacccttagttaatgagagaagcaaagggcggggtgcatctgctgctggggcctcacttactgtggggatggagtccccacggcccctctcctctggagctttgtggcaaacttaccccatgggctgggagagaggaatgagaatctcagtgggggctgggtttggtggctcacatttgtaatcccagcactttgagaggctgaggtgggtggatcacctgaggtcaggagttcgataccagcctggccaacatggtgaaaccccatctctactaaaaatacaaaaattggccggatgtggtggtgggtgcctgtaccccagctacttgggaggctgaggcaggagaatcgcatgaacccgggaggcagaggttgcagtgagcca

SEQ ID NO: 91292 - DNA, 1477 bp, Homo sapiens
ttgggaagggacgccctccgcgcagaggctgagagttccgcgcaggcgcaatgcttccgtcccctctggtctcgccctctcggggcctggtcgcagggaatcgcggatgcgcatgcgcctccagctcccgggatcgcggggaacgtggattccgaacaagggcaactgcggactcccccgtgggaagaaagggagggaagcggaagggaaaaagcgcatgtgcagcagcacgcggcagcttcgcatattccctcgaagcgcgcctcttgcgcgtgcgccgccctggcccagtgcccttggctgcaggaatggctggaaccacccggcttctagccggagtccccggcgcgcagccagcagttgcgcgctacctggcccgcggagggcctggcggacgggctgaactgcagcagctcggcgatcagggccttgcagcgctcggacagctcgaggccttcgggatagagcacgccgcgtttctggcgccggggcaggccggcgatgtccgagtcgtcgaagggcatgcacccggtgaccatgacgtagagcacgacgcccatgctccacacatcgtacttcttggggtcgtaggggatgcccaggagcacctcgggtgacgcgtaggcggctgagccgcagtaggtggtgctcaggtctgggtagccatgggcctggcggccgaagccgaagtcggtgagcttgacgcggcgctcgtccgggctcagcagcacgttttcgcacttgaggtcgcggtgcaccaggtgatgatcgtgcaggtagcgcacggcgccggcgatctgcgcaaagaggtcgcgcgcctgaactccggggatgcgcccgttgcgctgcacggcttgcagcaggtcggtggcggccgcttccatcacgatgtacagtttcccgttgcacacctcgatgaactcgaagacgtgcacgatgtgcgggtgtcgcacgccccgcaggatggacagctctcgcggcaggaacttgttgacgaagtccgggggcgctcgccgccggtccaccaccttgatggccacggtacccttgtacttcttggatgtggccaccttcaccttggagtagctgccctctccaattgtgcggcccagcttataaccgagttcgctcagaagtttgtctcccgacatggtggcgcctagggcgcacggggggcaggaggcggctgctgtcggggggcggccggactccaatctcgggtctaagccatggcgcttggcacctacacccccgcacccccatgtgcccactgccagacattggccgctgttgtgccttttattgccccgtaacaatttttgccttgtgaagtgactgcgggcgtcactccgccttagggtgggggtccgggaccccgccccggggccaccctagcctccctgctttgtgactcataatcatcctgaatggtcagtttccgatgagaggccactagcaagggatacccatcaccacc

SEQ ID NO: 91293 - DNA, 1888 bp, Homo sapiens
ccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggtcagtatcactctgcgccggggtctcagagtctgggcactcggggctcgggggcggggttccggggacacaggcgggcctcagttttcccggcggtgtgaccggaggcggagcccggggatccatcatagcttctgtaataacgctaagtgctgcagtttgttgaggtctttcccagctcctcttccttctcgtaacagcccaggaaatcggtccctctagttatttacgttttacagtgggttaaactgagtcatagcctgtgctctggccctcagccacccttggatttctaagatggggaaactgaggcccaaagaaggccgcggctccccaaggcaaagctgaggccgcaacccggaacctggagggaatttacaagatgttctatgcagtggttccctgctggcagcccccgcctgcatggtgtcacaggaatccatattctttaaattttcaattttttttttttgagacggagttttgctcttgttgcccaggctggagtgcaatggcgccatctcggctcaccgcaacctccgcctcctgggttcaagcgattctcttgcctcagcctcctgagtagctgggattacaggcatgtgccacaacgcctggctaactttgtgtttttagtagagacggggtttctccatgttggtcagggtggtctcgaactcccaacctcggatgatccgcccacctcggcctcccaaagtgctgggattacaggcgtgagccaccatgcccggcgtaaagttttcaaatgtttaagtaacacgttaaattttgttatcgggctcagcacagaaaattgaaaaagagaacttaaaaggcgcccatactcagtccccaggttaacagacaaatagaaacttttaaacgtaatctaagagtgaatacatacatttctttttttttttttaagacggtatggttctgttgcctgggctggagtgatttcttggcaacctccgcctcctgggctcaagccatcctcccaccccagcctcctgagaagctgggattacaagcatgcgcccagctttctgtattttctatagagatgggatctcgccatcttgcccaggctggtctcgaagtcctgggctcaagtgatccacccacctcggcttcccaaagtgatgggactatcggcatgagctaccgtgctcggcagaatgcatgtctcttaacaaatcaaactttacatttaaattacatgttatgcacattattcctcaattttaacacacacacaaaaatgagcatggtaattaaaaacgtaataattcagacagtagaaaaatcagtgtgaggtgaaaagtcctccccagccccttcttggtttttttattttttattt

SEQ ID NO: 91294 - DNA, 1126 bp, Homo sapiens
tggcctaggtccttcctggggtgcagggcagggggcttcaccctgcagagccaagaggtagcacggccacccctagagtccggggggtggctgggcagcccccacagggcactgcctgtccctggcagctgtgtgcagcccccgcagggcagcacgcggaactgtggcccaggtggccgggagccaccatggacactgtcagaactgcccttccacttcagggccagcctgccgcccagggtccaaacagccttctagaacacgatggacctggggcccccctagcaaccaccatctagaccctcaggcctcctgaggttgctgcctggcttgtacctttcagaaaacccctggcatgggggcagaggtgtcacagtccaagcagcctcactcctgagaagccgccagtgtcccctgattgcagagtgggcagcgcctggagctgtggaggagggtgtctgggggcgggctggcccgctgagcagcgcctctcttcacaggctacagcatgctggccatagggattggaaccctgatctacgggcactggagcataatgaagtggaaccgtgagcgcaggtagggcccctggtgggcgttgtctgaaagtgcccccccggcgagttgtcggggtcctgtagcattccgctgttgtctgtgctggcgaggggtgaacgggccccttggacttggctgtgcaatcccaggccccagaaagtgcagatccagacccagcacttccacttctaggctctgtcctcgagatgtctccatgtctgcaatcccagcactttgggaggccaaggtgggagcattgcttgagcccaggagttcaagaccagcctgggcaacagagggaaaccctgtcctcgccaccccaaaaaatgtgtctagtgaggagggttgggacccgtggatccagattaggacaggatatgagtggggggcctgcctcgggccctctaagcaggattttgtcagaggtgaccaggctcaaaccagaccacaccaggcagtggacacacagggccagatgaactagggccaggcgcccccctctccctgtgtcacaggctgggcactccttccccacccctcccccaaccccaacgcaggccaggcagga

SEQ ID NO: 91295 - DNA, 1439 bp, Homo sapiens
agcaccctggcccctgaggtctgtgctgcctgtgctcccccgacctagcctggtctgacctgagtgtgggtttcgggctttcacaggcgcctacaaatcgaggacttcgaggctcgcatcgcgctgttgccactgttacaggcagaaaccgaccggaggtagcaccgcaggggccaaggttgggaggtcactggccggaaggccccaggctgcagggcctgacctgcatccccgaaggtggccagaatgcacgtgggggccatcgccctgtgccgtcagctgcatcctcaggcgtggagacttagtggagacccaagggggcgaaccggaaggcttcctggaggaggaggcagcactggggttggggcaagagaaaagctaggagttggctgggggaaaaggagacagggtcggagggaggcttgaaggggtgctactaggggccctaggcaggggcccctcagggcactgaggccccacccccaccatcggccccatccccacaggaccttgcagatgcttcgggagaacctggaggaggaggccatcatcatgaaggacgtgcccgactggaaggtgggtcccggctgggagggcagaggtgccagccacggcagagacagggcctggggttggggagctcccacagctttctatagaaaccccaggaccaagggggtggtgggtgccaggtcccacaagggaaggctgtagcgcctgccacgcacaggggccactgatcctgggggatgggtcctagcaggctgtatatgggtggctgtgcctctacccataccccactgtccccacaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctggcctgcctgttttcctggggactgggggaaagaagggggagagggcccagctaggcaccaccggatcacatgtagcatggggacgcagcagatatgcacagggtgacctcaaaacacacctaggggctgcccctggatccactggcggcctcctctctgcctccgatatacctggactctcctgcctcccttttgaaaccatgcctgtcagcagcccacttacctctccaggctgggggcccctgggtcagctttgggtcagaccttctccacggaggtctggagagtggggggagccttgacctcccggatacaagtgatcctcccgcctcagcctcccgtgtcactgcgattacaggattacaggcgtgagccaccataccttgtgcagccctgccaattgtaggcatggcgagggtatttgtctgcggagggg

SEQ ID NO: 91296 - DNA, 1221 bp, Homo sapiens
gcggtggagtgggacttcccgctggcctagaaaacttcagctagggctgggggcggtggctcctgcctgtaatctcagcactttgggaggctgaggctggaggatcgcttaaggccaggagtttgggaccagcctgggcaacatagcaagatcccgactctacaaattaaaagaaaaagaagaaagaaaactcgagccagaagaatggagggtagattcagggtgggactcccagactgtttggggtggcctaaagcctataggatcgaagtgagacgcgagacaggacttccagccacctaaagcgggtccgagcagcttgaggctggattccaagtgacacttccctcaggcagcttgggatgcagcttggaggactgagtgggctcggggagggagttccagcaggccacggggaacccaggacagcctgaggacggaggcacagccagacgcaccaaggggggcgacccagaggggttgctcgagcgccgtcacccagggccagggggcgtggcctgaatggggcgtggccagggcgggatctgcggtcgcatcccgcccccactctcagtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgaggtgaggcgcctccagcccccgcgcccagcccctgaggctcccgagggcctggcagccggccttgggtgaagccgcactcggggagagaacccagggacccacgcgcttccccggggactgggtccccttcaccagtcggatccccgcgaccacctggggcgcggagcgggcctcatccattctcttccttggctaagccgggagtgtggataagaacctagggttcctcccggggtttggactctgaatcaccggccaggtctcccaccctggaccgaaggggtcggaactggcccctcccacctaactcccacacacgcactcactccaaccgctggagaaagaaatgcccatccctggaacactcaatggggcgggggacgggcccacttctcaagtgaggagactgaggcacccagaaggaaggggcttgtctgacctcatcactctgctgggagtatcttggacagctcctatcttggagaagccagtctagattc

SEQ ID NO: 91297 - DNA, 1003 bp, Homo sapiens
tgggcagcgcgctggaggagagtgtatggcagcccttggggctagagctgggttctggcctctcagagcctcaattttccctcctgttaaaatggggatcatgggccaagcacggtggctcacgcctgtaatcccagcactttgggaggccgaggcgggcggactacctgaggtcaggagtttgagaccaacctggccaacatggtgaaaccccgtctctactaaaaatataaaaattagctaggcctggtggagcgtgcctgtaatcccagctactcaggaggctgaggtgtgagaatcacttgaacccaggaggcagaggctgcagtgagccgagatcgtgccactgcactccagcctgggtgacagagggagattccgtctcaaaaaaaaaaaaaaaaaggggggggatgatcgtggctgcaccttgcctaaaaggaggctcccagcggtccccatcagtagcagcgtgcttccttctccccactcctcacccacagacgccacccccaccgaggagccaatggcgactgcactgggcctggaaagacggtccgtgtacaccggccagccctcaccagccctggaggactgggaaggtgagttagcctgcctcggagtcccgtctctgctgcgggcttgttgggggtggggcttgggctactggggtcgtgtgaggagagggcacacactagacgaagggcccggcgccgtcctggtccccggacatgacagcccctggaggtgatgccccaagttcaagatctaagtgagaggccggtcagacagaggcaagagctcagcgcaccgggatggaccaggtcaggccctgggcggcagaactggggtcgcggggaacccagtctgccctgcacctgtttcaggccgctggctcgggtcgtgggcgcgctcggctagccggtgcccaccgggggagggggctgagacagcaagtaaggcctttgcacgcatgcatgggggcctacaggccgccgccctggtc

SEQ ID NO: 91298 - DNA, 1897 bp, Homo sapiens
ggccagctcagatccaggctctgcattacaaatgtgggactccagcgctctccccgttcatctgtgaggcaggggtgcaagtgtacccacagagagacctgaggacttcctgagcgatgcagatggaatgcgaggtcccagaggtgatgctgtggagtgtgagctccctgagggacacagacggagtgtgagctccctgagggttacagacagagtgtgaactccctgagggatacagacagagtatgagctccctgagggatacagatggagtgtgagctccctgagggatacagacagagtgtgagctccctgagggttacagacagagtatgagctccctgagggatacagacggagtgtgagcttcctgagggatacagatggagtgtgagctccttgagggatacagatggagtgtgagttccctgagggatacagatggagtgtgagctccttgagggatacagatggagtgtgagttccctgagggatacagatggagtgtgagctccttgagggatacagatggagtgtgagttccctgaggtgactgaggtggagtgtgagctccctgagggatacagatggagtgtgagctccctgagggatacagatggagtgtgagctccctgagggatactgatagagtgtgagctccctgagggatacagatggagtgtgagctccctgagggatactgatagagtgtgagctccctgagggatacagatggagtgtgagctccctgagggttacagatggagtgtgagctccctgagggatacagatggagtgtgagctccctgagggatactggtagagtgtgagctccctgagggatacagatggagtgtgagctccctgagggttacagatggagtgtgagctccctgagggatacagatggagtgtgagctccctgagggttacagatagagtgtgagctccctgagggatactgatggaatgtgagctccctgagggataaagatggagtgtgagttccctgaggtgattgaggtggagtgtgagctccctgagggacagagatggagtgtgagctccctgagagatacagatggagtgtgagctgcctgagggatacaggtggggtgtgagctccctgagggatacagatggagtgtgagctccctgaggtgattgagatggagtgtgagttccctgggggatgctgtggagtgtgagccccctgaggtgacgtggtagagagtgtgagctccctgactctatagcctggtaggcagccaccagtgtcctctgtggaactgggggtgaaagagggagacactaagaccaagaggctaagaaatatttccgaaggttttaacatggaaacagtaagtccaggcagcctatggcagcaagccaggtccaggccatacccccgtggcagcatgagtgtgtggaacagggcctgggtgccgccctcccacctgggcaggcacagccccacagcctctatggcagcaggaatggcaggtgctgacccacagcatggcttgctgcatgtcaccacagccctccctactttgcagttggaggggctgagtttctagtccttcaccaccatgctctgctccaacccaggctaagtccagtcaagtctctgtgacagagagcaattggaacccctcggggtcacgcaggcagcaaaacatcctgaggtcatagtcacatatgactttgctcatcgggatctgctgtggtgtcagaaacaaggccagagctggagcaaggggctgcgcctctgggtcttcaaggcccctggagaagcgtgagacatttggcccccaaggaacaattgtctggaggacaaccagggctgcttcaaccaggatggagcctctggggcctcccatgtggatcaagagaa

SEQ ID NO: 91299 - DNA, 1044 bp, Homo sapiens
tgttggccgaggccaactccctggtcaatgctgctgtgtactcttgccgagatgctgagatgcgccgcaccttccgccgccttctctgctgcgcgtgcctccgccagtccacccgcgagtctgtccactatacatcctctgcccagggaggtgccagcactcgcatcatgcttcccgagaacggccacccactgatggactccaccctttagctaccttgaacttcagcggtacgcggcaagcaacaaatccacagcccctgatgacttgtgggtgctcctggctcaacccaaccaacaggactgactgactggcaggacaaggtctggcatggcacagcaccactgccaggcctccccaggcacaccactctgcccagggaatgggggctttgggtcatctcccactgcctgggggagtcagatggggtgcaggaatctggctcttcagccatctcaggtttagggggtttgtaacagacattattctgttttcactgcgtatccttggtaagccctgtggactggttcctgctgtgtgatgctgagggttttaaggtggggagagataagggctctctcgggccatgctacccggtatgactgggtaatgaggacagactgtggacaccccatctacctgagtctgattctttagcagcagagactgaggggtgcagagtgtgagctgggaaaggtttgtggctccttgcagcctccagggactggcctgtccccgatagaattgaagcagtccacggggaggggatgatacaaggagtaaacctttctttacactctgaggtctccaaaacatttgttgttatcaattcagtgtttctgtccctgtgtcccggaattgtctaccttggcccaagtccagaaaggatctttcaacatggtatctccttggccctgtgctcgctcttcttcagtctggctggctgttattccatctctctctttttttttttttttttttttagacagagtctcactttgtagcccaggctggagagcagtagcacaatctcagctcgctgca

SEQ ID NO: 91300 - DNA, 1045 bp, Homo sapiens
tgcccggatgggttcaggaccccagcccttcactccccctcccccttttgatccctcaccccagacgcctgggggagggggcccaggaaggggaagtgactgcttctgcttctgatttttgtgatgggggcagggtgccacgactgctgagggagagggcaacgcggtaggatccccacagggcccctctgtagccctggggagtcggcagtgctggtctaggccccttaggagagggggcaggggggcagcagtagaaatgtggcggggtccgacttggtgtttccggccgtctttgtgtctgtgttgtgtatgtggagtgtcattcggtctttatgtccctcacggcttcagtctctccatgtgtgtttctgccccaggctctgcctggctgtcccttgtgtatttccatctgtctagcccgtggttccattgtcagaccggctttcttctcgggacagcctggttgcatctggggcatctgttttgttggtttgcttctgggtgcaggcagacccagggagtgggtgtctctgttccccgagcagctgtctctggtctctggtggtgtgtgagtccatctgcctgcctcgagttggccccaaccaagccccccccagccctctctttctctctctcactcttccctttctcttccaccccctccaaatgagactggttgaggtgccgtgggtggagggaggcagtggttagcccatgtattacactcccctcccctaggactccccccaggtcctgagggcaggaagaggtacagtgacatcttccggagcctggacaacctcgaaatctcactggggaacgtgtgagtctgagcctggatcacccccaaatcctgccaagatgccccaagcccctaaccatttaggtgccttgcagtcccatttggaacctgtaacatctggacctacatacctaataaccagagaagtctaggatgggaccctccaaaatgcctcggtatcctaaaagtgtccccctaaatagactggaaatccccaaagtggtcctagaacccctacat

SEQ ID NO: 91301 - DNA, 1049 bp, Homo sapiens
gttttattttgagactgtctcgctctgtcgcccaggctggagtgcggtggtgtgatctcatctcactgcaacctccgcctcccgggttcaagcgattctcctgcctcagcctcccgagtagctggaattacaggcacatgccaccacccctggctaatttttgtatttttagtagagacggggtttcgccgtatcagccaggctggtctcaaactcctgacctcaggtgatccgcccacctcagccttccaaagtgctgagataacaggtgtgagccactgcgctcggccaaaatcagtttagttttgacctatctcgtgttgtgtgttttttcattgcatttgttgtgggggtttattgttggtggtttgttttcttaaagtagtttgtagaaagcaacacgggcactctctgaggtctccttagggtgtcaggtgaaatggggaagtctgggaactgtcctcacgggagccagctgggggacttcaggaccagtggctctgaagccagcaatcttcccctccgtggagcctgctcctccgggtctgacaccctcctgccccccaggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggtgagtcccaagaggggaggtgctgcaccccatcctggccagggctgacagcctgctgtctaccctgcaggaccgcctgagccaggtgctgcgagacctcgaggacgagagtacgcccattgtgaaactgggggatgccagcatcgcagcacccttcacctccaagctctcatccatccagtgcagtgagttgcctgcccccgctccccctcccttcattccccccttggcacccctacccacacccacacctgcctccccaccaccctgcagtctgccacgtgatcaagcagggccgctgcacgctggtgaccacgctac

SEQ ID NO: 91302 - DNA, 1007 bp, Homo sapiens
acctcctgtgtcccacagtgccaggttgaatggttgtgattttgtcctccttgccccgcctccagcttctacctttggagactccaaatggcactcagtctgtccactgctgtggggacccacccagtcctggctcacgcagagcacacgcagggcttacctgccccagtcctggtgtgtccctagctctactcttttgccctggtcttgggcagggctaggtggcatcctcagccctctcacccatccatcctccacaaagcccaccctccgcctccaccaccggcacatctgccgcttggcttcttcctgggctctcgttctttctgcttgcaccctacagctgcggatccttccagaatttagcctcaggttgcagtactgtgtgcagagcccaggccacagctcacagcctgcatgctctgccccgttcctgcacctggagcccccttcccagtgacacaggtcctcatcgccttcatagtggccacttctgaggcctttccaccctctctggattccattctcacctcctctctcatggcactcagcactccgatttctgtgactttcttgatcatgcgtctcccctggtgcagtgtgagctccctaaggccaggggtctgtgcccagtctgtggtatgtggtggagccccagtgagtaagagttcctggctaaactccaacattattgggagagtccctacttcattgacttggaagctgagccacaagggactctgtgatgtgcccatgtccgcaagcaggacatagagccacattcgggggacccagaccccccagtcactgccagatcccacccctcaagcgtgcctggtaccctcctggcatttctcccctcccaaccctcgcatgtgcccactacgggaacagggccttccattgtccccttggctcccagcgcatggtcagagctcaggaaatgcagagtgtgggcagagggagggacagatggtgagggtgcccctgtctgtccgcaggcccgg

SEQ ID NO: 91303 - DNA, 1028 bp, Homo sapiens
caaaggtcacccagatggggtttctgggaagtcgagagacaggtggcccatccaccccaagcccttgcagtgagggcccgtcagaggccctgcctcgggttcatttccaggggctccccacaaagtcctgggtgtcagccatggtagcggcacgggggctcagctcaggcctggaacatcccacaccagccatgcaccacatgacccccaggcacaatgcctggcttctgggggcatctgtgaagcaggtgcaggtctcataaagacccagttggcgcccaagccaccccagtgacaagcacggaatgaatggccttgggggtccttctgctggtggggatgcagcttcgccctacccgcctgcactctgtaaccagctgttccccgaccttgcagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaaggtgaggggctggggcctcaggcccagcaagggggagccactggctctcacagccctaggcaggtgggctgcacccctcagagcatcttggggacaggcaggcctacagctctgatgctccccgaggtgggtggccagaggctcactttagacccaggataggccacgtccttgggtgtccctctgggttggaatctgccctgccctggccgaagccacagtgccagggtcctccaagcccaggtcttccagctctggaccaacacctgctctagcccagagccccgatcaggccctgggggaggcaggagggaggtgggggaggccggggtgagaggtaggggcttggctgcctctttggagcaaagcccctcaggactcgtacttatttgtttccagatgagaaagtattcccccgaagtattaaaactcaggggctgaaaattcaccagcgctttcattttgccagtgccct

SEQ ID NO: 91304 - DNA, 1368 bp, Homo sapiens
gaagctcgccagggctcccgacgcccacatatggctcttggtttcttgagagcggcctgccatgctcaggttggaggggtcagggtggagactccataccccagaggccttgccctgggaacaggatggggcctggtctcttgcagggccgagatggtggtgcctgacttctcggagcttttcaaggagagagccacagcccccttctttgtatttcaggtaaagcagcagctctggcccatctccccatttcctcccttggggctttcctaaccggatcaagcctgcccaccacttctaaacctggaagcctctccccaccctcacatatcagatccggtgggtggaaggggctcatgggaacagggcgggtagggcaaggacagacaggctggtatcccacaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtgtggctgccagggagacccaggttgggggtgcagcacaggtgcggcttctgtgctgacacccatgccccgcccaggtctaccgaagccgcaagtggaggcccattgccagtgatgagatcgtaccaggggacatcgtctccatcggtgaggccgggttccgctcagtcccagtgggagccccagcctcagggcctctggccaaccctcctgcctctgccctgcaggccgctccccacaggagaacctggtgccatgtgacgtgcttctgctgcgaggccgctgcatcgtagacgaggccatgctcacgggggagtccgtgccacagatgaaggtacttggtggaggatggggatcctcaagctgttcaggaggaaacaggccaggaggtggaggcccagggggtggcggggatccccctcaggcacaggcggaggaggcagtgtgggcacagatgagctctgtggactggggagccgggtggtgggggcgaggaaggaggtgagagagccaagggcatccagggtacattggtgccctgggatgtcagaccaaggtgggctgggagcagtccagaggggtgagtcccagacgaggccaagtgcaggccccagagagcaggcactgtgagtgcaatggggagaagacaggacggggtgagggtgaggatctgggagctgggtgggatgtattggtcgggtggggatccccctggctcattccagcctcaaggtccagctgtccaggaactcagatggagaaggaagcaaggtaggcctggccatccagattcacgatcttcctccc

SEQ ID NO: 91305 - DNA, 1038 bp, Homo sapiens
taaaatgtttatttgtgtagagatggggtctcgccgtgttgcccaggcttgtctcaaactcctggcctcaagcagtcctcctaaatcaacatcccaaagtgctgggattacaggcatgagtcactgcacccaacctaaacatttcagtcctcactgtttcgagtctacgcatctcagcgcttcagaatggtgatggaagaccgtgaccatgtctgcccttttgtactgagtacaatggccaatgtgcggtgcacaccctctcccttcatcttcaccaaaactgcaaatgctgacacgtggctgggagccggagaactgggctccaaaccccatcatggccttgttacgatggtcctcaacccagaaacccacagaacacctagggagctctttcctgacttaatcactgttcagagattacaaatatgttgactacaactatcaatctaatacaaggatttataagaaacatttagcaacttcccctaccccaaggttggccagtcacattaatggcctgtggcaactacgttccctttcatgctgttcttactcaacgcaaaggtacccagcaagatacaagggaagggcttattgtttgatagcagtggggttgctctttggtttcctcttctcacatcccatacataagacgtccatgcagttaaagggcagagcgagaatgaccctcgttgacatgactggtgccctgatcagattggactatggcacagagtactgcagaacacacccttaggcccaagtccttgcattctcgagccttttttttttttttttttttttttggagacagggtcttactctgttacccaggctggagtgcagtggtgtgatcatggctcactgtagccttgaactcctgggctcaagcattcatcctgcctcagcctcccaaatagctgggaccacaggcacacaccaccacccccagctaatttttaaattttttgtaaatagaaggtcttgctgtgttgcccaggctagtctctgactcctgggctcaagcactcctcctgc

SEQ ID NO: 91306 - DNA, 1452 bp, Homo sapiens
gccacccaggctggagtgcagtgttgcaatctcagttcactgcaacctccgcctcccagttcaagggattctcctgcctcagcctcctaagtagctggtattacaggtgtgcaccaccgtgtccggctcatttgtgtatttttagttgagacagggtttcgccacattggcgaggctgatctcaaactcctgatctcaagtgatccgcccaccttggcctcccaaagtgctgggattatgggtgtgagtcaccgtgcccagccttgtgctcccagctttaagtgtggcaccagaggcacagcaagatggtctcgtttgtcctgatgacagacgagggagtgacagaggcagcaccagagcccagtggcatttcagaatatacccatagagctgctgcacccaaaacctcccgggggggtcttggaactgtaggttgagaagagctaagccacaatgctttctttgtctctgtcaggagtacgaccccagcaaagcgacctttgtgaaggtggtgccaacccccaacaatggctccacggagctcgtggccctgcaccgcaatgaggtagggactgcctgctgggctcctggaggaggggcttgagtaggattcccaggcgctgacaccccaaggtcaggggcctctgtggcaaacacaccttctaccgcagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaagtgagtccttgatttgcctgtagcacctttgcctttctgtcctgctcccctcctgattcagggtgcctaggaagcgggacagaggcatctgcccttttatttatttatttactattattttatttttattttattttttatttttgagactgagtctcgctctgtcacccaggctggagtgcagtgacgcgatctcagctcaccccaacctccgcctccccggttcaagtgattctcctgcctcaacctgccaagcagctgggaatacaggctccccccaccacgcctggctaatttttgtatttttagtagagatgggggtttcaccatgttggccaggctggtcttgaactcctgacctcaggtgatcctcccatgttggcctcccaaagtgctgggattacaggcgtgagccactgcacccggccaaatctgcccttttagccaaatgtcccaggtgactgtgatgccgcttgagcaacatgctctaagtccagtctcccctgaacttgcctgctggcaggaaccccagagggtctgcagctggaagcccgtgccctggggtgtgagaccttgagtgtaaggttctt

SEQ ID NO: 91307 - DNA, 1486 bp, Homo sapiens
catagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggtaagtgtgtacacgcgagcccgacccccagcacggtcgagcctcgccgtgggtcccagctgcggccttcctgtcggtcaccatcgcgacctgggccactcatctgcctggcctggattcccaggggcaccctctacactttggcgcaggcttaatcatgaccccactgctgacttgctgtgcatgcctggtgcgggttatttcctttttctgaagtcctccctgttatggtcatttagattcagtgatgtaatacttgtaaaaggcttagcgcagggcccagcatacgtcgcccaggtcaggtaggagttgtttatactagttcccatattagcgactactcttgttctggaaacggccctaccttccatctcatctgtctcctaccttggttttcaaagtgtaaggcgagatcactgggataggtttcccccatctatgaagcttagttggttcttagactgaaccaagtcttgctgtccagtgcttagtggtcttccatactgtgatggaaaggagcatgaaatgcagttaattacagtgttgaagagaggcagaggtgtttatgagcgagtcatttacatgatgtctttccgcaaaatgagggtggtgatactgagttctgtcggggatacaacagcaagcaaggtcgcgctcctgacccacagtttagagttctgagtgaccaagtgtcgtcggaggagttggtgactgtgagcttccctgggcctgaagcagtgactgtgtcgtctctctctgggcctgcctcaggtgacaccagcaggtttggagccatggacactgaggtatatcaggaagcttcccctctgattccaggagtgtgtttgcctcaagaagaggaaaagggaacagcatcaagggctacagaaagacagaagccccccaccctggctggctctgaatgtgggtagaatcctcattctcctctcctgagagacaacctgttctgtccttcaaaaagacttatctatcccaggggaggagctcaacgtggtagctttgaggtagtacaatgaaagacaccaatgagggacaaaataaaggaggggttaaggggactgtggcaccgctcaaacttcagctgccttttgacctgcagctaagcagcttagctcttaacttcctctccagggatggagaagtgggaggagctgaacagccatcagccaggagaggtggatctgggtttgattc

SEQ ID NO: 91308 - DNA, 3350 bp, Homo sapiens
cccaggaggctgaggcaggaaaattgctggaacccaggaggcagaagctgcagtgagcctagatcgtgccactgtactccagcctgggcaacagagcaagactccatcttggaaaaaaaaaaaaaattagccaggcatggtggcactctctagtcccacctgctcaggaggctgagatgggaggattggttgagcccaggaattcaaggcttcagtgagctgtgatcatgccactgtactccagcctgggtgagagaatgagactccatctcttatttaaacaacaacaacaaaaaaattgactgttttgatcataactatggttgagtcttcttccagagcattgaatatattaactttaaaacaattcagacagggcagatatcctatactttttctgaaaatggttaaaatgtaattctcatacctactaataaatacaaaataattaaaaagccactaataatgtgctattcattttttacagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatcttataaattataacatttttctttaaaactggaacatattctcattatgctttccaaaggacatattgatttagatgtgactcattcttcagtggattctacagaagaaaccatatgagagctaatttccaattcagcaacagcattttttacttctgtagttatttttttctatccaatctggctgagtcttggttgagtagttcatgctgctatttgaggtctctgggtatgaggtagggatcctt

SEQ ID NO: 91309 - DNA, 1070 bp, Homo sapiens
ttctttcatgcactcgacaggaattagaagagttgaaggctttcccacattctttacatttataaggtcgagccccagtgtgtattattacatgtgctcgaaagcttgcagaataaaagaaggcttttccacattctttacattcatagggtttctctccactatgagtccttttatgccttcgaaaagaactgagaaaactgaaggctttaccacattctttacatttgtagggtttttctccagtgtgagttctttcatgagttcgaaagtatgtgggacaactgaaagccttaccacattgcttacattcatagggtttctctccagtgtgagtccttttgtgtctttgaaaagattggtaacatataaaggctttcccacactgtttacattcatagggtttctttccagtatgagcatgtttttgaaaagactggtaatatataaaggtttttccacattgcttacattcatagggtttctgtccagcatgagtcctttcatgtctttgaaatggctggtaatatataaaggctttcccacactgtttacattcatagggcttcactccagtgtgagttctttcatgtttgcgaaagcagtggtgataactgaaggttttcccaactgctttacatttacatggttgcttttcatattcctgatactcatttggtttctgtccagtgtgagatctcatgtgcctattaagggacgaatgatgaatgaagtctcttccacaaaagctgcattcatgtggttttgctccagtaaaagtttccttgttgatattaacatttggcatctggctagtggtttctccacatttgctacctcttctactttcacagagtctctcaaccatatgacatctgtaaaaaatgaatagcacattattagtggctttttaattattttgtatttattagtaggtatgagaattacattttaaccattttcagaaaaagtataggatatctgccctgtctgaattgttttaaagttaatatattcaatgctctggaagaagactcaaccatagttatgatcaaaacagtcaatttttt

SEQ ID NO: 91310 - DNA, 1067 bp, Homo sapiens
tgggacttgatgaccattgtttgtgtccacgttcaacggagttcaaatttaatatttaactattccaccgcattcacaactccttctgtatattgtaaatatagcactcaaaaatgtgcatgttcgtattcatgactttaaatttctactttattatctagaaaaatatcataaataaactgatgtagtggatctcatgctgctctttcttctcggagttagagaatacattagagaatatttctatgttgaaaattattttattggataattttagtcagtcctataagccagaaccaattgtctttactctctaatttcaccttaagtcaaattaaaagtctcgcccatggccacttggtaaaaacgtgtgtgtgtgtgtgttttccagggaccattgcaatttagagacgtggccatagaattctctctggaggagtggcattgcctggacactgcacagtggaatttatatagggatgtgatgttagagaactacagacacctggtcttccttggtgaggataacttgaatgtataattcataatgtaccctaaaggttttatttctcctttttgtgaaatgttttttagtaatttattttttgcgtaaaagagtttcagatgccctttttccagaaaatttttagaatttgttcatttagaaaagaatttcaagatgtttaatcttttttttttttgagacagagtctcgctttgtcacccaggctggagtgtagtggcacgatctcagctcactgcaacctccgcctcccgggttcacgctattctcctgcctcagcctcccgagtagctgggactgttggcgtacgccgccacgcctggctaatttttttttttttttgtatttttagtagagatgaggtttcaccgtgttgtccaggatggtctcgatctcctgacctcgtgatctgcccgcctcagcctctcaaagtgctgggattacatgcgtgagccactgcgctcagccaagatgtttaatcttaatccaaaatctccacatgcctgagttgagctgtgttcttcactctaaattagcggtaagc

SEQ ID NO: 91311 - DNA, 1300 bp, Homo sapiens
cgagtcgcaccgaaacaaatgctcttcacgatcattgttaaagtagcaatagcgccacgtgctttcctgggaactgctggcctgttttccactcatacaaagtggagaaggctttgaaatagcaaaggagggtgacataaattgaatacttatatgaaatttttaattaaaaatagcatttgatgttatacaactataagtgagactattagtgtgatgtcatattcttaattatattgacaaaataaccattcacagtattcctatttaaaataacatgttttgtcggctgtatatttgctagcttttggttaaatagtaccagagctcaatagcaatcaacaaaatgaatctttattttaccgcaagcattagtgatgcatatgcctgtttttcttaaagttcattagctttttgccttttccggttgcagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgtcttctctgtatcttttttcatttattggctgaagaacaggaggatgcggaagatggaagaaaatataatctctgaaagataatgaagaagctctcctaaatagaagaaaacctcataggggatttttttttcatcattttactctctgcttctatgcgtt

SEQ ID NO: 91312 - DNA, 1321 bp, Homo sapiens
cttgtttctcccttagctaagagaaccagacaaactccatcttggctctttcactggcagccccttcctcaaggacttaacttgtgcaaggtgactcccagcacatccaagaatgcaattaactgataagatactgtggcaagctgtatccgcactccccaagaattcatctgattgataacgcccaaagccccgcgtttatcaccttgtaatagtcttaaagcccctgcacctggaactgtttactttcctgtaaccatttaccttttaactttttgactacttaacttctgtaaaattgttctaactagacacccctccccttcctaaaccaaggtataaaagttaatcaagccccttcctctgggccgagagaactttgcacgttagccgtctctcggtcgccggctaataaaggactcttaattcatctcaaagtgtggcgttttcctaactcgctagggtacaacaatcagatcaaccaccaaagtgggaaacattgaaatcaaggatcttatggttggtgatgaggcaagtgaattacgatcaatgttagaagttaactaccctatggaaaatggcatagtacgaaattgggatgacacgaaacacctgtgggactacacatttggaccagagaaacctaatatagataccagaaattgtaaaatattactcacagaacctcttatgaacccaaccaaaaacagagagaagatggtagaggtaatgtttgaaacttaccagttttccggtgtatatgtagccatccaggcagttctgactttgtacgctcgaggtttattgactgctgtagtggtagactctggagatggcgtgactcacatttacccagtattagaaggcttttctctccctcatcttaccaggagactggatattgctgggagggatataactagatatcttatcaagctacttctgttgcaaggatacaccttcaaccactctgctgattttgaaacggttcgcatgattaaagaaaaactgtgttacgtgggatataatattgtgcaagagcagaaactggccttagaaaccacagtattagttgaatcttatacactcccagatggaggaatcatcaaagttgggggagagagatttgaaacaccagaagctttatttcagcctcacttgatcaatgttgaaggagttggtgttgctgaattgctttttaacacaattcaggcggctgacattgataccagatctgaattctacaaacacattgtgctttctggagggtctactatgtatcctggcctgtcatcacggttgaaacgagaacttaaacagc

SEQ ID NO: 91313 - DNA, 1104 bp, Homo sapiens
ttattagaaattcaccacattggccaggtgtggtttctccacctgtaatcccaacactttaggaggccaaagtgggcagatcacctgaggtagggagttcaagaccagcctgaccaacataaacaccatctctactaaaactacgaaaaaaattaccgggtgcggtgatgcatgtctgtaatcccagctactcaggaggcagaggcaggagaattgcttgaacccgggaggcggaggtggcggtgagctgagatggcaccatttcactccagcttgggcaacaagagcgaaactccatctctaaataaataaataaataaataaatcagactttattccagatcttctgggggaaaaaaaacctgcataacgatgtcttcagcttattgtacatattaaaactttagagatgccttctaactaaacatgtcttttccatctgaaaaatattcacaactcattctgtataatgtaactatagcactgaaaaatttacatgttcctgttcttgcccttaattttatactttattatctagaaacatacatgaattgatgttgtggatcttatgctgctctttcttctcagagttagagaatacattagagaatatttctgttttgaaatcattttattggataattttagtcagtcctataagtcagaaccagttctctttactctcttatttcaccttaagtcaaattaaaaattccgcccatggccacttggtaaaaatgtgtgtgtgtgtgtttttcagggaccattgcaatttagagatgtggccatagaattctctctggaggagtggcattgcctggacactgcacagcggaatttatataggaatgtgatgttagagaactacagtaacctggtcttccttggtgaggataacttgagtacataatataccctatagattttatttatttattttttgtagaatgttttttagtaatttattctttgcataaaagagtttcagatccccattttccagaaaatcttcagaatttgttcgtttagaaaagaatttcttcaacatgttttatcttaatccaaactttccactttcctgagttgagctgtatttttcactct

SEQ ID NO: 91314 - DNA, 1475 bp, Homo sapiens
ctctttgcattatgctcacctggggcactgcacacacttaactcatttataaattttccacaaatgtattttggtcagtatgtttttgttacatttaaatgtctatgaaggatttagggcctatggtattttgctgtgccatcttacttaatgtagtttgtttaattttatatattacatttgtaaactatcttcatctaagtctagcaagtggagtaatttgtcatttttgtttctttcagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtg

SEQ ID NO: 91315 - DNA, 1068 bp, Homo sapiens
tgaagaatgtggaaaaggttttaaccactccacaactcttactagacataaggtaattcatgctggagagaaacactacaaatgtgaaaaatgtggcaaagattttaaacagtcctcacaccttactaaacataagacaattcatgctggagagaaaccctacaaatgtgaaggatgtggcaaagctttctgccaattctcataccttactaaacataagataattcatactggagagaaaccctacaaatgtgaggaatgtggcaaagcttttaattggtactcacaccttaccagacataagataattcatactggagagaaaccctacaaatgtgaataatgtggcaaagcctttaatgtattcgcaacccttactagacataagataattcatactgaagagaaaccctacaaatgtgaggaatgtggcaaagcttttaaacagtcctcaaaccttactactcatgaaaattcattctggagagaaaccctacaaatgtggagaatgtggcaaagctttcttcagattctcataccttactacacataagataattcatactggagagaaaccctacaaatgtgaagaatgtggcaaagcttttaactgttactcctaccttactgcacataagttgattcatactggagagaaaccctacaaatgtgaagaatgtggcaaagctttctaccgattcatttaccttactacacataagagaattcacactggagagaaaccctacaaatgtgaagaatgtggcaaagctttctaccgattatcttatcttactacacataagatgattcatactgtagagaaacgctacaaatgtgaggaatgtggcaaagcttttaactggtactcacgccttactacacataagagaattcatactggtgagaaaccctacaaatgtgaagaatgtggcaaagcctttagtgtattctcaacccttactaaacataagataattcatactggagagagaccctacaagtgtgaagaatgtggcaaagcctttaatgtattctcaacccttactaaacataagagaattcata

SEQ ID NO: 91316 - DNA, 1050 bp, Homo sapiens
attcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaata

SEQ ID NO: 91317 - DNA, 1143 bp, Homo sapiens
gcatggtttctctccagtatgagttgtcttatatgtagtaagccttaaggactggttaagggcattgcaacattccacacaattgtaggaattccctccagtatgaattacatgaatgtttagtaaggattgaggaatagctaaaaggcttgccacattcttcagatttgtagggtttccctcctgtacaaattcccttatgttcagtaagcgttgagaattaattaatagttttgccacatttttcatatttgtagggtttttcctccagtatgaattcttttatgagtagtaaggtgtgaggaccagttgaagtctttatcacattcttcacatttgtagggcttctcaccagtatgaattctcttatgttccataaggtttgaggactggttgaagcctttgccacattcttctcatttgtagagtttctctccagcatgaattttcttatgtgtaggagggttgggaactgtttaaaagctttgccaaattcttcacatttttagaatttctctccagcatgaattttcttatgtttactaaagactgagaaccagctgaaggctttgccactttcttcacatttgtagggtttctctccagtatgaattttctatgataactgagggttgaggaccacttataggctttgccacattctttgcatttgtatggtttctctccagtatgaattaccttatgtttagtaaggattgagaacatactaaagcctttaccacattcttcacatttgtagggtgtctctccagtatgaattctcttatgttccataaggtttgaggaccagttgaaagcctcaccacattcttcacatttgtagggtttctctccagtatgaattttcttatgataactaagggttgagggccacttataggctttgccacattcttcacatttctagagtttctctccagtatgaattttcttatgtttactgaagactgataaccagctgaaggctttgccacattcttcacatttgtagggtttctctccagtatgaattaccttatgtttagtgaggattgagaacgtactaaaggctttgccacattcttcacatttgtagggtttctctccagtatgaattttcttgtgatatctaagggttgaggg

SEQ ID NO: 91318 - DNA, 4530 bp, Homo sapiens
aactgtatttatctgagtctaataagtaggctaatttgtgatttttatttcttttcagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttagtatgttctcaatccttactaaacataaggtaattcataatggagagaaaccctacaaatgtgaagaatgtgataaggcaactcatgctggagagaaaccctacaaatgtgaagaatgtggcaaagctttcaactggtcctcaaaccttatggaacataagagaattcatactggagagaaaccctacaaatgtgaagaatgtggcaaaagcttcagtacattctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataagtcatcctcaacccttagttatcataagaaaattcatactgaagagaaaccttacaaatatgaagaatgtggcaaaggctttagtacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagagaaactctagaaatgtgaagaatgtggcaaagcctataagtggccctcaacccttagttatcataagaaaattcatactggagagaaaccctacaaatgtgaagaatgtggtgaggctttcaactggtcctcaaaccttatggaacataagagaattcatactggagagacaccctacaaatgtgaagaatgtggtaaaggctttagtatgttctcaatccttactaaacataaggtaattcatactggagagaaaccatacaaatgcaaagaatgtggcaaagcctataagtggtcctcaaccctcagttatcatagaaaattcatactggagagaaaccctacaaatgtgaagaaagtggcaaagccttcagctggttctcagtctttagtaaacataagaaaattcatgctggagagaaattctaaaaatgtgaagaatttggcaaagcttttaaacagttcccaaccctcctacacataagaaaattcatgctggagagaaactctacaaatgagaagaatgtggcaaaggcttcaaccagtcctcaaaccttatggaacataagagaattcatactggtgagaagccctacaaatgtgaagaatgtgataaagacttcaactggtcctcacaccttactactcataaaagaattcatactggaggaaaaaccctacaaatatgaaaaatgtggcaaaactattaattaattctcaacgcttactgaacataagggaatttgtacaggagggaaaccctacaaatctgaagaatgtggcaagccttttagctattcctcaatccttactaaacattcatgtaattcatactggagggaattcctacaattgtgtggaatgt

SEQ ID NO: 91319 - DNA, 3851 bp, Homo sapiens
caaatgtatttggtcagtatgtttttgttacatttatatgtctatgaagaaattagggcctgtcttattttgctgtgccatcttatgtggtttgcataattttataggttagatttgtaaagtatattcatctgagtctagcaagtggaataatttgttatttttatttcttctagttatgcgttctcattttacacaagacctttggccagatcagagcacaaaagattctttccaagaagtaatactgagaacatatgcaagatgtggacataagaatttacgattaagaaaagattgtaaaagtgccaatgagggtaagatgcacaaagaaggttataataaacttaaccaatgcaggacagctacccagagaaaaatatttcagtgtaacaaacatatgaaagtctttcataaatattcaaatagaaataaggttagacacactaaaaagaaaactttcaaatgtataaaatgtagcaaatcatttttcatgctttcatgcttaattcgacataagagaattcatattagacagaatatctacaaatgtgaagaacgtggcaaagcctttaaatcgttctcaacccttactaaacataagataattcatactgaagacaaaccttacaaatataagaaatgtggcaatgcctttaaattttcttcaacgttcactaaacataagagaattcatactggagagacacctttcagatgtgaagaatgtggcaaagcttttaaccagtcctcaaatcttactgaccataagagaattcatactggagagaaaacctacaaatgtgaagaatgtggcaaagcttttaaggggtcctcaaattttaatgcacataaggtaattcatactgcagagaaaccctacaaatgtgaagattgtggcaaaacttttaaccatttctcagcccttagaaaacataagataattcatactggaaagaaaccctacaagcgtgaagaatgtggcaaagcttttagccagtcctcaacccttagaaaacatgagataattcatactggagagaaaccctacaaatgtgaagaatgtggtaaagcttttaagtggtcttcaaaacttactgtacataaggtagttcatactggagagaaaccctacaaatgtgaagaatgtggcaaagcttttagccagttctcaacccttaaaaaacataagataattcatactggaaagaaaccctacaaatgtgaagaatgtggcaaagcttttaacagttcctcaacccttatgaaacataagataattcatactggggagaaaccatacaaatgtgaagaatgtggcaaagcttttaggcaatcctcacaccttactagacataaagcaattcatactggagagaaaccctacaaatgtgaagaatgtggcaaagcttttaaccatttctcagaccttagaagacataagataattcatactggaaagaaaccctacaaatgtgaagaatgtgggaaagcttttagccagtcctcaacccttagaaaccatcagataattcatactggagagaaaccctacaaatgtgaagaatgtggtaaagcttttaagtggtcatcaaaacttactgtacataaggtaattcatactggagagaaaccctgcaaatgtgaagaatgtggcaaagcttttaagcatttctcagccctcagaaaacataaggtaattcatactagggagaaattgtacaaatgtgaagaatgtggcaaagcttttaacaattcctcaatccttgctaaacataagataattcatactgggaagaaaccgtacaaatgtgaagaatgtggcaaagcttttaggcaatcctcacaccttactagacataaagcaattcatactggagagaaaccttacaaatgtgaagaatgtggcaaagcttttagccatttctcagcccttagaagacataagataattcatactggaaagaaaccgtacaaatgtgaagaatgtggcaaagcttttagccatttctcagcccttagaagacataagataattcatactggagagaaaccctacaaatgtgaagaatgtggtaaagcttttaagtggtcatcaaaacttactgtacataaggtaattcatactgcagagaaaccctgcaaatgtgaagaatgtggcaaatcttttaagcatttctcagcccttagaaaacataaggtaattcatactagggagaaattgtacaaatgtgaagaatgtgtcaaagcttttaacagtttctcagcccttatgaaacataaggtaattcatactggagagaaaccctacaagtgtgaagaatgtggtaaagcttttaagtggtcctcaaagcttactgtacataaggtaattcatactggagagaaaccctgcaaatgtgaagaatgtggcaaagcttttaagcatttctcagcccttagaaaacataaggtaattcatactggaaagaaaccctacaaatgtgaagaatgtggcaaagcttttagccaatcctcatcccttagaaaacatgagataattcatagtggagagaaaccatacaaatgtgaagaatgtggtaaagcttttaagtggttgtcaaaacttactgtacataaggtaattcatactgcagagaaaccctgtaaatgtgaagaatgtggcaaagcttttaagcatttctcagcccttagaaaacataagataattcatactggaaagaaaccctacaaatgtgaagaatgtggcaaagcttttaatgattcctcaacccttatgaagcataagataattcatactgggaagaaaccatacaaatgtgcagaatgtggcaaagcttttaagcaatcctcacatcttactagacataaagcaattcatactggggagaaaccctacaaatgcgaagaatgtggcaaagattttaacaattcctcaacccttaagaaacataagctaattcatactagggagaaattgtacaaatgtgaagaatgtgtcaaagcttttaacaatttctcagcccttatgaaacataagataattcatactggggagaaaccctacaaatgtgaagaatgtggtaaagcttttaagtggtcctcaaaacttactgaacataaggtaattcatactggagagaaaccctgcaaatgtgaagaatgtgacaaagcttttaagcatttctcagcccttagaaaacataaggtaattcatactggaaagaaaccctaccaatgtgacgaatgtggcaaagcttttaacaattcctcaacccttacgaaacataagataattcatactggggagaaaccctacaaatgtgaagaatgtggcaaagcctttagtcagtcctcaatccttactaaacataagataattcattctgtagagaaaccctacaaatgtgaagaatgtggcaaagcctttaaccagtcctcacaccttactagacacaaaacaattcatactggagagaaaccctacaaatgtgaagaatgtggcaaagcttttattcagtgctcataccttattagacataaaacaattcataccagagagaaacctacaaatgtgaagaaagtaccaaagcttttaagcaatcctcacaccttactagacaaaacaattcatactggagagaaaccctacaaatgtgaagaatgtgccaaagctttttaaccatccttcaacccttactaaacatatgataattcacactggggagaaaccttagaaatgtgaataatgtggcagagctttcaaccattttataaaccttaatacacataggataatttatactagagacagaccctgcatatgtgaagaatgtggcaaagcttttaac

SEQ ID NO: 91320 - DNA, 1129 bp, Homo sapiens
tggctaaaagctttgccacattcttcacatttgtagggtttctttccagtatgaattaccttatgttttctaagggctgagaaatgcttaaaagctttgccacattcttcacatttgcagggtttctctccagtatgaattaccttatgtacagtaagctttgaggaccacttaaaagctttaccacattcttcacacttgtagggtttctctccagtatgaattaccttatgtttcataagggctgagaaactgttaaaagctttgacacattcttcacatttgtacaatttctccctagtatgaattaccttatgttttctaagggctgagaaatgcttaaaagatttgccacattcttcacatttgcagggtttctctgcagtatgaattaccttatgtacagtaagttttgatgaccacttaaaagctttaccacattcttcacatttgtagggtttctctccagtatgaattatcttatgtcttctaagggctgagaaatggctaaaagctttgccacattcttcacatttgtacggtttctttccagtatgaattatcttatgtcttctaagggctgagaaatggctaaaagctttgccacattcttcacatttgtaaggtttctctccagtatgaattgctttatgtctagtaaggtgtgaggattgcctaaaagctttgccacattcttcacatttgtacggtttcttcccagtatgaattatcttatgtttagcaaggattgaggaattgttaaaagctttgccacattcttcacatttgtacaatttctccctagtatgaattaccttatgttttctgagggctgagaaatgcttaaaagctttgccacattcttcacatttgcagggtttctctccagtatgaattaccttatgtacagtaagttttgatgaccacttaaaagctttaccacattcttcacatttgtagggtttctctccagtatgaattatctgatggtttctaagggttgaggactggctaaaagctttcccacattcttcacatttgtagggtttctttccagtatgaattatcttatgtcttctaaggtctgagaaatggttaaaagctttgccacattcttcacatttgtagg

SEQ ID NO: 91321 - DNA, 1038 bp, Homo sapiens
atagattgagaccaacattaccaagtgatttataagctcaataaaacttgagaggcaatgcttagttcagtggttgtaagcccaggctgctaattacaatcacatggccagtttgcagaactccctttactggtgcccttcccacaggttctgtttaatgttctgggtggaagcattcatgttattttaattaactgcctcatgtgactctaagttgtggccagaatcaagtatagggggttcaagatacatttatgagagttaagtttcacctgtgcactaaagggtagtcctagagcctcttttctttgggtttcatagggacagggcagtgtggctcatacttttgttactgtagcagaaattgctggcaggggagggcacctgaagacaggaaaggagaaacttgtatttttatatctgtagagcagctcattgttgctgaatctcttctgttataaagtacagaaatgggtggagttttttctgttttgggtcttctgcctgtgggtgtggtggtagcaggtaaacatgtggtgctgacacttttcaaggcatagtctcaagatgcggtgtaatttgtccagagaatcttatctgagaaggaatcctagaaaagaaggagaaagagaaaaaatggcattcttaatgatgaaatattgaatacttattttatttttattttactttaagttccaggatacatgtgcagaatgtgcaggtttattacataggtatatgtgtgccacagtggtttgctgcacgtattgacccatcttctaggtgccctccccttgccccccactccacaacaggccctggtgtgtgttattcccctccctgtgtccttgtgttctcattgttcaactaccacttatgagtgagaacatgcggtttttggttttctatccctgtgttagtttgctgaggatgatgacttccagcttaatccatgttcctacaaaggacatgatctcatttctttgtatggctgcatagtattccatggtgtgtatgtaccacattttatctatccat

SEQ ID NO: 91322 - DNA, 5858 bp, Homo sapiens
atgaagaaattagggcctgtcttattttgctgtgccatcttgcttaagcggtttgtataattttataggttagatttgtaaagtatattcatctgagtctagcaagtgacataatttattattttcatttcttccagttattagttctcattttacacaagacttttggccagatcagagcataaaagattctttccaagaaataatattgagaacatatgcaagatgtggacataagaatttacgattaagaaaagattgtgaaagtgtcaatgagggtaagatgcacgaagaagcttataataaacttaaccaatgttggacaactacccagggaaaaatatttcagtgtaacaaatatgtgaaagtctttcataaatattcaaattcaaatagatataagattagacacactaaaaagaaaactttcaaatgtatgaaatgtagcaaatcatttttcatgctttcacacttaattcaacataagagaattcatactagagagaatatctacaaatgtgaagaacgtggcaaagcctttaaatggttctcaacccttattaaacataagataattcatactgaagacaaaccctacaaatataagaaatgtggcaaagcttttaacatctcttcaatgttcactaaatgtaagataattcatactggaaagaaaccctgcaaatgtgaagaatgtggcaaagtttttaacaattcctcaacccttatgaaacataagataattcatactgggaagaaaccatataaatgtgaagaatgtggcaaagcttttaagcaatcctcacaccttactagacataaagcaattcatactggagagaaaccctacaaatgcgaagaatgtggcaaagcttttaaccatttctcagcccttagaaaacatcagataattcatactggaaagaaaccctacaaatgtgaagaatgtggcaaagcttttagccagtcctcaacccttagaaaacatgagataattcatactgaagagaaaccctacaaatatgaagaatgcggcaaagcttttagcaatttgtcagcccttagaaaacatgagataattcatactggacagaaaccctacaaatgtgaagaatgtggtaaagcttttaagtggtcctcaaaacttactgtacataaggtaattcatactgcagagaaaccctgcaaatgtgaagaatgtggcaaagcttttaagcgtttctcagcccttagaaaacataagataattcatactggaaagcaaccctacaaatgtgaagaatgcagcaaagcttttagcaatttttcagcccttagaaaacatgagataattcatactggagagaaaccctacaaatgtgaagaatgtggtaaagcttttaagtggtcctcaaaacttactgtacataaggtaattcatatggaagagaaaccttgcaaatgtgaagaatgtggcaaagcttttaagcatttctcagcccttagaaaacataagataattcatactggaaagaaaccctacaaatgtgaagaatgtggcaaagcttttaacaattcctcaacccttatgaaacataagataattcatactgggaagaaaccatacaaatgtgaagaatgtggcaaagcttttaagcaatcttcacatcttactagacataaagcaattcatactggggagaaaccctacaaatgtgaagaatgtggcaaagcttttaaccacttctcagcccttagaaaacatcagataattcatactggaaagaaaccctacaaatgtgaagaatgtggcaaagcttttagccagtcctcaacccttagaaaacatgagataattcatactggagagaaaccctacaaatgtgaagaatgtggtaaagcttttaagtggtcctcacaccttactagacataaagtaattcatactgaagagaaaccctacaaatgtgaagaatgtggcaaggcttttaaccatttctcagcccttaggaaacataagataattcatactggaaagaaaccctacaaatgtgaagaatgtggcaaagcttttagccagtcctcaactcttagaaaacatgagataattcatactggagagaaaccctacaaatgtgaagaatgtggtaaagcttttaagtggtcctcaaaacttactgtacataaggtaattcatactgcagagaaaccctgcaaatgtgaagaatgtggcaaagcttttaagcatttctcagcccttagaaaacataagataattcatactggaaagaaaccctataaatgtgaagaatgtggcaaagcttttaacaattcctcaacccttagaaaacatgagataattcatactggagagaaatcctacaaatgtgaagaatgtggtaaagcttttcagtggtcctcaaaacttactttacataaggtaattcatatggagagaaaccctgcaaatgtgaagaatgtggcaaagcttttaaacatttctcagcccttagaaaacatgagataattcatactggaaagaaaccctacaaatgtgaagaatgtggcaaagcttttaacaattcctcaacccttaggaaacataagataatttatactgggaagaaaccatacaaatgtgaagaatgtggcaaagcttttaagcagtcctcacaccttactagacataaagcagttcatactggggagaagccctacaaatgtggagaatgtggaaaagcttttaacaattcctcaacccttaagaaacataagctaattcatactagggagaaatcgtacaaatgtgaagaatgtggcaaagcttttagcaatttctcagcccttaggaaacataagataattcatactggggagaaaccatacaaatgtgaagaatgtggtaaagcttttaagtggtctcaaaacttatggaacataaggtaattcatactgtagagaaaccctacaaatgtgaagaatgtggcaaagcttttaagcatttctcagcccttagaaaacatgagataattatactggaaagaaaccctacaaatgtgaagaatgtggcaaagcttttaacaattcctcaacccttatgaaacataagataattcatactggggagaaaccgtacaaatgtgaagaatgtggcaaaggttttaacaatttctcgacccttatgaaacataagataattcatactggggagaaaccgtacaaatgtgaagaatgtggcaaagcttttaagcaatcctcacaccttactaaacataaatcaattcatactggagagaaaccctacaaatgtgaagaacgtggcaaagcttttagccatttctcacgccttactaaacataggataattcatactggaaagaaaccctacaaatgtgaagagtgtggtaaagcatttagtcctcaaaccttactaaacataagataattcattctggagagaaaccctacaaatgtgaagaatgtggcaaagcctttaaccagtcctcacaccttactcaacataaaacaattcatactggagggaaaacctacaaatgtgaagaatgtggcaaagcttttaaccatctttcagcccttactaaacataagataattcatactggggagaagccctaaaaatgtgaagaatgtgtcaaagctttcaaccattttacaaaccttaatacacataagataatttatactagagacagaccctccatatgtgaagaatgtggcaaagcttttaaccagtcctcaagccttaataggcagaaaacaattcatgctggagagaaaccccacaaatgtaaagaatgtggcaaagcctttaaccagtcctcacaccttaaatacacataaaataattgatactggaggaaaaccctacaaatataataaaggtgacaaagcttttaaccattgctcagctgttactcaaaatgagagaattcctaaagaagataaactccacaaatgtgaataatatggcaaagcttttaactggtcctcaaatcttactgaatgtaagataattcatactgaagataaacccttcaaatgtgaggaatgtggcaaagcttttaatcagtcctcaaatcttactgaacataagataattcatagtagagacaaacactgcaaatatgaagaatgggcaaagcttttaaccagtcctcaaactttactcaacataaaataatttatcttggagaggaacactacaaatttaaagaatttggcaaaacttttaactgcttctcaaaacttactgaacataagataattcatactggagagatactttacaaatgtgaagaatgtggcaaagcttctaacgggttctcagatcttactgaatataagataaattagagagaaacccgcctcatgtgaagagtgtggcaaaacttttaactggtcctcaaaccttactgaacataagataattcatactgaagagaaaccctacaaatatgaaaactgtggcaaagcttttaactggttttcagaccttactcaacagaaaatagttgatactgaagacaaactctagaaatgtgaagaatgtggcaatgcttttaatcagttaaactttattagacataagaaaattcgtactggagaaaaaccctacaaatgtgaagaaagtggcaatgcttttagccagtcctcaactcttgctaaacaacataattcaatgggagagaaaccctacaaatgtgaataatgccataagcattcttcaatttttttttttttttttttgaaacagagtttcgccctagttgcccaggctctggagtgcagtggcacaatctcggctcactgcaacctccgcctcctgggttttcaagcgattctcctgcctcagcctcccgagtagcagggactataggcatgtgccaccacgcccacctaattttgtatttttagtagagacggggtttctccatgttggtcaagctggtctcgaactcccgacctctggtgatctgcccgcctcggcctcccaaagtgctgggattaaaggcgtgagccaccgtgcccagcctaattcttcaattcttaataaacaatttatactgaagagaaaccctacaaacgtgaagaatgttgcaaagcttttaacgtcctcaaaccttactgaacataagataattcataatggaaactagccctacaaatatgaagaatgtggcaaacactgtaaccatttctcacatcttaccacacattaagataattcatactgaagagaaacccgacaaatgtgaagaatgtaacaaagtctttaactggtcttcaactcatactaaatataagagaattcatacagaagataaattttataaatatgaagaatgtgacaaaagctttaaaaacatttcaacccttattacacataagataatttatgttgtagagaaattctacaaatgtgaagaatgtggcaaagttttttttttttttttgaaatggagtctcactctgtcgcccaaattggagtgcaatggtgcaatctcagttcattgcaacctccgcctcctgggttcaagcgattctctggcctcaacctcccaagcagctgggattgcaggcgcctgccaccacgcccagctaatttttgtatttttagtagagacggggtttcaccattttgaccaggctggttttgaactcctgacctcaagtgatccacccgccttggcctcccaaagtgccccaaagtgctgggattacaagcatgagccattgagcccggtcgaatgtggcaaagtttttaataagttatcaaatcatactggagagaagctctacaaacctaaaagacatgacagtgctcttgagaacaccttaaacttttctaaacataaaag

SEQ ID NO: 91323 - DNA, 1250 bp, Homo sapiens
taatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaactaatgctcacaccttaatgcataggaaagcatttatgcttgagaaaaagtgaacaaatatagacaaaaagccattaatacctgctcacatcgtactcaaattcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaa

SEQ ID NO: 91324 - DNA, 2967 bp, Homo sapiens
attcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcata

SEQ ID NO: 91325 - DNA, 1095 bp, Homo sapiens
ccatttaaagactttgtcatattcctcacatttttagactttctcaccagtatgatttcttttatgtttagaaaggtttgaggtgttgtcaaaagcattgtcacatctttcaggtttgtgaagtttttctcaagtatgatctggggacttattaaaggctttgccacattcttcacatttgtaatttctcttcagtatgacttacgtgtagtaagatgtgaggaatggttacaggctttgccacattctttacatttgtaagttttctctccagcataaattattttatgtttagcatggattgagagatgagtaaaagctttgctacattcttcacatttgtaggttttctcaagtatgaattatcttacgttcagtaagttttttttaatccaaaatgtgtttattgagatggtttcccactcatcttgattcagagtgcttttagtgctgcttcctcctgaaggaacatccttctgtaagccttgcttttcctcctgtaggctggcagaggacagtggagcagccaacacacaaaactaccatttgtgcatgactaaagaccgtggtgactttatagcatcctgggcatttcacatccatgaagtaggaattggggctctgcaccaggcgtttcttcttgtgtttcctcttctcttctggagagggatgaaggagatcctttgtgagaggcatgtcctcttgtgggaaggttgtcatcacccgaaagctgttcagtaagttttgaggaccacttaaaagcattgccacattcttcaaattctagagtttctctccagtataaattatcttatgcttagtaaggtttgaggaccatttaaaggctttgccacattcttcacatttgtagggtttctcttcagtatgaattatcttatgtacagcaaggtgtaaggaccagttaaaggctttgctacattcttcacatttgtagggtttctctccagttctgagttatcttatgttcagtaaggtttgaggaccacttataagctctgccacattctttacatttgtaggttttctttccagtatgaattcccttatgggtagtaaggtgtgagtactggctaa

SEQ ID NO: 91326 - DNA, 1050 bp, Homo sapiens
tgccaggaggcttcttgccccattcaaattgttatgaagttcagctagggaaatccttctccccttggagttttaccccttgcttctctgtcctcctccctctcccatggattcctgtggtgccaggcaggaatgggctccttggggattcagcgagctcccagggcctccctgttgcctcctgaacccctgtatttcactcagcttggctctctaacttgactcacctccaggtagtaaggagcttctcccacaaacagactttcagtttctccagtggggtcgttgtgttcaggagaagagagtctccctttcccacttctgcagtggtggcactcactgtatttggggtgtctgtcaggtcctgcaggagcagtctgcttccttcagagggttgtcctgatgcctttaaggacatattctgaagataaaggtggtgattttttcagatactctctcctgagaaggaatcagagaagagagaaaaaatggttgattctcaaatgaatgtgtcccaggtcaaaactgtgtccacattttcttctagaaggtcatgtatttacagttgcaatcattttcatttctacttctgatgcttttgcctaacaagattatttgaagtaccttttttcttctcatgacagtgaaatgacctcattaaaataattctcccctatgtttcagagccttatctttattctctccatccaggcttcttacatatcacaaatagtaccttgaatttataccgtgaaatattgaaagtattccctttgttgacagatcagcctgagcaggtgaagatataaaacattcttattggggatggtgctgggtcctcagatatcagtgagggagaaaactgcaccatttaggttctatctgaatgctccatcagctctatgaataacacaatttttaaatgcacacttaaaaaagatggaattaatggcctggaataatttagaaagatatgtaaaggaatgaattcaaagaaatgtgccttctagaatgcttaaagagagagtatttagatacactattagaaat

SEQ ID NO: 91327 - DNA, 1761 bp, Homo sapiens
gtgtggactagatgagttttagggtgtccttctaatccagagagtatgggaggtatttagcatgatttatatagtaagtcttggcagttgaattttcggaaactttgagttattactgtttattttgctgtttaacgtttttagcatgatgcactgaggtgttgtgaatcctgaatcagcaatgttcaaccaactagggggagctcaatttacaaatagtatcttgtgatttcataccagtatgataggtggtggttcacttcatttcatttttaagattttatatgctagcaccgccaatttgactatttctgagacccagtgagtgccatatttcacatttttagaatttgattttttacctgtgaatccataaagggctatttcctgatatatactcccttcgggatactcatctaattgtgttttttaaccttctgtttgtcttgcagtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagatacttgtgaaatctgtaactgactttattttcttgcccaaatatttgcttcctgctttgcgtcagggacgcagattctgcacggtcattgttgggatgaagtaaaattaacgggtcatctaagtgtctatggcattgacagaaacagtagtatctaggtattccttatttaccggacttggtaagagtcctggctatgcatttcctccctactgtgtaagccgtgtgataatctcaacactaatctgtgggaaagagtcctgaatgaggcattagtagctctgagggtttatcttcacgtctggtctgctggtttttctccttaagtgacaggccaggaaattttattagtcccttatgagtgtaaattagtacttaatcctttagtcttaataggcagtgatgggatattacctgag

SEQ ID NO: 91328 - DNA, 1060 bp, Homo sapiens
gaaggggaacatcacactctggggactgttgtggggtggggggagggggagggatagcattgggagatatacctaatgctaaatgatgagtcaatgggtgcagcacaccagcatggcacatgtatacatatgtaactaacctgcacattgtgcacatgtaccctaaaacttaaagtataataaaaaaaaaattggaggtttacctgacttagagaaactatttttagaaacaggcaaataatgtagaaccataaggcaaaaaccttttctgtaatcatttcagcctgtaatttaagttcacattatagtctgtctagatggttcatggcaggatggcttatgggagtggaggggttggatctggagaagattcttgaattggagaggaaggttgtactattttcatgcagatttccaaggcgcattggagctcaaccttaaaataaaacttgttttgttaaaattccttaaattttctcctttaagtatttgattttgctttaggttagaattaaatctagcatcttactgaaagtcagacctaatgcagctcatgtaaatatttggagaatgatttttgcaacagggcagtttaatttccgaaaggattcttggtggtgtagcctactaaagtgtaaccagctagatagagtgggaggagacttttgccaccaaatctctgaatgagaagggcaaagccattttattgagttttcttgtacatttccttgtatactgttaagggttgtggatactgtttttaatgtagaagtatgaactttttattcctttatcttttagggaggaagctcatcttttctgtaatcccaggtagtgctaggagcaagtaatttatgcttaattccaaatgccagtatatactggcaggttagcatttatttgttagagtagtagtataggatgtaatgtcactttgactccacagattctgggatgtgagtctcaagttgccattatctgtgtcctggtcttctccaggaaatgatttagtcagaaaagcacatagagtgattttggtaggtttcattattgtttgaat

SEQ ID NO: 91329 - DNA, 1054 bp, Homo sapiens
gccttccatctttacttggccctgtatcggagatagagaaatggcagcctgtgggcagtgtgtctgcaggctgtgtagttttcaaaaaaactgggaagactaatggcatctcttaaaatgctggaagccggtaatactgggatctagtttctacttgggaaaattccatagtgtgctgtgtagtggccgcccccgcagttggagcaagtggtcttctccagtttgtcacagtctttaccaggtctgcgtgtttcattctgttaccagcctggctccactgatagctgtttgtgactcttcccctacacgctaaccaaattgcccgccacttttctttttactctgtcttcattcaccctgggctctgcactttcttcatggtccttccactaagttgctacatgtccatatgttttccttacccatcttttcaatctcagttaaggatcaggtgaataaagtttttatttgctgatttgtctgtctctgtagcacatacactttacactctgtattgtgtttattggtaactcctccacccttgggcttaagggcatagagaaggtaatatcttctttatttttctatctttcacaacgtcggattttgtatacagttagtgcaaagtatttgtgaatgaatatttgttaaggagcatcagtgggttttgaagaaactgtccatggcaggtgtagagtaccctagcccatccttgggacctggaggtgagaaggaaggaaggagaacatttcaatagcaaaagaaaagcatctttggaattcgtcgtgttgctaaagtttcttcaaaaaattggaggcttacatttctctgatggccagtgatgctgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccaatttttaggttgcctgtaaaccacaa

SEQ ID NO: 91330 - DNA, 1034 bp, Homo sapiens
acattagagctgtcactccccacttcaggccaggcgcttgtgtctgatctcactaggatcctaaagtgtatggtctgtaaattacaaactgcagcaacaaaatgcttaatcattaaaccaaggcagccactatgcaccagcctccagctgggtgctaagcgtgagtggccccagcctggggaagcctcactgttcctggtctgctgtgagctcctaggttcttgagactcaggtgttaaccttgcctgttttctcatcccctgcaggcaccggccgtagctacaccacagacccactcttgtccctgctcctgttagctctgcataagttcctgcgcctgctcttgggacattgacagacaagaccaacccgagcatctcagaggccgcacatgacctgcccggggccctcggtgaggaccatgtcgctggatggacacagagagactgagagacgcatgaaaaagtccacatggaaaataaataaatcatatttttgggaaagttacacaaatgtagaacacctaaaataatgcatctagtttccaaataatttggagtttggcccatgcagtctgcatgggaatcaatgatttctctacttcaatgtagttttcttttctacactttccctccaagtcttcattttgcacgaactgttgagcagttatctttaggataatatgtacaaatgttggggtcaaagccttttgacaaagcaaaatatttttagtagattattgtgtttaggatttttttttaatttactttttttctttgggggcttttcttttttattaaattatttcttttgaggcattttgattaaaaaagacacatcttatcataattaaaattcactgtcaataatatttatttttaaataaagattggaaacaaggtcagacacttgtttataaactgtattgtatattgctgaagaacagttgaataaaaaacaactttgaaataacctttctacagccatggatgaatgtcaagcgttggtgcccactgcagcctggctgcctgccg

SEQ ID NO: 91331 - DNA, 1013 bp, Homo sapiens
agtgaggcttacagatgggaagtgccctaagcgaggttaaacagctagttagcagcagacacggaactagaacctaagcctgctgtcccagcttcggtgcccgtgctcacagcggaagctgcctcggctcatccgtaagggcgctgattagggacgacaaagacctcaccccaccgtccccgtcccatttccgccctcccagatccccaacctccttcgagtcctctccaagtcgcctcgcctcgctccactccaggccttagcaagcattccacatgcctttaccccaaccctactgcctgtcccccaaaagatgcaggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtaagcggggccgcgaagttggagagggttggggacgttaagggtcggggtcttggtactggtgggtgaaatgggtccgggctacctgttgctgcggagtcctaacagaaccgctacaggaatgggcccaccctacctaagaaaaactgagggctggagcacgggttagcctggctcgacctctgagctagggagggatgtcagggctggaggcaggttctcccggaggctgctcagtggtgtgcgatgctagaggagggttccaggccttggctcaacttggccactatctcccggggtgaccgcggtcaagatcctgctcctttctgcgagctggtttcacactcttaacctgatgcaaagcgccgagagctgctggggaatgatatcactaacccaaagctttggtccttaggggtagaagacatgtgccaaggaggggcgtgtagacaccgttaagactgggccttcaatc

SEQ ID NO: 91332 - DNA, 1304 bp, Homo sapiens
caacctcatcttctcctatctctgaataagcagttgttctgctataagtgtagaagtgtagttattttcttttcttttcttttcttttttttttttttttttttttgagacagagtctcactctgtcacccaggctggagtgcaatggcacgatcttggcgcattgcagcctctgcctcccaggttccagcgattctcctgcctcaatctcccatgtagctgggaatacaagtgcaagccaccatccccggctaatttttgtatttttagtagagacggggtttcaccatgttggccaggccggtcttgaactcctgaccttgggtcaggatccgcccgccttggcctcccaaagtgctaggactacaggtatgagccactgcgcctagtggcgtagttattttcatagttagaaaagtcttgggtcttacagccatacccaacaagaattgatcatttcttttttttaatcccccaggtgtgatctaccatgcattgtctcagaaagaggcgaatgactccgatgtccaggtcagttcttggcagggagtccaggagcaacagaggtgatggcaaagatggctcagtagcttctgagcccccagcactgattgagatgtcctttcccacatcatactcctcatttttctggcagacatctaaggctggatcaaagtctgtagttctcattacctgttcccacgtgccagcctccttttctgttgtgccaaagtcaagtttggtaaaatgaggctttccttaaccttttatcatttcccactgtgttggggacaccaggctgtgcccacgtggtgggcagcatcattcaaccttgtcactgtgccctctgcacttctgcagaaggtgtgcaatcacatatcataagtgaaatttacagattatatctgaatgcctcggcctgctttgtcagttttgcaaaagttcctcttgtggctcataatgagagcattaccttgaaagcaagattttgaaagaccagtatacctttattttgcttctccatgaaagatgagccactcaggtatttaagagaatcagatcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactattgacagatcagcatcagtctgtcagcctcagtcttagcatttagcacctggctagtgcaaaaagagctca

SEQ ID NO: 91333 - DNA, 1014 bp, Homo sapiens
ggcgggagcggaccttttggagagtggccacaccatgcccacagagctggaaacccggttaaggagtattgtcctaagggcacagtgtcagggtccctgcgccctgaggcttggccgaccctggagccctagttttgctgttttctgtagtgttaggatcacttcctccatagcttagtgctactctgagctcactttcatctggtcatgcctggttgaatatatttgttatacatttctcaagctttctcttctgccaaggatgagagaattcttcttcaagatagaaaggttttggtcctttcagaataacctcagaaaagcagggccagagcaggaagtgagcgtttgacacgctgttgtgtgtgacaaacggtcatgaattggtgtgtgagtgtgacttacatctcggcagctgtgggtagcagatgcatggcggatgagcaggttgagagcctcagtaggtaaagggatgggccccatttgctcttgcagtagctgccgggaatggcgggcgggatgcctgggatcctgggctgcccagaccggagcagtgagcgccgcacccccttgtccgcctgcagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagaggtaacccgagctccccacgtctttctgcccgcggtgcttacccttcttggtgtgtgaacttggctgagtggctggggaggcagcctggctccacctaagctaagggggcctctctgtcgtctgccacaagagggcagccttcctttaccaatctgggctgtgttcagcgaggcgggtgagacaggactcattgtctggcctctctc

SEQ ID NO: 91334 - DNA, 1051 bp, Homo sapiens
cggggctattatttcaggtaatttacctaagagcgtgtagcacatggccatccagaggttcactctgtcactctgtggagacccagggcgtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactcacccacggcctgggatcttgaacacagaatccctttcatccaatgctgtggtttcaaatgtcagctacacctgacagcccccaaggtgacatctccagcgtaggcctgtcccctgaactccaggctcaggcatccagctgcccacttgacatagccacctggatgttcagggggcatctcagactttacatagccaaagctgccaccgattctcctcacagcaacccctcctggtcttttccatctcagttaattactcagttatttacactggttgttcagaccaaaaacctaaacagtgtctatgtttcttctttcctaatctcctcgaatccttcggaacatcctactacttaaattcagccactgtcattccccagattacctcagacacagctcctcaccgcaccaggcagccagagtgccggttacgtagaaatcagagcacgttccttccctgcttcaagtcttctggcagcgtcccatcgtatgggagtaaacctgcctccttgctgtggtctaaggcctccccgctccctggggcagcaggcctcccacactgccttcctcctgccctgcctcagggcttcgcctctgctccttacctctacccgggagttctcctgtgtgtgcacagtccagcttctcattgttcagccctgctccaatgccactcccctcagggtctaccattgcaaaccatgaccctccacacattgccctgtccctactcttcatagcactcgttgc

SEQ ID NO: 91335 - DNA, 1030 bp, Homo sapiens
aatgtgggaaaaccagtttctggcaggtgttctgggactttctggttctgggaatttggtgtatagcctttgaccctgaagattaggtgccaagctacatttagcatgtgactagattgacctgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacagtacatatgtggacataaacagggatcaaataaaggaggtattgctgcagtccagccaggttgaaagggaaggggggtccccaaaggtccattggatggcaggtgtctacagaggctcgcctttgggtggaactctgacccacctaaggtttactttgctatttcaggaaggttgaagaggattgaagggtgagttgctaagtgacttagggtttattcacttc

SEQ ID NO: 91336 - DNA, 1009 bp, Homo sapiens
ctttgtgattagagagggatttttacagtaagcccagaaacctccgtcagctcatgaagaagaaagtgggcccagcactgaggtgggagatggggcaggcaggcttcattttgcatccttaaatgtggagcccagggaatgcatgttgggtgtcaattatctgagccaaatggacagaagactgcataaacctttgccctccacactggctggcggagcaggcgtggcaccggctgagcccgctgcagcccgctcatgaatgtgcctgctcatggtgatggtggtgtgcactcagtgggaacttaagtaaggccatcgcttatgaataagacccactaattgaacgattccatgttttctagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctc

SEQ ID NO: 91337 - DNA, 1031 bp, Homo sapiens
tccacccgcgccagccacgcggctttttgccgctccagcgccgctcggccccgcccccggcgcccgcggcccgcccctcgccgccgcgcgccagacttctcccgcgtcccgcccgccgccccgccccgcgtcccgcgccccgcgccccgcgcccggccctcggcgcgcaggccctgtcacttggccccgccctgtccgccggccccgcccctgattccccgtccctgcgcctcgcgggccggcgccgtggaggggcgggtccgggggcggggcgagggacggggcgggacgggctctgggtcccgcgcggccgctgaggggctgggagccgcggcggggcggtgcgagggcgggccggggccggttccgcgcgcagggattttaaatgtcccgctctgagccgggcgcaggagcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggtgagtctactgccgcgggctgcggacagggactcctggggcccagaccgcgccggggagctgggtgggggcggggtgcggccgggtcgcgggtccccgggcggcgtcgcggggcgcccgggagggtgctgagagcgcggcggggtggggtggaggggacactgaggcagcccgggccccgggaggcgacgggccggtgagggcggcgggggcggcgggaccccgggtcgggggtcggcgggtgcccgggtcgcgggtgacaggccaccccgccatcggccatcttcctggctcgcccggccgcccgcgcgcaaagggggaaggggtactgggcccgcggcctgaccccgccgccgcctcaccccgcgccgccccgcaggcctcaggccggagcagccccatcatgccgagggagcgcagggagcggtgagtgcccgcgccgcggggccggacgggacggg

SEQ ID NO: 91338 - DNA, 1056 bp, Homo sapiens
ctggtgagagtgaacttctctaatgcagccacagcccatatggcccagcactgtacctgtcagtgggcactggcctctgccagtcctgggattccaggaagcttggtgttcctgactggcaccgtctgagattacagatatgtgcctagcctggaagaaccagaatggacatcacagtattcagtcctccccttctgcccaggaggaaactgagactcagttagaggaagaaagtaacccagagtcctgtgccatccaggggcaaagttgggctctcggccttgtctgtaaaagctggtgaactgggggagggttcctgggtgtttataagcaacaactttccccctatctacacctatttttcttgtcatggtgtttaaggacctcctccgtcttctgtaggtcagatttcaaattcttctcctctttctggccctggaagttcttatagcccctccagcaattacctgcattgatccccagctcagcctgacctcagcaagagtatcagtggaacattcagtgtaatgataggtggtgtctcaatacatttttttttgactgcttttcttttctctccttaaggagttcctgccaaatttcctgcatgcagtgtgataatcattataatatcagaagtttcttgcagaaaaagcttgtactatctctttactttcagaaatggctggagactgtagttatggctccagtgggggaagcagcctatctctaaactagctggtcaggccttctgactctatcacagataaacgctgaacagaaacagtgttcgacctgagtgcagggatcccagctaggttagcagagaagcccctcactttgcagagcagcagccagggtagttcatctggaagcgtgaagggtttcaacgcagtgcgccgtgttctaaatagcagttgtcactgcatgtaaggtcccccgaaataagcatttctgaggagggtccactgactattgaagaaagggttgctgatttcctttttcattcaaagaaatcatttcagagacggaaatgagacggcatatccccagttt

SEQ ID NO: 91339 - DNA, 1483 bp, Homo sapiens
tctcctaatgctatccctcccccctcccccccatttttgatcttttatactaatgaatgtgaagtgcttatgtaaatatttttattgacagttctgttttacttttaagaaattttagtagatgcattgtactcattaaaaaaatctttgagttgtgacaaaaaatatcataatgtatctttttggaagcactttcagaagtcatgcctagtatcttactgagttgcaggtgaatttgtaatgtttttgggtaatgtaagagctgtttgcatcttatctcacctctcctgtgtatttttcatttacagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgaggtcagtgccgactctgccacatggcttccaggtctcttactccatgctcccctttatccctcatagcatggacgcattcttacccctttgtgggcctcatttttgttgtgtgttttgttgtagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgagcttgagtcttcctgttcgcttcatgaaagcactgagcatttccagcatttttgtgtattaggacctctgtgtggtttattccctcgacatgttctccatctctgaagctatatggtatatttttactgtggtggtctttctgttttgcttgtattcttagcaagaatttctgaaatctttttatccttcagatgttttaaaattggcatctaattttttccatccaagtttaaataattgttaagattgtattttccagtaaattgtaactgttaacatttgagctttgttcattatgttcattaaattgctttttttttttttttttttttgagatggagtcttgctttgtcacccaggctggagtgcagtggcacaatctcagctcactgcaacctctgcctcacgggttcaagtgactttcctggcctcagcctcctgagtagctgggattacaggcgcacgccatcacgcccagtattttttttttttttttttgagacggagtcttgctctgtcacccaggctagagtgcagtggtgcgatctcagcttactgcaagctcctcctcccgggttcatgccattctcctgcctcagcctcccgagtagctgggactacaggcgcccgccaccacgtctggctaattttttgtatttttagtagaaatggggtttcaccgtgttagccaggatggtctcgatctcctgacctcgtggtttgcccgccttggcctcccaaagtgctgagattacaggcgtgagc

SEQ ID NO: 91340 - DNA, 1477 bp, Homo sapiens
gaattgctggagcccaggtggccgaggttgcagtgagtcgagatcctaccactgcactccagcctgggcaacagagggaaattctgtctaaaagaaaaaagaaaagattaaaaatttgtgtatgattatcaaagggtatatgggcccaactttcaaatgtgttaaaggtactgaaaaggggatatttcaagagtacccacaatgagtcaaagttccatccatttatttaatggtgggtgggagttgtgttcttttttttttttttttttttttttacaaccattggtgtggcttctgtgttaattccatcagtgcgccctctctctttccatgccagggtactgagaagtcattttggatgcattataaattgagactgttagagattggctttggtgctagtgccatcttttatttcctttcaggaaatctatcctccaaagttgcaccagtttgcgtatgtgacagatggagcttgttcaggagatgaaattctcaccatggaattaatgattatgaaggtgggttccagtgaattttccggccattttttaaatgcgtacggcagatcttttccacctgaagtgtgagtgcctctgggaggtgttctccagctggacacattgtggcatggaacatggctgcattttgaacttcttttctcaatcatcggtctcttttctctctgttttcctttaggcccttaagtggcgtttaagtcccctgactattgtgtcctggctgaatgtatacatgcaggttgcatatctaaatgacttacatgaagtgctactgccgcagtatccccagcaaatctttatacagattgcagaggtaagtggctccatcacgtccgtggggccaccttccctgcagctggagtgaggaactctagaataggcgtgtggtggcatccatctcagcgttcttttcttctccgtagctgttggatctctgtgtcctggatgttgactgccttgaatttccttatggtatacttgctgcttcggccttgtatcatttctcgtcatctgaattgatgcaaaaggtttcaggtaagttggctttccagtgcatgcacaaacaaggtgtactaagcttacatccagttgtcagcctcagattaagcccacgatgtcttcactgcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggtcagtgctgctccttctttcagtccttcttggccaaattcttaaaactgcctaaataggccagccgcggtggttcaggcctgtaaacccagcactttgggaggccgaggtgggccgatcacttgaggccaggagttcaagaccagcctggccaacatggtgaaaccttg

SEQ ID NO: 91341 - DNA, 1126 bp, Homo sapiens
cagaaggactgcttaagctcagaagtttgagactagcctggacaacatagggagaccctgtccctaaaaaatttaaaaactagccaggcatggtggcacatgtctgtagtcccagcactttgggaggcggaggcgggcagatcgcctgatatcaggagttcaagactagccaggccaaaatggcgaaaccctgtctctatgaaaaatacaaaaattagctggacatggtggcgggtgcctataatctcagctactctacttgggaggctgaggcgggagaatcggttgaaccctggaagtggaagttgcagtaagccgagatcccaccactgtactacagtctggatgagaaagcaagtctccatcttgagaaaaaaaaaaaatttaaaaattaaaaaagaaaaagcctatggtaattgaagcccaaggatatgttctactctaatgtgttgtcccttttattcttaccaacaggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgttttt

SEQ ID NO: 91342 - DNA, 1063 bp, Homo sapiens
ggcacttcccccttgttctgcacacaacagagcagtctcctggaggcagagcctttccccaagcagagtgccagcccctttctgggtctcatgcaagggagcagtgaacactggagggacacaggcagggtgtccctgaagcctcctactgtgggtccattgctaatgtggccagccctagtcattctcctaaattctttcttagctttacgaggaccttacgtcctctgatgttaatcaagtgcattaatcaacagatggttaaatggggtagtaccccagctccagacacagttgtagctgctgtaactagagctgtgaacttgcactctacagacaggagactgacccagatgtggcaggtgtgggaagcattttgtgcggcggggggcgggtgggaggggaggggtggcggggattcctttagcctgggtggtcagggagggtttctcagaggaggtgaccttgagcaagacttaaagggtgagaatcaacctgctatgtaaagatctgtgaggaggatgtgccaggaatagagaagagcaagggcccaggcttcaaggtgaagatcaaggaaatgtatctgtagctggagagcagggattgaggtcagcagaatgggggtgacattgggaaggagaggagggaccaggtgactgataaggggccctcaaccctgcctgccccagagtcactgtggaactctccatacagggagagaaagcagaactacccagaaagccccctgacttgccaccgggacagcatgcgtggtttatggtccacagctccgtacaggaactctcgcatgtgttcatgttcattgatatcctccagtctgcaccaaaggatgtctgagaattaacgatcaactccagtttcctggaaatgaatgtggaggggcagactgaggttgcagggtgttcctggaggcctacggtgagacctgtgctactgtggtcagctctattcacaatgcatgcttgaaaatgaggcatcagggtaaataacagtgctctctgggtttttttttttttcttcccccgctctgctcccttttttt

SEQ ID NO: 91343 - DNA, 1004 bp, Homo sapiens
gctgggcacatttacacggagggcagaccgggaggcccttagggctgggagggccaccaggtcaataatatatgcaaccggcaaaagaaaacatcgacctcatttcctccagagagcagacaactgtaaccctggagtcctggtttgcatgtaaataatgagcaagatactgcgtggccacttgtatcattgaggggagagtgagacaagaacaagaaagataaattagaaaaatatgagggcaccacttatggatctgtacaaggaagtgtcattcttcaggttaattttgcttcctctagaaagcagctcagtgttggtaggcttctatgtctgagattttaaaatggctttggtatgattattatcaatgaaataatcactgtcagtaacaaaaaatcagtttctcgagaggatgactgacgtgcggttgcagcatttggccccggggcccattaaatcctgaccaaagtgctgaagagttgccccacaaatgatttggctacactgggaatcacccggaaggaggccaagggtgtgtaattctggggaagtttggcggcagcctagggcctcctcaatctgaaagctcttgtttcgctttgtaaagcgtttgcttgtttctttttctttctctctttttttctttctttctttttctttcgcctgcctccctccctccttccctccctcccttccctcctctctccgtccctccttctctccctctcctgcctctctccctctctcccccctttctctttccttcctccctccctcccttacttcctccctccctcctctccctctcctgcctctctccctctctcccccctttctctttccttcctccctccctcccttacttcctccctccctcctctccctctcctgcctctctccctctctcccccctttctctttccttccttccttccttccttccttccttccttcctccctccctcccttcctccctccctcccttcctccctccctccctt

SEQ ID NO: 91344 - DNA, 5319 bp, Homo sapiens
tcgcctgcccaggaaagggggcttctgagctgaaggcgtgcggcagcgcgtgggaatttgggggcgggggcagcacgctgtcaacggaagcgttcgccttaatatttgtagcttgtaatgacctaaacattgcttaaaatgtgtactgtttgttgctctttgattgcacggaaaagttttaccgcgtttgtcatgataatgcttcctgtgcaatatttggttatttaatatttgtcacaatataatgccatttaaacattaaaaaaaaaagagagtctcactatgttgcccaggctaatctcgaacttctggcctcaagcgatcctccccctcctacccttccccacctcgcctcccaaagtgttgggattataggcctgagtcaccgcacccggctcatttttacaaattttaatttcatcgtataataaatgagttttaaactactggtgaaaagggtacaaagttttgtgtttcctagtgggactttatataaagaagtattcccaatttaagaaatagttttattgttaaatctgatttttctgtggattctgtggtctttcagattgattctgtcccctcaagtgtcttgaaattgttactttgaaaagcagtatttaatttgcttaaaatattttatgtcatgtttggaagagcatggattataaagggttaggaagttgcttcaacactataagcagtttaaaagttcttaactttttaattgaacattcctgtataagaacgactgtttacatagatacaaaaatatactcagttctactagatgggggttttgatagaacttaaaaaaccctcgtttgcttggaaaccacctgttgggatgaactgcgggaatctttctttgttctggttggtttaaattattttgtgggttggattttcatttctcagccatttttctctaataacgcaactgttaggtttggaagccatgttttcaagatgaaggtttaaaaatccagtggctagggtggtgactcaaacctgtaatcccagctgcttgggatgtcaaggtcgtggaattgcttgaagccaaggagttcgagatcagcctgggcaacacagggagacctccgtctatacaaaaaaatacaaaaaattagccgggccatggtggtgcacgcttgtagtcccacgtacttgggaggctgaggtgagaggatcacttgagctcaggcgtttgaggctgcagtgggccatggtcatgcaactgcacttcaccctgggcgacagagtgagaccctgtcattcatatatatatatatatatatatatatatatatatatatatatatatatatataaaacttaactagtttggcgtctttaaattagaagacattaatgtatttttttaaaagagaaagatagaaaaagaagaaagaaaaaacagcccctcatgaaatcttactccttttgccaaaacttggcattttttattctttcagagaatgtgacacagaccctcagaggatggtgtttctattgcctttcctctgctgcagtgggttaatttcacctccttcagtgtataatacgtgcataatgctgacttgatatgttttctgccatttggcatattaaaaagatatccttagttttattctgatgttagtgtgactgaaatgcaaaggatactttttggggtgctctgaacagctttctggtatcgtgttgagttacattggaagagagagtaactgctttttcagttacagtcttgtggcaaactgaatgactgttttctgtagacattgactgtgctaccaaattatttttctgtgttgtgttaatgttaattcggcacacaaaataaccacgtatatctgtcatgggtgtgtaaaattatccccagttcaggaaaaagcgcgtcagtatttaatctatctttatttaatagaagcatttgcttcagtggacaggagacccacaaggccacaaaataaactgattagatagctgcactgtaattatagtgtagtacaggaaaactacccagtaaatcggcagtgaaaattttttgtgaagcaatttatttaggctttaaagctggcccagttgtgggagtacagtgagttctagtaaagtagaagcgtagtgacatcctgagtgtagaaggggaaaatgtcatagtagcttcatatgtggcacttagtattcctttatgaaagatgaatcaaacatgcttttaagctcttggcctttccctacatgggttttgtgagacagagttaaactctgcagaaaatgatttgaatgactgttctcagttttccctgagagggtacctacctagttggctgtagatgcagagagagaaatgagttccttacacacagtgggtgccttaggcttagggcataatcttctctgggagccttgattgagaggggctggtaggtaatgtggcttaaatgttgctcattagttttgctctttctttttttccaaattcagctaaggagtataacaagttttacgctctctctctctttttttcttgtatgttctctggaacatggaataaaaaggacaaaaaattggcaacctgaggaagaggacagacaaggggcatgaacaagccacaacctctaagtgacaatatctgtagtcagcggttaggatcaaatattttaacattgctttcacttacagtcaatggtgaaacatttccaaaacaatttattttagttagaacttcggtttgtttctattttgatctagcaataaaacatgtaagaaacattccctgcagctttgtttataaagagaaaaactaaaagtctgacattgggggattggttaaataaatcaggagctgttacgtaggcattgaaaactaggacagtatgtatagggtggttccagttacgtttatataaatatttacacattttacataggaaaacaccattgttttaaaagtacacaattttattattttacctaaaagtttgtaaaattggatgggatttttttttttccaaaaaaagctattgataaaacttattttaattttaacgaaaattggaatgttactttaattgcaaaacactttctgagcctgaaaaatggctcttggctggtttgaatgccggttaggcaggtttatttcttggttacttcagagctgatatatataatttattcaaacaaccatcttccagttgatttccttcccccccccaaaggttttatttaatcttcatttgttataagatacagggagaggagagaaattcagatcatcctttttttgtctttaactaaatctgtttttactaacagcagtaaaatatttgttggaaaaatggaagcttaacctgtctagactgtgacctataccataaaatgtgtggtctaggactgttgtggagtgtcttgggctgttcagggaggtttccttgtactaagatcttgttaaatctgattctaagaattgcattatgttgaaatttttgtttcttggctaaggtgatgtttctgagatacctgtattttatctctagatactattagcttttattagcagaactactgagattttattgtaatattttaaaaagtggtggatccagtatcgtttttataggcttatttgcaggataatagtaagattagaaaattcattaggataatatatttataattgagtgcctcatgtagttctcacttggaattttggaatagcttatacttcctgatatagatccttggggaattaaatgcattaagagtaaatattttaaattttttataaagcagaacagctaatttaacttaatggagggttttcatatttcttgtgataaactaaactgcacatagtttaaagaactgtcagccacgtaggccatataacagctattctttccaagcctagaatccatgccatagaatttatgtaacaaatatttaatgagtatctactacatgccaggcatgttctgctgagtgtgcagtaatgaacaaaatacagcaagttctttctttcatggttacactctaggggtgaaggcatgcagttacatagccttaccttgggtgtttggtaggtaaggctaagtagaaaaacaggaaggtaagaggcgtgtagagaatgagggatgtgagtggagggatggtgtcttctgtaagccatcagagagggcttctctgttaggttccatttgagcagaaacttgaaataagtggggagtgagctgtgtggatatatggaggatattttagagaagagctttctagccagtatgagagcagtaccagatcattgtaagagttttggttttcatatttgtgagatgggaaacgattggaatgtgttttgaggctgatcttaaattatatccatttgtcatgcatatgtgaagaaatggacggatggaattacattatagggagcaactctgtgtgccacgcattgtgatagatgtttacagatccgatcttagaattttcattaatactgtttatttttcagatgaacagtttgtttctagtttttgcctggaactttctcatggcgtgtttgtgtcttcagttccacttagaatgctttttctaaggtggttataccagtttaccgcttgctagcagtggacagaagttctccctgcttcagtctttaccaccatgtgtcttttcatatttgctagccaatctagtgatgagtaatgaggttgatgaccttttcagatgtttattggctacttggatttttgtgttttgtttttgtgaaatacctgctcatctgttaactactttctattgggatgttagttatattctaattgattcatagtaatgactgcctttccaattatatattgtaagtttcttccctggtctgtggcttgacttggagcacttacagtggtgtctgtcctttgatcaacagacatttttaattttaacaattgtttccttcatggttagtgttttttgtcttatttttaagaggtctttcttactacttttctgaagatatcctcttatattgtctaatagaagctttactgctttgcttttcacattgagaatctacattctacctggaattggctttgtatatgggggagattgaggtcaggtttcatttttactgtatggatacctagttgtcccatcagcatttattggaaagagtgtcatgtctccaccgcattgtcatctttgtcataaatcaggtgactgtgtaagtagatcagtttcttgactgttctgttggcttgtctgttcttgcagcaaacctacactgtctaaatcattatgactttgtgttatcttggtacc

SEQ ID NO: 91345 - DNA, 1053 bp, Homo sapiens
aatacgaaaaccactcaggcgtggcggcgcgcgcctgcaatcccaggcactctgcaggctgaggcaggagaatcaggcagggaggttgcagtgagccgagatggcggcagtacagtccagcttcggcttggcatcagagggagaccatggagacagagggagagggagactgtggggagacgggagggggagggggagggagaggttacttattttttaagaaaggcacagttgtaagaatatgtttgcttgtatagccgaaggcacattccgttttgtaggtaggtgagttttcagaactcattacttgtaagttttattttagataaacttcttgttgttggcacttagtattgtgccagtaatgtgccataagaagagacaactttggttttagttctttggaagttgtcaataaacataaaacagtatttcaaggaggaaaaaacccatttcattgttttaggcttctctagattggaagaaaagatggtaatggtcccaaaacactggggggaaagggggaagaaggtgcgtggaatctgtgatttggccataactgctttattttgttttacctgttgttatcatttttagtttaagaaccttttagcttgtatcacttgcccttatctccagagtgatgtctcaatctttttagtctgtcatatgcaattttccccccttaaactacaactgtttatttgaaaaattataaaagtacaggaaaggtgaaagaacaatatgatgaccactgtttagagtaatcagttagcattttgtcctatttgcttttctctttatatattccttttttttcccttttccccctgcagaaccattcaaaagtgaattgcagacatcatcacatcaataatactgaagcacttatcattttacatcaaggtcattcttctacataaccatatctttttttacactcaagaaattaacattgacatgtaccatattcacattttctcagtttttctaaaaatgtcctttataactctctttcaatgcaagagccaatcagagattactatggcattt

SEQ ID NO: 91346 - DNA, 1410 bp, Homo sapiens
ctgggttcaatggaccctgactgtataccctgatactttgaattcaaatccattaccacaaggttcttcttaaattttccccagtctatatttgaaactccccttctttcatagtgaaaaccttggttctcaacatctgcatttattcatttgctctatcctacaatatatacaaaatagcttcagaattactgcattaataccactgccaatggcaaacctgaagtaaagttcaaaatgtctttgcagtttcattggcttttgtgtaattaatgcttttggggtgtacagttagggtactgatcccaaaagtcacttgaattactttttttctgtgcagttataccttggatttttatttatattgaatcttagtatttgttttttatctttttcacttaattgcattttatgaatacatgaaaacatttgcatggttcaaaatcacaactaaatcaaaagttatccctactgaggtaattctgattcattcccattcctgctcttacttacccctacagataaacttttttttttttttttttttgagacagagtttcactcttgttgcccaggctggagtgcagtggcgcaatctcggctcactgcaacctccacatcccaggttcaagcaattctcctgcctcagcctcccaagtaactggaattacaggcgcccaccaccatgcccggctaatttaaaaaatatttttagtagaaatggagtttgaccatgttcgccagggtggtttcaaactcctgacctcaggtgatctgcccgcctcagcctcccaaagtgctaggattacaggtgtgaaccaccacagccggcctagataaccatttacattcacttttgacctgtccttcctctgtttcttcttcaaaaatacatgtgttcactttatctcccctccatactgctttcttatacaaaaggcagcttattttgccttttgttcatctcattaaatgataaacctgggaattactctggttcatagagatattcctcatcattttttttttatttttttggagatggagtctcgctctgttgctcaggctggagtgcagcggtgcattctcggctccgcctcccgggttcatgctattctcctgcctcagccaagctaattttttttttttttttaattttttagtagagacggggtttcactgtgttagccaggatggtctcgatctcctgacctcgtgatccgcctgcctcggcctcccaaagtgctgagattacaggcgtgagccaccgtgcccggcctccttatcatattttgtggttgcatagtgctttatgtctgtgtcatcagatattcagctgatatcttattgatgggcatttggtgttttttagtctcttgatagtatagataatgcctcagtaaatcactt

SEQ ID NO: 91347 - DNA, 1059 bp, Homo sapiens
tttgcctttgatttttttcctcttttctaagtctgctttctactttactgatttcttctctcttttttcctgtttaagattttcctttgcctgtaatttttctagcccttagagatgatggttgaggttactaatattaacctttccttattataagatatgcattttgagctttaaatttttctcttaatcattgccttaggtactgcacacattttgtatgtcattttccttatcagtcatttaaaaatagtttctaatttctattgtgatttgctcattgacccataaattggaaatacattccttttcaaacattattttctacttatttttctgtttctctagtgtggtcagagtacacattctgcataattgaaatttaagtcttgccttttgacctaatgttttctttttcttggtaaatttttcataatttacttggaaaaaaatgttaatcctgcagtttttgggttcagtatgtgtctgttagttcaggctgcttgaatatgttgttccagtattttatgtccttgttaatttttttgtctgctaattctatcatttattgagatatgtattaaaatagtcactaggattatagatttatttttctctctttttttaacctttgctttatatattttacagctatgttattcattgtatacaaatttaaaattgtaaaaacttcctggtcagttgaccttttcaccattctgagatatttttatctctagtaatgctacttgccttcaagtctcctttgttggatattagtattagtatggtcacaccagctaaatttgtttgttttgtctatctttaaaaaaaatcttcttaacttcagtcttttgggttcgaagtgtgtcttataaacagcatattgttgtggttttaatattcagtctagatatcttttccttttatttagagtattttaagccattatatgtagtaggattcctgatatatttaattttatcacctttctattagacgtacattgtatttattttttattcaaaaaattgtagtaaatataacaaaatttaccat

SEQ ID NO: 91348 - DNA, 3141 bp, Homo sapiens
ctatgttgcccagggtggtctcgaactcctggcctcaagcggtcgtcctgccttggcctctcaaagtgctgggaaataggcatgagctaccatgaccagcccattttaatcatttttaagtatacagttcagtggcattgggtatattcacgttgttgatcaaccgtaattaccatccatctccaggcctttttttttttttttttttaaatcttgcaaaactgaaactctgttcattaaacaataactctctattcttccccttcctgatctggctgccagcattctattatactttttgtctctatgaatttgattactctaagtacctttaagtggaatcatagagtatttgtccttttgtgattgggttatttcacttaccataatgtctcaaggttcgtccacgttgtggcacatatcagaatttcttcctttttaaggctgaataatattccattgtattatagaatgtattatgcagtgtattatacgtttttgtttattttagcatccatggatacttgggttgcctctaccttatggtgattttgagtaatgctgctgtgaacatgggtgtttggtttaagtatctgcttttgattcttttttttttgtttttttttttttttgttgtttgttttgagatggagtttcactcttgttgcccaggctggagtgcaatggcacaatctcggctcactgcaacctctatctcctgggttcaagtgattctcctgcctcagcctcccaagtagctgagattacaggcatgcaccaccacccctggctaattttttgtgtttagtagagttggggtttcaccatgttggtcaggctggtctcgaactcctgacctcgggtgatccacccacctcggcctcccaaagtgctgggattacaggcgtgtgccactgcgcccggctgctttcgattcttctgggtatgctcagaggtggaatttctggatcatatggtaattctgtgtttaatttttaaggaactgccacactgctttctccggtgactgtaccattttacattcccggacaaattcacaagggttccagtccacatactgggcaacttttggcatttgcattggctgtttttgttttctgtaaggaccatcctcattactggagtgtcaaatggttccccattatagttctaattgatgtacttttatgttcttttttctctgctttttttttttccttcctttggatcaaacattttgtattgttatttcctcctattaacttgtttgtgatacattattttttactacttttatactgtacttatggtttagtactaaatataatatgtatttatagtatctttttttttttttttttttacaattccttttcactaagtaagtctctggtgtctctagagatcatagcattcattcatttatccagcccacctcttgcatgattgctcccatgcattttaattctacgtattttaaacaccacaacactgtatttaattgttctgtgtggtcaatattgatttatctttacccatctttttttttttttatcctgtacctttactcttcaattctttctgcatttatattactctgaagagtcctttttgttgttgttgctgtcttttttttaaccgatcacacttatttaataacaatatctagtttaataatttttttgataagacattttattaacaacatgtctagtttaataaaccgtatttcttttaatgaaagtctgctggtgcagaattctgtttctgttgaaaatgttattttttccttcatgttggaggatctatttgctgtgtatgtcactatagattttcagttattttttccagcatttcaagatactctgttatctttcactttctgtcattgatgttgaagttagctctagctctaagtcttgtcactcctttgaaggctgtgaatctcccctgtgcctcctccgcctacccccagctgcacataaagttttccctttttctttggttttcatcactgttaactatgttgtgccttgaaattttctttgtgcttctcttgcttgggattcttggagtttcttcagtctatcggctgatactttgatatcagttttagaaaatccagaattcaagatcttttcaatattgcttctgctgcattctctcttccctttctggatcttgcacttacactgtgtttcacatgtctcttattggtcttttctgtattttccatgttttatttttgaatctctgggctttaatttggtgttttcttttgacctgtcaagttcaaaaatcctgatttctgctgtttaatcttcttttaatgccatttattttaatttttggttcttcagttgtacaattttcattggtttcttcctgtagatttcagttctctagtgaaaattgctatttttaaaatatattccttttatcttttcctctatttccttgaacatattaatcattatgtttgttaacaccagtatctagattgcatgtgtgtttggttctgttttatatattttttcttttgacttttggtcatatgatcctgtttcttggcatcctagttatttttgactaaatcctgggattgtgtctttaaagattgtagatattcctgaaggtgataacttcctctggaaaaggcgcgtcctttcttctactgaagcagatgcagtgggagctggtcaccttactccgggcaggtgctgggtggagtgaaggccaggttgttgttttagtaagccatctgctgcttctggtttcttcaggctttcatctggaagcttgattttgctcactacaccatatttccttggaggcttctgaactaatttttgtttgatcctgagctctgcttttcagagttttagtttatctttttggccttcgcagctcagaatttgacagataccatgggagggaaagcagttgtatgcttaagacctctcttgtgctctcattttactaccatatagccttgtcagactgcgcaagttctgcttgtttctttctgctagccatggctgtctcctcagggcccaacataattctcagcctcttgcctgtgcctcctgttgtctgagaaaaaagtggcttcagatgatcagctcacttctccacagttct

SEQ ID NO: 91349 - DNA, 1086 bp, Homo sapiens
caaggtggaattcaggcagtatttcagattcagaaatgtaggtcacaatttcttatctgcagttcggaagcctgaaaagcactgaaaacacagttattcttaagtttatggcatattcattgttgacaaaactggaacttatatgggtgaggcatttattacattttgaatattcatatgtttcattgcaaatgttatgtttactacatggccctacctcatggagctttcagccagaacagttagagttcctggatctctagttcaagtcacccccaaaaccctccaaacatgtaaacgtcttcattcttagaagtattactgaatgtatgtgtcaccactcttaaaatatttccaataggagaaaactgtaatagaatacttaagatagtgagtaatgattactgaaagaaaaaaagagcccagtttgtaggtaaagccaacaagggagggagatgtatagtgccagagcacgttagacatagtccgatatttgtgtaaaacgagactagattggcatacaggaaaaaatgcttagaagcctgtgtaggaggaatctggctaaaacataaaggtaaagattaaggagacttttgattccatcttagctaacattttaaataagaacatgtaagtgttttcagaagtggctccatataattggacttagctttcattagcagttttgctttgcagcatatttggaacataatttgtttaaaattgaaatggttttctttacttttatggtggttgatttatttatttatttatttatttttggggacagggtctctgtctgtctcccaggctggagtgcagtggtgtgatctcggctcactgcaacctccacctccttggttcaagcaattcaagctacctgagtagctggaattacaggcatgcaccaccacacctggctaatttttgtatttttggtagagacggggtttcaccatgttggctaggctggtctgaactcctggcatcatgtgatctactggcctgggcctcaaagtgctaagattacaggcgtgagccactctgctcaggctatggtggtttttatacagcaacactcagttt

SEQ ID NO: 91350 - DNA, 7453 bp, Homo sapiens
attttctttttgactcagcagctttaaaaccaaaatagtaagatctgtcttgaagccacagtctagcaggagaagcaaactatataaatttagacagctctgattagcacagttcccaaactgttatattatgcattaacccatacaggaagaatttaaaattgcagtatggtgagacaagttttagaagtgaagcatttttgagaaaagtatcaaagatgaagaagtactcttgaccttttaggctttctgttccagtctagttttagtgtggcattgtatttaacttgccttagaaactcataggtttatgccctcttgtggtctgtcaccaatataaatagcacaaatgaaaattttaagtactggagatcttactgcatgttactgctctcctttataaaataatttttaaaaagcagcttctgaggaacaacagctaagaaattattattcctgtcttccatataatgtgtggagcttaaaagttaccaaatgttattttaacccttggtaacaaaatgtatgtgtatgttaggtggacactaatgaacagaaaaatatttttggatgggctgtccatcattgtccttctaggtgtctaaccctattaatttataagtgtcttaaaaatatgatgaggtgtgatagtaattgtagggctagcacattacccttctaccttcacctaaacatacacagatatactagtaaatgatgcttgggaaatgtgtttatacttgtttcatctgaaagggtcaggagctgtaggaggcattggaagaaataaggattataatgttagtgaattggtgaacttaagcttacagaatttgcttttactgacatgattggcaaggtcttatttgtgagtgtgggactgaggaactaactagtggaggagaaacagcaatagcagtcagtgttttaagactgcagctgtaaccagtgtttttctgctgttatccagtaagccgcatgatggttggaagcaggccagtatagggactgtgcactttaggattagatagaatccctgatagaaagacttggttttaaaactggtctcatctcttaccagttcctggacagttgtgtaatattaagtaagttacttcatctctgaatacaggtttcctctccaaataaagatttaaaccgcctccattgaactctttgcagttcgttttgtcacatgcagtgttggcatatactcctgttgttattgctcataggttaaagacagttttgtgttgcaaagaatggataccatatgactttgtagccactgggttgttggtaaagactcctaaatagtggtaaatcagctcatagttctttttctttactgtggacttactgctgtacttctatgtaggtacatactttattataaattcttgagtgtaaacgaggtcattatgttaaagaatttactagttcaggtattttaaagttgaagcctagtaactatttttaagaaaaatgaaaataatacaataagttttttttctttaggggcactatttgcatgttttggcaggtttaaaaaataaacaaaaactagttttgttcttccattgtggtcttacttttgtggaggacaacaaagtaatgaaatgtttttgtttcttttgctgtgtttttcaagtgttgcttgtagaacaaggctcgctgccttatggttacttttaaaatttaatacttaaagtaattaatctgagtcccctttcaggagaaataagattatttagaataatttaacttaagggaaaaatatttgtttttataacaccttctaaaatttctaagttgtagaaatttactaattttttcttttttttttttttttttttttttgagatggagtctccttctgttgtccaggctggagtgcagtggcgcgatctcggctcactgcaagctctgcctcccaggttcatgccattctcctacctcagcctcccgagtagccaggactacaggcacctgccaccatgcccggccatttttttgtatttttagtagagatggggtttcactgtgttagccaggatggtctcgatctcctgacctcgtgatccacccacctcagcctcccaaagtgctgggattacaggcgtgagccaccgcgtctgaccaaaatttactaattttttcttttgaataacttgctgtgaaatagaagacaactaaaaaaaaaaccctctaaatataatagaactgcttgggcttaaatcttttctgcaagtaggtggaccataaatcatataaacaaagataacctagacatgccatcagaaggctagtctatatatttttatatctacctctttcatctttccccttatttctgatttcccaaatgtcacttctttagtttacatttggatagtgcttatttgaagtctctgatattctacacactatatgtaactaataaagactttaaaatgtaaggcagcattttggtagtgaaaatttctcttgtacattgtgaaatggattttgttgttcgtctatcttcctagggagactgtttaagggaagtaaaaggaacagggcaagaatggccggaacgaagtggagggtagactatggggagtgatggcaagaacacatgccattctaccagtgacttgtttcttaaacataaaaagcatatgtgccaaatttgcatatttactaattaaaaaggcttcctggaaacattaggtagactatcttctataacctttaacaccgtcactaatggatatagcttagaagatttcctcgaaggtcctttaaataatgtaaatgattatgaatgtgtaactagttaatatgcagctacgaaaggattatcatgtagaggttaatgaacattctgctcttatggtttgcagggctttgctttctgtgcttttggctctcttcatgcttggaaacacatgcattgggattggaaaacatcctgactgttcttgggtctcatcttttaatggggttgttaaataggaactttatgaaaaggatttcatgagcatttttttcctttttcaatttacatttaattctatttgtctattttgtaattactgccaaatcagaaacagtgaaatggattgatgtagttttagcttggctcttccagatgtaaagtcagtactctattatatattgccactgttattaagtgttgctatgtgattgatacttactgagagatcttcattctaaaatggactttttatgctgagttaatgtgtagtatggttgggtttctgattatagcatgtattttggtacagaatttctgtcttagtatttaaaatgtcccaaaagaggacatttatttcaggaattaaatgttacaatagaggaatttagtgacaggtctaaaaaaaatcgtgtgtattttttttttttttttttttttttttttgctgggacgggatggtgaaacattgagcatatacaagagacaatattggtatttagagcagtgaactagagcagcgttttgcaaaccagataatgctgctctctttttctcatggcctagtcttaagcattttggctttcatcccctagtttctctgtctctaaaatggtatatggtattctagactgctgtttaaaatttttattaataggtaatttaaaagtagataattagcaatccttgaaaacagtgttaattcttaaattgtcattcaaaaatagtgttatttttttaaattgcatttttctttattgtctagtcttcttattttctgagcattttgagaatctactgacatatctccaaggaaaacaaataacttttgtacttaaattcattgttttagtattataaacatagtttaaactggctgtgaagtgcttacagtcttgatcataattcactggggaacaaatgagctgttcagagcatctccttatcccaagtatttcttcttgaaaatgtagtagaaaaatatcactgaattcattttttaatgcgtcagaataaaaattacaggtgaaaatgtttggagatatactgacaaaataaaatattgtcactacagtcattttttttaactgacgaaacgtggatgttacattggtttcttgttatttataacatttatgtattctacaaaatatgtaatattgaaaacaggtctgtagattgtacaaaatactagttatcttatatcatatgtcacctaatagttatgaagcgggttttgtaccaaagtatgaatcagaaagctgtaatttgttctgcagttatcagcctgcattagagggttatgataaagtgtgctgcttaaaaactaacgttcacatctctgtgcatttgacaaataaaaatgtatactgagatgctattaaatctgtaaagccaatgttctagttttcagatacactgatttttgtagctctgtgcatagctctgttttttcatgagtagttatctgttttcatgacaggtggtcactaactgccaagagagaatccagcattggtgagtgaaagatggttttattacacttctgaaatactgatggggtaacctacttgtgttcaaataatgtgtttactgtttgcgtgtgtgtgtatgtatgactagtaattgaattcttctagtagtctccattttgaatgcctttaatactaatttatattgtctttgacccttttctgaattacacatttctgatttcctgacgttgtgttaccacttgtatttattctaagtgccttttcttttctaagaataatattaatatcattatgaattggagactgagacatttttgaatgtgacttagctctattttggggatatttcttacattttagtagaaaaataatgggaatcagttactttaaaataatgatggaaatagggcacagaaatgttttcccaaagtttgaaaaaaaaatctaattttctacttttcagagcttgttttattgactgtactttttttttttttaagagagagcatatctattttaatgtgctaatctatagttaataggaccatgtttggtaaataacacactttcctttggcttctgaggaaaatgctcgatttaatggtgaataaaatcttatattatgagttgtcatgaagtatagctgttgatcttacagatatcaaattacaatatatccatgctgtgcttacgaaggttttactgagagaacaacaggagctgtcttgattattgtctgcagggttattgcaaaaatcatggtaactgcccctttagtggtgagattaaaccttcggttatacaccatcaagcatataatattttaaatttattttaagaggctttttcttcatgcctgagagatctccaaggaaataatttatagttagtgtatatcaaatgttttttggtttaaatgcacataggctgcaggcagtggataagagtgaaaattggtgcaatctgtacacatcatcttattaaattttgactattggcttgcagaaaataatctaaaactaataatatccactttataagtaaaaattcaggacttcattaattttcaataaatgcatcgttgtagttgcttccactggtggtgtaagtgtgttagcatttccataatggaccattcgcctttcattatacattcagttcaggttaaaacttgaaatacaagtcgttggccaaagaattttttcccctgcacatttagtcagagtggcccattttacaaataatttccagaggaagtttattaacgtggacttctgtctattggttttggtaagaagttcaggaaattagaaaggtattcactggaaatagatgctagtttacataaatgggtgaatggtaacttgcttctggtttgttttataagattcttattagagttctttaaggataagggcacgttttcatccttttattcacagcccctactgctatgtttggcacaaaataggcacttgataaatgtttgagtaaatgaccaaatatgtggttattttctatataacattttagtttacaaatactctagtagtgcacaagtctagtgagcagtgacagaaatgtgacatttacttcatggcaggttcatgtgaccctcaatttcacttttcagttttgtaaaaccctctaaactgtagaagcttagcatatttgcctacacatatcttgaagtaatatagtactttatacatttaaaaaattatttttttccagttaaaatttgcattttcctctgaatcatttctggtttggttcaggaaacagacttttctctttgcttttaatgaagatctatacatggtatattgctcaaatctgaatggccagtaaattaatcaattcattatatcaaaaaattgaaaccaaagtgtcaccatttccctgaaagcaaggaaattgctgtttgggagagtcgtggaattcttgtgatatttttgcattctcttaattcctcaaacaatagttgagtttctaccatatgccagtattgtgctgctgtttggaattgaaagaccctgccatagaagaattcatagccagacatataacagggaaatcacgataattttgtgctatttgcggagatatgaagcaactacaggagttcagaggctggagccgttcttagggtgtctcacacactacttttaaaagcatgttgctttaattcctacttaacccttggtattagcctagtctaaaatataatttctgttaagcccctattctttatgagtacgcaccagtatagtaaagaagaacaaaatatatggtttgaaaaatgcattcttatgctggtgatgtttatgcttgtttgtataatttttaagggattctttaaggaacaagtatatgtattctaggctcagaaataatctaaattggtttttgtttaaaaaaaaatgtaggacagggagtaaaaatatttatagaaaaataggagtgaaaatggtctgggaccacaggatctacccaaaaaaatctttgagaaaattaatttaaatcctagaactttggtgaacgaagaaatttataatatttgtttagttaataacagataaaaaggaaagattcaagcctattggatgagaatttgtacattattttagagctaataataatggttttcagtttagtgaggatttaaaaaatgtttttgaatcaaactttttttctttataatcctttttaactaactcaggaaataaggtattatgaaatccacacactgttacctccttaaagtatgaggatacttcccactgtttggtccactagtggctgattattttgtttgtggattatttgtaattttctttttaattcttccttaaagagcatggcatttggagtcacagacctatatttgaatcctgtcatttactagcgttttgaccttgaacaattatgctcagagtctcagttttttcttgtaaagtgatgatgatactactta

SEQ ID NO: 91351 - DNA, 1618 bp, Homo sapiens
aacatccaataaaactcttaagcacagagtcctgtttgaggatgaagatgtgaatattgcaacaaccacagtgcttgtctgagaagtgcatcacttggtgataatcctgagtgcttgttcttattttgagaaatataagtccagattccactataccaaagacagattggggtgggtatcagtgtaagacctgagagaaatgtaggctgtgaaaaatggaggcatgcctataatttactttttactaattcatattgaactcatgatcaaattggtgagggttttcacatttttcttttatttttaagtcagttgataattttgaggtttttaaatatttggtaggttcaaaaccaggattgccatttttcactgttgtaaaacctcttgagaaactttaacccggaggtatctatgattgggcctctgctgaaactatatgtaaaatatgagttcttttctcagggaagagcctagagtttttctagtttctcatagggatcagtgacctaaaagggttttttaattgctactgtaattaagaaaacccacaaaattacttttttctaaaatatgctttagaaagaaaatatagaaagtgtaaagtagcaaaacctatgaattacggtaagatttaagtagaaatttgcacaaactttcaaagcttaagtcagctataaactcatcacaccttttctaaaaggtcctttcctttgatttgtaataggaatttatattagttatagaaaatttggaaaataaaaagaacaaaaattacatataaactcatcagtaaaaattaactaggcactttaggatatttctttcaaacgtagatgaatgtgtttttacataattttaaaggttttttgctttgaattcacatctcattttcttagagcaaaagattagtaatgagtgaagaaacaggcacctgtgataactgacaagtcttcaaacacatgtgtatggttgttgtagagagaacagtagaacagatttttctgtccaggcttactatatatatatatccattgcactgttttctcattgttgaaaagttaaattgaagaaatctagtagaatgttagctgcatctctctttagataattttgtttcattgacttgaaaaattatgtttttatatgcgggttaatcttggtatctatgtctaatagtaaagttttctgatggactcataaaatataaagaacatagattatttcatcagcatcttctgatgacataaattccttggtataatagagttataaaaaaggaatataccaccattctgcctgaattttgtggtacatttcagttacttatatcaattgaaattactgaatattttgccatgaccatttagaaaaaaagtgtaatgctattgatttaattcaagtacatttaaattttccatgaggagtgttccttttcccaccaaattgcataaagcataacagtatagatccctttttcaagaatttttaaataaaatgtaacttttatcaatttgtttagattgtttaaaaggatactttgaaaaaaatcattatttcttgctttagtaactggaggacatctctttatctatatagaatccatgcccaaacttaa

SEQ ID NO: 91352 - DNA, 7291 bp, Homo sapiens
aaaaaaaaactgggccaggcatggtggctcacacctgtaatcccagcactctgggaggccgaagcgggtagatcacaaggtcagggttcgagaccagcctgaccaacatggtgaaaccccgtctctactaaaaatacaaaaattagccgggtgcggtggcgcgtgcctataatctcagctactcaggaggctgaggcaggagaatcgcttgaacctgggaggtggaggttgcagtgagccgagatcacgccacggcactccaggctgggtgaaagagtgagactccatctccaaaaaaaaaaaaaaaaaaaaaagttcaatgttagtatttgctgtctattttaacttcttactttaaagtaaaattagcaaagtcttattgtttcaacctgatttaaattttatctcccttttttattatttaaaggttggagtctttatcactggcctcaaaggatgtagactttttttttttaatagagatttttatttttgtcagtcacttttaagaggattaaaaatgttgatccctttcatatttcctcgtccctttaaaaatattctattatgacaaatttcaaacatatggaagagtgaatcttgatcacctatctgtctgtaccctaatccgttaatccatttttttctgatgaatttcaaattaagttgtggacatctgtgtatttcacccctaaatacttgagcatatccctcatttaacttgatttctctcttactttctacaattttatgcaaatgagctgtttcccataggttctgtcttgatcttaatcctttaagggtaagggctaacttgtggttgtgttaatggtcttcatcgctgctgcctattttttttttttaatttccttaaaacaaaaggtactctcaaaaggcatattgcacatgattagcaagattcagaaggaagtggttaaagtttcttacatgccttatacctatgcttttagttcttgttttgtataaggaatgttgcatgaggatattggaaaaaaatttaaaattaagagttgaaggcggaacctgatctataaggatccattatgttgaagccaaagaagcaggtctagctattctaagtaagtaggctggagaggtgtttcttaactctatctgggttttgttttccatttgaagaaaaattattttaagcaattaccatttttgattactgtaatgactcctgtgtccaaaaattaattacgtttctaattattaaaatagaaaaaaaaatctgttcaaattttgttataaataaagaccccagacttaacctcagtaatgcattagttcttagcataacttttgcattttctgttgcataggctttgtgatctttaacaggattatttaagcctgaaataatagagatactatttggagatcactgtttgactaagccctgaacatttccacgaatgtagcctttagagagagagggttcctcaagctgtagtttcttccagagacattgcttgactcctcctggcctcccttcataaaggatttctacatgggctgcattttaagtgatcttctacttttgtatttttagaaaataattcaaaatttataaatagcaactctaatcttaaactgctctccagtatgtccgcatttttattccagagagaattattaataagttgaaaactgattatatttgacttgaaatattgacattgatctctggtattgcctgtttttgaacgtactgttcttttaatgtacaaaatagatgttttttgtgaggaagttgtttttttttctcctaagcattgttaccaaaataagacttattgaatggtgactttaatactagcttcttaatattcatagaaatatttagatatctaggctggtgtatttagtccttgagcatttgcagaattacttatctgaaacataaataagctgttagtgttatgttattaatagtgagtgttgactgtctaggcactgtaccagtcagtcctatggagacattctcccattgattgctcacaccagtcctgtttccaaagcccctgaatggttacattcagctgtactgtctttcagcaagttatactatttgtatcaaattggttagtgaaatcttgtaggtaatagtctttcttgaaagttttggaattgatgttttttgatgcttcatgaaaaaaatgagttttgagttttggaaccaaaatagtagttgctccatgctgggcagtgtgttagaccttttatatttaattctgttgaacctgtgagataagtattagtccaattttgccattgaagttactaagactaaggtgaatttgtgtaaattgcatgtagagcttgggattcactctctggtctgacttcaaagccatgttctttctggtacatagccttgtgcatgaagtttttttgccattttatccatataaaaattttccaggaggaggatttttgccttaaacaaaagaataaaacatgtttcgtatttatttatagaaaaggattttttttggggaaagttataaagcagttgcacactagaaaatgagaaagctttcatgaaggaatgcaggtcagaagacctagctaggttaaactcattgcttacctcatcttgatagaggagatctggcttcttgctatgtggtttttccatcttccttctactttgtcttctgtaagagaaaaatactgataagtgacatttattataggttatgtaaaataatatatatgtgaaattccttaagatcttaagactgagctaatttttttttattaattatgctactgttgcttcagggaactaagcagtaagctgaaaccaattctgtgatgtttgtcatttatattatctggagagttgttacctacattgcagtttatcctgatttcaatttgacaatgtctacatgttcttttaaattacttgctgagttggtgaatttttgtttctgttatttttaaaaactgacaacatccttctgcttaaaaaaaattcagtgctgtagttttgcttgcagcctgtatcttagcagggaaccctttggaaacccagtctccagagaaagtttgacgggcatcttggcataggctgctgcctggtattactcaaaaagaagggctgttcatttccagcaggtgttaagagctgagtaaggcccatagcatggaaatacgatcatctctgcccctacagagttacatataccttttggttgtttgaaattacttatttggtagctctgtttgatgtaacaagaaacagactcctaggccaaattgaaacgccttttgtattatctctacttaatttcttctacccccagttgattctctcttaccttaatcacattattatgaataattgaagagctgatgatgcatttttcagcctaaggttttctgatgaggactaaagcatctgatcaaatttcatgttcatgatttcaacttcacagccagtatctattcactcaaaagctttattaaatctcttctttcggccgggtgtggtggctcatgcctgtaatcccagcactttgggaggctgcggtggggggatcgcttgaagccaggagttcgagaccagcctggccaacgtggcgaagaaacctaatctctatggaagatacaaaaattagctgggcgtggtgtcatgcgtctgtagtctcagctactcaggaggctaaggcaggggaatcacttgaacccaggaggtggaggttgcagtgagctgagattgtgccactgcactccagcctgggcaacagagagagactctgtcttaaaataaataaatctcttcttttttcatcttgagtcccttcttctctccaaatatcaggccctcttttactgtctcccttaattttcacattttatttggtccagatagtcttgtatcttaaaaaacagtaattctcaaaatttgagtattctgcttctaaatgccagagtccctgaagagtcttaattcttcaataaatgtatggtagaataatgccattgctaaactgtataaaaacaggattttaaaactaaaaataaaaccacattaatcttgaatttgctaaaattatgtttttgattagcttgttttatgatacctggcctactgggcctcccaaattgctgggattacaggcgtgagccaccacacacgactgaaagaagagatttaataaagcttttgagtgaggccaggtgcagtggctcacgcctgtaactctagcacttcaggaggctgaagtgggaggatcatgaggtcaggagttcaagaccagcctgaccaacatggtgaaacctcctctctactgaaaatacaaaaactagccttgcatggtggcgcacacttgtaatcccagctactcaggaggctgaggcaggagaattgcttgaacccgggaggtggagggtgcagtgagccgagatcacgccactgcactttagcctgggcgacggagcgacactctgtctcaaaaaaaaaaaaaaaaaaaaaaaaaaaaaaaaaaaaaaaaaaaaaaaaaaaaaaaaaagaaaaatcgttaataatgtgtgtatttggtgttttctgtcaacaggaagaaggtagataatgactataatgcccttcgagaaagactcagcaccttgcctgataaattgtcttataatataatggtatgtttggtgtgtttcttttaaagtaatagttgtttcttgtaaacatattaactatgtgtcggttcacagaatgtcaggctgatggactgtgtccaaggtaactatgtagcaaggaagatttgttttgttttactttataagaacacagtaattgtagtaattgttggtatttacctttttttttcagaatatatatggtgacacaaatgacataaatattagcacaaaattggacatatttcaaatggaaacttactatataaaaaatgtaattatgacagaaatatggtactaagtcgtttcttgttagccagagcaggaataggccataatgttttgtaattcacagaattaaaccttaggacattgatttttatataaaaacgtgctgctaatttttgttttaatgatcttcacatcgacatagtgatctgttcatgagccctggattagagcctttcattgcatgaatgttctttcttatgaagactttgttcttttatactagtccaagtattttgtatatatagctagatagatccattaaagctatttgtttactaattcctgctttgcaaaagtgtctactttattgaaaataatttttagttttctttatcaaaagtattttgcattgacaatgtttcactactagttgctttcacttagatttgcaagtgaatgaaaagtataaacatgccgagacagtactactttctttaagagctatatgtaaatatggtgtggatttattttcctgttttaacattgatttatgaacataaagcaattttctttagattttcctagtaaaattttaatatagtgttgaatttctgtgaagctggcattttatttttcccaatgtataaataaaaaaattcagttatgtaaggcttttaatgcgaagtgttttataaaatgtacttttcagtgttttatgttttttcccttttttctttttttttaaacaataggtaccatttggcccttttgccttcatgccaggaaaacttgtccatactaatgaagtcactgttttactgggggacaactggtttgcaaagtgctcagcaaagcaggctgtaggtttagttgagcaccggaaagaacgtaggtacccattttaaatgatgtttctttgttgtatatgtatccattcacagattgccaagctgaagggctgtttcttaccaaaagtaccttccgtgatctatgaatccaggctgtttgtgattctgttgaattgtaggtagtttgagtagaaccaacatttgagaatgagctggagaatggagcatccgggttggaaatgtcacctacattggcatgttttcagaagttacaaagtttcaaagtcattatgtgattttgtagttagaagttgggaagacataaaaattggagtcattttataccttataatttttttttagttgctattatagacttatttttgcacttaatactttagtacacagaaataatgtgttttctccttagtgaactaagagaaatacctgtttacataagtagacaattcttaaaaatgctttttggtttggaaaaaaaaccatattttcatttgatagaggagaccaggtgtgaaaaggtgctacctaaaacagcacccttatcctttttcagttgtttgagttctctgcatccctttattagggcagctcttgagttttgtttatccgtgctattatctgtaggtgtatagaagcctacatacacacacacaacacacactacacattttgcagttggatgagctagcttgggttctagcttagttatattttaaaattaggttcagtttataatctgttgttatttctgtaatacgtatttagattgagagtataatatccgccctacctgctttttaaccttttagttaaatgtgtatttgaaaataaatgatgggaagatccttttttataaataaggtcatactaaacagaaaacagctgagttttctaaagctgaacttgatttcacttatacatgaatgagtactagagaactcatttactcagtgaaattctgggaactatatttggagactctaattgcaaatcaactcctataagtttataattgatatatattttgatcttttgtgacactaatcagaatcttattgttaggcctgtatgtaatttctggcaatgataaatcttttggctttgctgcattatttttgtcatgtatattagcgaaagagaatgggcatacttttttcttaaagaccttactgaagacgaagcctctctttatatactgaagtagctctgatgttatgaaatgaatccatagcctgttgaagtttgttcacattgattttcatatttcagtgaaaaaaatctttataattagttataacttaaaatattaatgggaatacttatactacaatagaatagagctctagagtagagaaacatgtttttgtaaatcactttctagtagttaaatatggttttggaaagtgaccaaacatagatgacttttgggatcaatatttatctaaaataattttcaaagtacatatttcctgttacaataaattctgggccgggcgcaggggctcatgcctgtaatcccagca

SEQ ID NO: 91353 - DNA, 1540 bp, Homo sapiens
agattagggtttggggacctgttcttttcaaacttttatctagatctttggttaaagttcactcttcttttggaaatactctcaagtgaattgccttttccaggtccgatatcccagatcgacttgtagtagcttttcccagccacagttaggttccatttttttctgttgtgcaaagtccattatcagttgtgcagtttccaaaatttggttgacatttcttgtctattttctcttcaaatgtatttgtctttatgggtttatgcctttaaaaatttcttagttgttactttacctaaggtataggggaaaggcaaatactaagtacatgtattcaatgtgctattttaaagcagaagtccaaacctttgtactggtttaagaaggagtacatcctgtccagaggtttgtgagtatttccaccagggggcacgtcctgttgaagctgtcgaaagaatatttaaaaattccagcacacaaaagaaacgaggttgagaatagagtggtcacaaaggattcagtagagaattgcatatttacaggcttcatactattcagtacatatgaatatatggctaagtaaaaaagactcctttcacgaatgatgttcataacttttattagtgttttgcaaataatttttattacatctgcatttctgttcctttcaaatatatacaattctacaaactgttaactaaatgtttctaaatatttggtcttacttagtgagtaggcatatcgtttatctttaggtgaaaatgactgcttaagttcttatgaggttttaaattttcttttttggtttaaacatgtctttggaatttgcactgttaatttgctttaagtctcctttttcatagctaactcaaaggatttcagccagttctggacaaagattctgaattagtgaagactttaaaatattagcttatgcttgctgcacatttaacctgcagcctggttttgtcagctaaataaataaaaactatacctcattctatacttctgaaatcctagaaaatttaacttctgatttttagttaaaataacctgtgtttgaaaacaatcttctgtccttcaaattactaatttttttcttcaattttagtttttattttttggggtggggggaagtatctgtggagaactgtcttttgtacattttcacagctatttctttgatcccattgaatttgttttcttttttctataataattggtaactaaaatgtttgagattaaaatgaatacagatattgtctatatcacaaagtatatttctttttctctcagtagtgttatttgctataatttcagtgtggtttgaaattttgcttaattagatttcaacttagccatgtttggagcgttaaaattgattgagtctgtttaaatgatccatttttagtgacatgtatatttcacctcttaaaataaatttttggagaatagagtacaaaagctttagtgaaaaatgtaatagcatggtttctaatgttaaatctcagagttatagaaagaaatggaattaaattct

SEQ ID NO: 91354 - DNA, 1898 bp, Homo sapiens
tagatacgaatttagacttgttatttactttgtacaaaatcgaaataggtgcttaccattctgctgtattttatgttattgtgagcaccaggttcgtttgccttgcggttgcccagctttcttttgtcttgtcttaaattttctgtatagctatctaattttttgttgctctaggacataggacttatgataatttaatagagatatatatctgcatatataatgtgtatgtgacggtgttggtgcttatcagtttgtggtatttctgagattctgatataaagtatatgcttttgagatctgatttcttaaccttgtgatagtggtttatattaatgtatgattcagaaagctttcttgaatttaaaaatggaactgtgcaatcgtatttcagtttttcataattaccctatttccaaaacactttgtttcttaaatggaatattcacacaactttttcttacatgcgtgagttatgatgaattttttttaaagtcaacaatagttgattgaaagtaactcctataacatcagtgaacaatcaattctttacacattgacaacccaaggctttcactgatacctttagcttagttgcacagtatttatatgtggatagacttttaaaaatgtacttagcttacctacctgccatttttaatattttccagtcttcttgaaaaaagttattgatttgacctcctacctaaaataatgttctttagatctaaagctggttagacacattatctgactgagtttactgaagcaaaaacattccataaccttaaccttttccctgaccccctgcttttaacaactgccgacatagttttatgctgttatgtgaccatgctcggatgaaatctgtcaaacagctccttgagttattaggctgtctgagtctgacctttctgcaatcaaagatatatgacttaagggctcagatttgccatggcaaccggtccaatttgctgccgtgagaaaaggtctaattgttgcagaaatttaatgatctagagcgacatcagggctgtgagattttatgaactgtttacaccgtaattttcattttgttaatgcagtcttttttttgtaacccattcatggctagagcataagtgattgtgttttatttaaaatagcattgcatagcatgagagccgtatcggagaacatgtgccactctcgagaagcccttcatatgtggtgatatttcacttttaactcccttccttattttcattcttttaaaagatattttaactgcttagacctttgccagacctgcattcatcattggtagagaaagaactatgtacttttctcctccatcctcttctgatctgcttactgattgagtgcctgttgtaaaacagtaggaaatcacagagcatctgggggaggaggtatcatatcactgtctattattctttatcagcgcttggccataaaaattctgtatttggagaaaagtaggatattgttcagcatataattatagttagaaaccccatgtattttttagatggtgccatttactgcttagcagagatttctactctgattacagaaacatgaattacttgttgcatttgtccagtattgggtagagaaatgtttgtgtctattctcaaattaaaatttttcctcaaataggttaatagagggtggtatttaggagatgttgaaaggctgtgtgttgtgttgttatgcagtttaacttggaaatggttgattatataccgtaaaaaatgtgttgtattttcagtcatctaatttaggaatattttctgttcaggaacagaataacttgtcttaatctatgttatctatgcattatccagctggacaaaaattacctgtgcaacaaaactgttatgaaatactgcatttta

SEQ ID NO: 91355 - DNA, 1677 bp, Homo sapiens
tgatattttcagatgtatgcaacaatgcagcaaatttgaatatatgatggactcgaggtcatctggtagtgccatatctcataacaggacgcatcttagacttcttcccattactttcccattactttgctttaataaagcaaataaagccttaatttgctttattaaaaaataatctattttttaaaatgaaaagcagatacctctgagttcagatttgacccatcttttttcctcacatgaagattacaaatgaagcagtttaaaaagtagagatgttcatatgtaaaatgataatagaactttacagagatgagccgccgttgtttccttgtagggtactcattccttggcagtgccctggagtttaaagtatcctgtcacaaggcttttgcacgttactgtagtaactagatttccttgagtaaggatggtaaatggaaatttatcatttatgtgttgcatttcgccttataaccagggtgcattgtggccatttcttatgcatttttgaagctcttctcacaaccttgaatgtgtatgcaggttctctggggctcttgttgaaatacagattctgattcagtgggtctagggtgtccttagagcttacacttctgaagtgttccccaaggacgccagtgctgttgatccatggaccacactttgagtagcaaggctgtaagagacattcatccttggagttctgtttggcttaaaaattgtgacccctctgtttcaatatttcccttgccccaaaagaaagtctcattaagtctgggtttgtgccttttttatgttggctattaacagccacgtcttttcctttttctaaatagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgataggtacttgatgacaaattatctttccaagataatttgtttctatacacatttcctcattaatctttttcttcattaataaaataatatgtgttcattgaagaaaatgcagggaagcataatatattatcaataatcctttcacctcaagatgaacattaattctctggaatattttcttataggattgtgtgtttgtgcatattcccatgcatgtacatgtacttaaatacttaagatcaacatcttcattttttattatggcctattttatataattaattataccagatagttgacttttaataatcatggatttaatatatataatgttaaattttaaatgaagtatttttatgccacacccaggatagtgctctatctttgaatgtgttgtgaaaaacaaaaatacactttgaatttaaatttgatacagtaaaatgtttattcttgctttccttttataaactttggagcaggtaatttgtaatctggtcagatagctatatgtatgagaaactttacgaaattgctgtttgaaatacacattagcacacacttagaattgttaaaatgctaaatgaaatctgctactcgagaagttctatattattttgcttaaatgatgtaccatatgcaataattagtttctgtgaaaaatagggcaggaag

SEQ ID NO: 91356 - DNA, 1260 bp, Homo sapiens
gcatatgtataaatcctttatttttaaaaattacaataatacatgctcattgtaaaatattctgagtataggagtagaaaataagtgtgtattatgtggtttcaatttctggtctttagagataaatgttctctgaatttcttacaactttattattattgatactatatttatattgcatatggccaatatctttcttgcaaagataaaaaaattatcttctatattctacttatgtctgaataacctcaatatatagaagcagcataggaactgttttttgttaatttatttcaaaacatttttttgtttttgaacttagaattctagttttaaaaatactttattcaagatcttagtatttacccatggaaactaactggaaatttaaataatgtaaaattctagtatgtttgtttgatcttgttaattttcttccttgctagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtttgtatacttttaactttactaattttgcatataatttgaacattaagcattatgatattttttagaagagcaatattaacaatcattatcattgtggatagtgccagacaggaaaatcatcttttgcctcttgttctgaccaatttaagaagaaaaagggaaaaaaaatttagttagctggtattggtccattgttctctgaaacaatgcattgtttggggtctggaaggggatcagatttgagtggcaactactgtaacttcacctgtccttcattcagagagttttcttaagaatcctggagttaattatattgtggacattttggtgtgcttaggatgttgaaagtgactgcattagttaaatttttaattatgccaggttgttttctatggacataaaatgaatacttcataggcacaaagggaaaatgtaggaggaagtaaaaattagtttcttttc

SEQ ID NO: 91357 - DNA, 1519 bp, Homo sapiens
tctctgctccatgtactgctctaaggggacactgggaattcgtctaattcgtctttctcagggaaatttaaggcctagaagacatagatctggttggtaacaaaacaggaactctttcgcctctgagtgccctttctacacaatatcccgattgcctgtatcagttaagggtctgtggtatcattcttaagtgtgtgtgattattatttagtgaaatatgtttaaaacatatttgatatttcttagcttcctaaagttattcctgctcctatatgaagtgaaataattgtttgtgtttttatattctaatatgtcagactgaaggggtcttcccctgattcttcgggaaaagttgactgagatgattagccagaaaaaaaggtcgctttttaatcttttgccaggcttttacttttttcctgttttcatttagataaaacagaaagaacaaatattatttgcaggaacgttacaggtaatagtggtcattattgtggaaagtatgctctaagtgctgactagggatagaaaaataacatgttaaccccatgtgaaccctgaacaggcttggtttttatttttttactccttcaatttctaaaaattagagatgttttaaaaattctaaataggcattatttaatagtacttttatgacttaaaggttgtattcttactgaatttttgtttatactctttcttttgaaatacataattcaagccaaacacttatatcaaaggaatggggtgatgggaagtttataagaaatctagcatttagttcaaatgtattttgctttctctacaataataaagacactgaagactaggatttgttaataaagaagattttctttagatgtcatagatctatgagataaggactttttaaaaaattccatctgataatgcacatcatttcagcatcagaaaatttcagctgcctctcttactattatttttttagttatagagtttatttgttttggtttcactttgatttaatttgtcaaaagattcttaatttcttgctctgaaattttaggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacaggtgggaggcgctcacagctgcagggcagtctgctgggcttgcctctctttctgccactgaacctttactggagaaagttgactgtaacacagaagaccctcactgaaaagtgaagtgttctgaggagttaacttaggatctgataggctgaccggctgtagcttcccagtccagagcagtgggaatggaggattttttttttttttcactttctcctcttcaccagtgcttttgaaacatttccaaatggtctagtcagaaaatcttgtatcttcagaaagcatttttgtttccagtgggctaggtccctacgtttctaccacagccgtaa

SEQ ID NO: 91358 - DNA, 1066 bp, Homo sapiens
aataacatgctgtgtttttgttctcactcataggtgggaattgaacaatgagaacacttggacacagggtggggaacaccacacaccggggtctgtcatggggtggggggaggggggaaggatagcattaggagatacacctaatgtaaatgatgagttaatgggtgcagcacaccaacatggcacatgtatacatatgtaacaaacctgcacgttgtgcacatgtaccctagaacttaaagtataataaaataaataaataacatgctgtgttttattattaggccagagaaatagctttcaaaatagtatgaagataccatttgaggctataaaattattgtgattgtgactattttagatataagattgtaataaaaattttcagattaatttctagaatagattcaaggaaattttcaaaaagttgttctcagttttatgagttacgtatagtgaatgcatatgtgttttgaatatcacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggtgtgtgtgtgtatcttttaattctttatttcatatagtatctttgaccagttttagctatttaatctgaaaagtcataagattaaattaattctaggttttatactttcttggtactaattaataaaaaattaatagtcacaaacagtacaaatattgtgataatcaaatagtttattttttgataaacacattacttgtcttaacgttctatttcagcaaaatgggaaatttaaaatgtcttacttggcattatgtattacatttgtagctaggaaattatttcgcagtttattttaaataaattaccagtaggtcattttctgatagtgta

SEQ ID NO: 91359 - DNA, 1029 bp, Homo sapiens
tagagtgtggaacctattttttatttcacccttagtagctttgcattttgtatggaaatgtttaatagtagttgctatacattttttaacatcaaagaaatagttcatgattatggtaagtactttggaagatatccttttcagtatctttttaaatgctaaaatacctctttttcaaaggcattttaaatagaagaaggagaagaaggctctatgctcatcgtgataaagtggagtttttaggaaagtaagctttaagctgcttttaccagttgaactccaaaaataatgtaggagagagatggctttctttgtttttgtttcagtggtggggcaaggtagaagaaggtggctttttaaattatttaggtgttacgttgttttaactaattttgagcacttggtagacagaggagaacaaaatgtacattaaagttcacctgtcaaattttcatttgtagagggaaggatggaggttctaaataccagcaatcttaaaaaaaaaaaaaaaattaactccttgtgtcttacctatttttgtataaaacgacatgtacagatatttccagcaatttatgcacattctttaattctgttccagttgaacatatagttgaccagattaaatgcagcaaacatccaggtgaaattgagtcatttctttttttgtggaacttctgatttctgtcattgagttaattatattaaaattttgaaacctgtacttattcctactagtatcagcacttttatttttcaacttccactgatcttttaaaattgaggcaatatgcagtaaaatatttaaataattgcataaacaccaccaaagagatatcagttagaaatgtcagtactggtgaaactaagctattggctagcaggcagcaaggccatcataggatagctcattcatcaactgatgtacaaaagtcagagtttgacaccctaatagcatttttattttaatacattatttttcacagcatgggctggacatgaatggaatgtatgaaagtttgaagacct

SEQ ID NO: 91360 - DNA, 2444 bp, Homo sapiens
cttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaatgccagtccaccctctctattcatggctaaatatttaaaggttatttatagcttctttaatgaattcttcttaaacaaagtgaaattatgtcctagaaaagtagaagctattcgtaactagagcagtgcaactttaaagttttatgaatatgtattttaatgacaagggggcgagcttgcatccccactagttaatggataattcaaaccgaggactgattttgaaagatcacctaaaaatgtagatttgttctttagtaaatttagatcaactatgcatatattttgtaggtaaatctttcagtccatgccccaaccctcaccaaaaccaaagcagaaattacacacacaaagatgctcccgttaggaattgctattcacatgaggctttctgtgctagatttttttctcagaaacaaactttactgtaggactattgtggtgttcttaacagatttgtaatttcaagatgcgtgtcattaaataatttttcatgttcacagacttgattttgagcctgtctatgttacatctttcagataggttttccctcatagaacaagatggtagtagaagcagataaagtgtttgataacacatttttgcgtgttctgctctggagaccatgaaatagtgttgccccatttcatagcttcagtcttataacagagtattaaattgtaatttaaaattatagcttttttatattaaagtttgggacaaaatgaagctgtcttacctgttctgttttaaaccattataaaacagaacagcagaccaagagattctcttttaaactttctattttgaaatataataactttagtctttcagaaaattgcactaaatagtaccaagagttcccatataccctcatttcattcagcctccctcaatattgtaatatagaaccgtaatataattatccaaatcaggaaatttatgttggtgcaatagcgttagacctaaattacagatcttacttgaatttcaccaacttt

SEQ ID NO: 91361 - DNA, 1011 bp, Homo sapiens
ataagtttcaggaggttttcttttttggttgattctttccagttttctacaaagatgactgtcatctatgtacaaagacagtttggcttcctccttccaaatgtgtataccttttatctctttttctgtattatcaaggacttgcaatatgaagttgaaaaggagtggtgagaggggatatccttgccttgttcctgattagtgggaaggcttcaagtttctcaccattaagtatgatgttagcgtgggtttttgtagatttttaaaaattaaattgaggaacttcaccctattcctagtttactgtgagtttttattattagcaggtgttggattttgccaaatgctttttcttcatctattgatgtgatcatgtgatttttttcttctttaccttgttgatgtgatagattacattgattttcaaatgttgaaccacccttgcatacctagaataaatctcacttggtcatggtgtataatataatcctttgcatacatttttggattcagtttaataatattttcttgagttttgcatctgtgtttattagcaatatttgtctgtagtttcttgtaatgtctttgcctgattttcatatggtaatgctgaactcatagaagtagggagtactccctgtgcttctatcatctgaaagagataggagagaattggtgtattttttttttttccttaaatgtttcatagaattcataagtgtatctgtctgggcctgcgctttgtgttttggaaagttattaattatttaatagagatagtcttattccgattgtctgtttcttctcgtgtgagttttggtagattgtgctcttcaaggaattggtccattttttctaggagtaccatatttgtgtgcatagacgtgttcatagtatttcttggttatccttttaatctccctgggatctgtaatgacattctctttttttatttctgaaatcagcaatttgtgtcctctctcttttttcttagttagcttgtcttactga

SEQ ID NO: 91362 - DNA, 1049 bp, Homo sapiens
tgtactgtaaacctttgccctgtgagggacacgggagtccctactttagttgaaacagacatggtctgtggggttggtgtgcctagtgtgggagtacttggtctgctagcaactgaaccaacacttaactgcgggactgttactcttcccgtggaagttgatgcctttttctgtaaagatttcagcctataatttggagctgttaagcaatatctatcaggtggcaatctaggacctgaatatggcttgattaatggaaaaggggtttgatttctttgccttgcgatatctaataaaaaaatctcttgggggaagagaggtaaaagactggtcagcgtggaactggattgccaactgcacatcatctgcatcaacggtagctttcttagcatggctggagtaaatttttgcatcatctagaattgtggtcacataacggaaggcaaactctaacatctgatttataagtcttggctcatattctgtaattcccagatccttcaggatttgtgccatcatctgtgcatctttcggcatgctcttgggagaagccatcttgccagactccatgatatacgatgatcagacttcttgagctaaatcacccacattaatgtatttcagtcctgattttgacacaagtcctttgcctagtgtggtttttccaacccctggtgtactggtgagcaggatgcttggaagcaacatggtcctccccacgacggctctgagcgccttgctcacccgcccttcacattacgggaaggaccatttaaaacgtgattaaagcaagttctacaggctggaggaaaagaaaaccaggtggcaacttcaatgtacagaaaataatgaagagcactcaacatggtaaattcacaggtagacaatttaacatttaaagaaaaagtttcaaaggtaattgagaggaatgacaaagtgaggacctttgtaaatactttccctaaaaagcaaagataaagttggactattagtttctggcctggcatacaagcttggacgttgtcactacatcctaataagtaaacagc

SEQ ID NO: 91363 - DNA, 1070 bp, Homo sapiens
gtccccacagacccggggtccctccggagttcagcaggctgtggagtcgctggccagccagccatgaatccctgcacagtgcctgtgcaagtcacccacttgcctgccctgtcacgatgctccatgaggccgggtccgctttttctgggagttatcactgtccagcttggtggtttactcgtcctaggtctgtctcctccaaccagaccttaagctgctgggagcagcaggagcagggatgtcctcctggaaggacatgggcacaacggacaatctcatcaggagagaggggacttgcagtggcacctgcatggaaatcaaaagagcaccagctgtgtgctgcagaggagggggtccctccaacctgctccacttcccaccccccatcctgtctgtccagcttggcactgtcttgcagcacctagagacgcaccggcccaggatcagccaccaagcacagagtagcactcactgaagatccaggcactttttggggcacacatcaagccaccccaggtgggggtcttcctacttcacccgcaagggtaaggcctgccctgctgagggtagtcacccttccccagtcccccgggagctggctaggaaagcagggtttccctttaagggtgatgcctgcagcagccactgtggcctgcctggcccagcccccaccccgtggcacctgcccacgcggcacctgcccagggcggcccactgtgctcccggcagccctcctgacgtcaacggcagccgcggggacgctgcctcctctgccacacgttgctcacaaagtgtaggcaaaaggcaggcgtccaattgctgcggatgaggaagagaaataatttcgtttctaaatcaggactcagtaccggtggccaggccccggaaggggcatctgtcggctgcacggcagccactcctgcaatggaggagatggtccagttctccatggggacttggggggctccccagctctggccctgggtgccgaaagccctgagaacaagccatctgaaaattaggattctgcgtcgcctgtcaatccccagaagcccacagcctttcattaa

SEQ ID NO: 91364 - DNA, 1040 bp, Homo sapiens
gagccacaccgtgttcccagagccttgtaggcgcagcaccagctcccaggatctgggaggcagagctcagctgttggactcatgttgtcagggttatctttgcactttgacctaagtagctttccctgtgggcctgtgctctgatcccggctcgctggggaggtcccttctctccctcactccaggggcctgggcaaggtgttgggtaggtggtccagggctcttattggtctgataggaggaatgtgcctgtggcaatgagcaagaggcaggctaaggtgggtgatcgcacccaacccctcccctttctctgggtggagctatttgtttgcttgtctacacaggtggttcctgagctcctgcagggtacccagccccgatcccccacccactggccccactctccctgctggctctctacctgcaggccttggcctaaatggcatgtctcagcgaggcctttgtggcccaccgggtcctcctccccaccacgcctactagtttctcttccatgcttctctccccttggcacttctgcttattcttcttatttcactgttttcttctgtcccagattatcagctccttgagggcaggaatctcatgccttttgttctctgctgtattttcagcacctagaagcttgctcagcacataataggtgctcaacaaatatgcattgatggggagaatgaagaggcatggtccttctcttgtgaagtgtactgtccaatgtgagtcacacttaaggagtaagggatgggtcataacagtttatagggcatagtgaaaggagttattgagagtagggaggcgaaggcttcctggaggaggcagtcagggaagacttcctggaggaggtggcctggaaaattgagtcagagttttatatgcagaggtaagaaaaggaaggaaggatgatggtggggcatgagccacccccctctgggccctctgtagcagggtctggtttgagaaggtcaacaggggcccgataggaaggtcctgagtccagtgaaggatccttgtcttggtactgg

SEQ ID NO: 91365 - DNA, 1038 bp, Homo sapiens
ccctctgacccactcatcctcccacccttcctccttccctctctcccacccttcctccttccctctctccaactcttcctctctcccacccttcctccctcccaccctctctctggccctctcactctcctgccctgtctcccttctttccattcttcctcccatgagtacccacccactgagcatctgcttcttgtcaggtatgttctgggctcctcggattcaggctgctgccctcatggggtttgcatgcctactctccccattttacagcaaggaagcctgagacctaaagaagctgtgacctggggcgccatttccgatgaggatgttatatgatccgcaaaataagaacacacagtttccagagaaagaaaaacaaatggcccatatgcagatgaaaatattttaacctgactagtaatcaaagaaaaaattcaaaagttgttttggtttactgatagattgatttgctcctccaacccaacaacttatgagattgataacaatgagtattgtatataaggttgggagaaaccagacactcttagtccgcccagtagctgtttatatttatacaaagttgaagagtaatttgggaaacatgtcaaaagccccccaaataagtgtctgcccattgtttcagcaattccctttttatgaaattattctctctatatattatattattatgagatatgttaatatttaatatatttattaatatataatacattacatattatatactaataaatattctataaatatatgttataaattttaatgaatattattataatatatattttatgataataaatatatattataatgatatatgaatgtatactatatatatggtataagatatattaagatatgaaatatcttatatagttatattatctcataccttatataataagatgtatcatcaataatctatattattaatctatatataatatatctaatgtatattagatagccaaagatgtttgaccaaggatattcactgagactcagtttataaag

SEQ ID NO: 91366 - DNA, 1058 bp, Homo sapiens
atcctacataggcccagagatttatccacagagagacaagggcagaagggaaaattgggtggacatgtttgctgtggtctaattgctctaagatgaatgaggaccatagagagaactaggtacctcaccacaagatgcaaacatcagccaggaaggacccaggtgcctcctttgccgtcctccgtcctcctgggcagcttctccctgcacggaccagccggcctggtgtgtgtctccacggcactgaacctgtgcagggcaggctctccatgaatatttgctggctgaatgaatgaactcaggggcaacaggaaaaggacaacgttcaagccaacactagggacataaacttaagtgagacaatgaggccagaaagtctaaagtgttttctgtcacttggtcagatctttctttctccttgaagaagccctatgaagaaagccctggaggagatgataatggcgcctttcaccacggaaaggtcaacccacatgtgttcattgagtgactctgtgggccagcccttcgctcggctctgttgatgattacgagacaggcaaacccacggggtactcttggtaagtaggctggaatcaaaacacatgagaaaaattagtgagcattccaaagcagcatgtcattgtatagaaatgttcagaaaaggtttagagacggagtgtgccgggaggccaggcgaggcttcgtggcggcagtggaagtgcgaggcttcgtggcgaggcttcgtgaagtggtgatgagaaacgcttgaaaggcagggaggagaaggtcgggccttctaaacttggagaagataggggaaggccaggtgtggtgacagatcccaaggccagtgcagcagtgaagaaatgtgtcactgtccccttggctcaggcccagccaccgagtcctgggacgtgatctttacatcgcctggttctctggttgatccatctttccctctgatcactgcccttcctcctggggcctttttgaaatctgactcaggttctgagcacacgtttcagcatttctggatgcaatttggtatcatagcgaag

SEQ ID NO: 91367 - DNA, 1026 bp, Homo sapiens
tgtgtatatgtgtgtatgcatgtgtgtctgtgtgtatgtatgtgtgcctgtgtgtttgtgtgtgtgtgcgaatatgtgtgtggctaaactatccctttccttcaagaccttagaagctgaggcctttccctgcagctgctggactcctgctgctgtctgtctggtgggaattagtcacacgtggagcttaaaaagtgagccagactcaaatacccatttggagggctgcctcaagacagagtatccaggggaaattcgctttatggctgggagttagataccagggttgtcactctgaagagctgcacaaagaagaggtgtcttttgtagtttcttggcagaggggcagatagaccgcagagcgttgttgtttttgccagttgtgtctaagaacagcacccttcatgcatcttacagtgcaaactgatgtctaacacgtgcacaccacctagagggaggcctccagagtccacagcctgtgctcctacttgttggctgtgtgactttggcaaattacttaacctatctgtgcctcagcaactttacttgcaatacataaagaacaacagtacctgtctcggggttaatataaagatgaaaccaactgatatttaaacacaaggcctggcccattgtaagccctcactaaatgtgagctatcgtagtattatttattcctccagggggaagtgtgtttttgctatcttcaagagcaacattctggggtgtggtggctcacacctgtaattctggcactttggaaggctgagacagaaggattgcttgaggtcaggagtttgagaccagcctgggcaacatagtgagaccccatctctatgaaaaataaaagattagctgggcatggtggcatgcagctatagtctcagttacttggggggctgaggtaagaggttcacttgaacccaggagattgaagctgcagtgagccatgattgtattgttgcactccagcctgggtgacagaatgagaacctatctgaaaaaaaaagaaaaaaaataaaagtc

SEQ ID NO: 91368 - DNA, 1091 bp, Homo sapiens
aaagaaaatgcaagaagaaatttcttttaacaacaaaaaaatatttactttgttttaaagcactacaattaatagacaacagggcccctgtggggaaacatcttttcaaaatcaggtgttttgtaggttacttttaatttcctattcataaactgatgcttgcagtctagctggacttggaagggtatgagagaaatatggaacccaaagaattacagctaatgagaacagatggaccacaggacccaagagcatgtagatgtgggatgctctctttagctgcaggaagaatggtttggtgaaggtaagagtcacatttgttatgggctgaatgtaggtccccccaaacccccaaatcatatgttgaggccctacacctcaacatgatggaatttggagaatgggacctttgtgaggcgattaggtttagataaggtaatgagggtagggccctgatgatgagattagtgcccttataaggagaggaagagactaccagagctctgtttcccccatcaatccctatgtgaggactcaccagggaggtgcttgtctgcaagtcaggaagagagccctcacccgaacctgatcatgctgtcaccctgatctccaacttgcagcctcctgaactgtgagaaaatacatccctgttgtttaagcccccaacactcatcacatttgtccccaatcagcaacagtgaccttcttgctagttttgctactcctgaacccaaagtgaggctccatggctttcaaaacattcatgctacatttcaccttgcttgttagccattcagctagaccctattagcagtgcagatgaaaaacagctgactgctgtctgtggccaagatgccagaacccataagatgggtttgtcagcagacttctccctgcagaaatcccctgccaccatggtgtgtgaggtctccaccctggcatgaaaacctgggacaattctagggcagcatatatcctcataaccaaatcccagatattccttctgtctttggaactttgcacatcgctcaaaggacacatggccaagggctcacccttactggcattctggaagatcacagcattgctcg

SEQ ID NO: 91369 - DNA, 1042 bp, Homo sapiens
cctagaattatacaaatgagagatgtattacatccatgtaatacataaaacacctcaacttaaaaaaaaaaacacatattttattaaaaatttaagccctttcagagatgttcggcaacacgcctacggtttttccgctcatccccacccctttttctcaagaggagtccaaatttttctgtctactctgttttctctcggcattccatctttctccgggtttttagggagaaactcactacaatttaaaatgagttgtttggcaaatagagagtgctgtgttagctaagctcttgccttgggatgtgggcacacaggtgggttttacggccaggcagggaagaaagcaggttcccctcctggtgcagggcctgtgccaggccccatcttctctgtggctggccctggttcttttctggcctgttctttgtcctactgacctttacctgggaggagctaaaggacacatatgtttccctccaggaccagctccccacagaatgcgtctcaggggacagagacatcctccctcccgtgccttccgcatcttcacatcctggagcccagatttccacgcttgaatttttcacaggttaaatatagcatcggtttattagaatccaaagtcctgcatctaacagattaaactgacaacacttccatcaccaccagggcccatgtggcttgaagggagatgggatttgtacgagtgacggtggaaccccgctcttgacagtttgggaggactcgacacactttgcccatctcctcaccccactcccaggatcatcttctgggctttccaatttgggggttggtgtgaggatttacaagccaaggtaggccgcaggttctctcgcttgtttgacaccttgggcgtttagccaggaaaggactgctcatatacgtgggggtccatgaattaattttacctctagagaaacatcagaattgggcagtagggctccaggcacgaatgcaaacctcacgtggcacaataacaaccccatgaaccaggcagcatggcggatatggtttgtta

SEQ ID NO: 91370 - DNA, 1052 bp, Homo sapiens
gggccggccttggggaggacggcaggctggtggcctgtcatggcgagtgggccccaccaaaaagttaggcggcgtggaatctggtctcagctctgttatgaacgcctcgtggtgcctctggtcagtcctttcctctgtttggggcctcattttctctcatttcaaatgaagcccatctgtaggagtcacttccttatctctaggatgatctgaatctgagcagacacagccaggatttcagcaggggtcttagacggtgtgtccctgtttttctctctttccagacaagagcatcaattgggtggaggttctcagcacgtggtgggtggagaacgtgctgccctagtctcttcacactacccctgtgtacctgtggagcctaaaacacctgggaaggaagcaaaccccagagctccgaaacctccatttccaaaaaggatcgagagccagtctcctagaaatggagcccttagtggtggtccacgctggagacgatgacaaacaattggacccttgtgtccccaagctgtgggctccctggcgatgacaccggagctgtctctattttgcctgtcgggggaatgttccagcgcattttcccttattatgacttgattaaggacacaataaacccttgccatgatttttatctatttgcagtaatatctctcagttctaatttcagagattagcttgttttccaaacattaaatgaaggacaaacttgatcccattgttcatgcctggcgagcacagccatagccaccacctaccattgacaaacacaagctgctggccacacctgcacgtcactgccatgggaagcagccccgagactgttggagtgggaggcagaacattagggatttcaattctgctttattttcaacttgaaatggaggaaaacagacaaaaaacaaataagaaagctaaacagttgcgtgagagctagcaatttgctgggctcccgatgacagacactgcattatcataattgtctcttctacatgataggacagaaaaataataatgtcattttatttatagctggg

SEQ ID NO: 91371 - DNA, 1114 bp, Homo sapiens
agtgtgcacagccttgagggcttggctgtgcaagttgatgtaggggcggagagccagcatcaaattgggtgctgcggagacgttttttcctcctgcttttggttgtgaagatgcccctcgtggcttctgatccctgagccctcggtgatgccttgaatgagggtagccccacatgcaaagggatgccctaggctgcctatcctgcaatgcactgtgtgtgtgtgtgtgtgtgtgtgtgtgtgtgtgtgtgtgtgtgtgtgtgtgtgttggaggccaggttcaagtacaagagcagcagctgctgtctttaccacctgggagaaaacatctttctgaggtgtgtggcagtgtgggaaggtgattgtggatggggtgactgtgtgggagactgtggtgggtctaccctgatgtatctgcacctgaagccaacttcttcctggtctagatgtggacatttcttaaagtttatcctgggtctacaaatgtgaaatcatctgggtattcgtaaaccagccgcatcactgagagcagaggtaaatccagtgctcccacttggtagagttctttgacaatgaagctgtgtagaggtgaacaacaaaacccacaacaaagataaagaaaagaaaaggaaaaatatgcattgatagaattatgctttgtctttctacttaaatggcaaaactcatgtgtcttcacatctggaataaatgtgatgttttacaattaaacctatttacgggagctcaccattggatcatagcatttgctttctgatttttaaaggcccccaaaccattgaatagtaaagagtgctgaatgccatgcagtgaagttcatgatcataggctactctgtggaactcagggatctacggtggcagcatgctcctgggtgagttgggcagctcctggctggaagagggaggcctggcctttggtgtctggctgtatggacttccactcctttgaggttatctcagcatttgatagcagaaggctggtttaaaacattttcatgtgagagaaatgctcttgacccaatgttgcgtgaaaaaagcaggttgccaaatacaataccaacccaacacattcacacacatgcacacattataaag

SEQ ID NO: 91372 - DNA, 1027 bp, Homo sapiens
cacacacacgcgccaggcttctaagcatgcagggctgctctacagaagctacctagagccctgaaagatttgacagtagctttctctcatgaaagtggatgcattgtcattctttaaattaaacaaaatgatgtccataatgcaatattcaagagaatcaaagggtatgcagttaaaagagagtcttcttctaaccccagctcctcagttcttctccctaggggcaagcaccgataccagtttgtagtatagtcttctagatatttatgttggtgcaaaagtaattgcagttttgccattaaattaaaagtatattttaaatattttaaatgagaaatccacactttacactccatgttgtacctgtttttgtctaagaatatactttggatatctgcagtttactttgacatgcatccaaaagttaagatacatggaatgatgggtatatatgtgataaagcaaataaagcggaatgttaaagttttaaactaggtgatgggtgtacaggcaaaattctttaaactttgctgtgtatattacattgtacataataaaatggtggcaaatctatgtatctcagtcatcatcttatatcatgttaggtttcagctgctatatcctaccatattttgttgcacagagctgccttatactttttaagggccacgtttgactctagtgaatgagttaccctctgcatggacattctggttgcttctagtcttttctttgacaaacagtaccatagtgaacatccttctgcacacgcctttgtatagtaatgtccttccacttacatccttgtgggatgcagtcctacaggcggaattgctagctgaaaaggtatgttcaggttaacaaaatgataaatatccaaactgttctccaaaaagatcacacacatttcgcttcccacagctgcgtgggagtgcgcgcgtgatgtctctggccgtcagcgcttaggtaggacagcatcacagtcagcaaccccttctctcgctcagcaggcacccagaagcctcca

SEQ ID NO: 91373 - DNA, 1050 bp, Homo sapiens
gtgttttatttcaatatgtggtaagatacaaattgccttcatactatcatattattgcctttaagtatactgcctggctcagttacatatacactgtatatttatatgcgtgtatacgtgtattgtgtgtacatatatgtattcttacatatgtatgtatatgtatggtacatatgtgtatcacctagtggaaatcagtgttctcacagtcttattcttatcagagggatttttaaaactagccttatatgcatgttttcaagaataaagcagaatgctaacaaagtgcattttccttccctctcattagatatcagatccctttcatatgtagaaaagtaaggatttcaggtatttattctgacatgttgacataactccacatattcagttacctcaatttttaaaatctattttactatctctcacatgtagaatatgattcccagggtttaaaacacacaaggaaattgatcgctgttcaaaaatgtgcagcggtagcccagaggctcaaagtctagaacctcgagctacaggtctcagggaagaagggaattggtcgaacacatccagtaatgccgtggaatattcttttttcctttgaaggtttggcttacagtactgttctcatgatcatgtttaattctatgttttttctaagggctttttactcctctgctggttttttttttaatgaaacagaaagctgctgcctttcagtagcctggctgagtgctgtaaggaaggagagtctacattctggactgctcacttctctccaggatgccttctctggcgttcctcacatggagctggacttctcccctgtatttgcatgcttctctggcctgtgcacactggcacactggggcacacatagggtttccatcagagccgaaggctgcgtgagacttggggaggatatttatttgaagttgcacaaatgtttacagtaagggagactgagacatgggcactcgcagtgcagagctaccctgagcagaggaactgcctttccctcctgtcttccatgtgctccgttctccctaa

SEQ ID NO: 91374 - DNA, 1030 bp, Homo sapiens
cagcagcctcttcccctttgtgtctgagctctgtcccctctgcagggccccagcagacccccaccaggcctgatgtggacagctgttcccaagccctgccagttaatcgcttctgggtttgcacccttgagctgtgtgcaccaggacacccccacctactggaagtactcagggacgcagcctggttcactgacacagcccccagctgcctgaggagtcggtgaagctctggcctttccacctcttctgctgcaagaggccttgcagcctgcttccctggtggaaaaaggaaagcagaaactctaggccttcctgctggatctacactactgggagagccccgatagtgcaaatttaattggcagggattctattaaatatgtgactttatttggggttgctaatgaaatcaaaggcttgttgtatgacttacagtgtggacattaatttttaagaatgatgggatagaaagttagaacggaagagtttttctacctaaagaaatgagaatctagaatttgtgaaagggctgaatgttcctatcttgctgcttctgggacaaacttttccctgacatgtaaaacgcctgcaactgccatgaacaggaaagaaatggaaatggtactgattcactcatcaactccaggcaactttgtgtgtgtgtgtgtgtgtgtgtgtgtgtgtgtttattttgaaataactttattcgcagcctaacactttgcactgcattcagcatgacttagaatttacttttggtgttgtccagctgctgccaaaaattgggtagaatcagattggtattctttgttggtgcctggaattgtagccagtggtacaaaggtgatgttgttccttgctgagacttcgtggaagaaggcaaaactttgatcatctgcccttgcacttgggcagtgttgaaggtgattggagtacaagtgccaatttgcaggaacaattgtaaacacctttgatacaaatgccatcatcccatttttactgattagaaaaactttgctattaataggtg

SEQ ID NO: 91375 - DNA, 1078 bp, Homo sapiens
aagaggctagaatgtggtggggtaggaaacttgccatttaattttaccttcctggagatcctagagtcaaactagtgtgtggatctgctggacacccgtaatgagctgcaccttgtcccaagtgttacagaggtctggaggcctcgggactcagggtcagcttggcagtttccacgtgccttcccccatctatattgtatttttcagtaagggattgcacacagaaatcaaataacagaaggtgcctgtgtgagaaggggatgctgcagtctctttggaggaagaaaaaggtgtgttacagtggttgagagatggaaggtgaacgcagtggttccctggcctgtgtccagagcctgtgaaggcaggtcttgctgccagctttagctggctgggtgcagactggctggggaaagcggggcctgcctcctgggtcttggccctgcagcctcctgcctgccaggtaagcaggggctggaggagagggtcctggggtctgggccctgggcctgggctgcaaacctgcagcccccagtcctcccggtagtgactcctagactggttttgatggtgatgatgataaaaggtctgagaactccataggccccagtaatcagggcccgcactgacatccttctcaagtttgacagcttcttccttttctctcctcaccgccaaggctttctcaactgaatttccccgccctccctctcccctcctccctgcccgccgcccaccccttccctccctttccccttttctgtgtgcgtctctcttgtttcatgttcttgatcagtttcagatgctgggaattattttttttcaggcgggagggggagtgttgctttaggtttgtgggttgggcaggtgtgagaggaagtctgtggttttttttttttttttttttttttttgtactgtaggcctgttgctaattaatgttcctccataagattctgtcggagttgagtaatgtttttgatctttatgcctgataactgcatacttaatgagatttcaaagctgtgagtgcagctccctacaattattgacagatgccttttctttgccattgggttcag

SEQ ID NO: 91376 - DNA, 1068 bp, Homo sapiens
gccccccggacgccccgccgcgctctgccctcttccctctcgcacccatttggggagccgctcgcggagcgcgctgagccgcgccaggtccctacctcctcagctctccggctgcagagggaatgggaagcaaccccggcctggctctttctgtgggtggcgggcggggtcacctgagttccccgggacatcttccgcgtcctccgagcggccgaccgccgggggactgcctggtgtccgccgagccagggagcgcgaacgagtgagcgagccggtcccctcggccaccttagtactaacacgattgattcctcatttcttgggcccaaactgggcacagcggtggaacccggagcgcacagggtctgggtattgtcagatgactgtcaagtccatgttagatgctggcgtttccttctcccctgtttgtgtttcctcgcccccaccccctccttgtactgctgctcccaccctcatctccgcatagcacttagttctgggacgtgtctgagtacttttttgttcctcctttttttttttttttcttcttctttaaccgggagtgtcaactcctgttaagactgagccgatttttttcttttcttttctggaaaacgcatcattgaaaacaaaacaaaaaccacacacataacattattttgcaataatgtcggttgggggcatgttgcctggaagaagggtttctggcccgttgccatccttgatttgatgactgattgatcgcccgtcatgctgctgcctttgatctattcattcccaataaacatcaataaatcacttgcaatagtgaggccaagctctgtgacgtcaggagggccctgtcagtgcaactttgggatttggggcggattgccgagaggaccacatatggacgtgatgtattttgatatgagtaacactcagatgtgcagaggttcagatgctccctgaaggggagggttaagtggggcttcctttcttttcttttctcttcctttcttttacttctcttttgatgttaagagggaagggcagagagtagggtcagggcattggctggtgcccatc

SEQ ID NO: 91377 - DNA, 1094 bp, Homo sapiens
ctagatccattataaccatgaacagctcttcctaatataaagatgatcagcaccccacaaaaacacacacatacatgccctgacgtgcatccaatgacatgagtctccatatcaaagcccacttgcagtgtgttcctggcagtcgctgcggtttgtggttttaatatctcgcttcttctacgctcctggcacctgctagagtgggcctggcttcccctctttaggcacagctcacaccgggagggtaagcccccagcctgctctctgcctaggctgggcacggcacagtccacagcctgggagggagccgttcatcagggtgacataacggttcagttccagaagaaagttcctgcctagggctgagcttcaggcagggtaggttcccaggagcaagtgctgtgagcctgaggccccaggcgtctgaagacaccacaggtctccccctcgtctcctccatcccagcaagcacctgcggtccaatcgcgctaagccaggggccctgctttcagccgggttggaaagggatagaagctcccccatctcctgcccttttctaaagacaggcagctccagcaaaaccctcagccctcaggcgtccctttcgtggggtccccgcccctgttctggaaatgagaccccaggtcccaggatgcagctggcatcgcaggggaagggacttgcccccaccctccacccgctaccatgacccgggagaggccttcccgagggtctgaaggtccgcagagccctgccccaccctagtccaacaaggggaccgcgttttagggacatccctggattgtcaagaaacgctggctcatccggacccccggggagcgcagcatgaacccaggagcaccctgacaccccgaaaacagggaacctggggcccttctcaaactcaaggggaaggaaagggagcctgccaagttctgcttctgcgaggcagctgccaccaaaacccgctccgagggccccgccgggccgccctggcagctggaaaagcgcattcctgctcgcccgaggatgcagaaggcaaccgagtccccgggcggcggcggggcaactgcggaaatcacgcagccagatga

SEQ ID NO: 91378 - DNA, 1409 bp, Homo sapiens
cgttagattgtatttttagtttagattaaaatagcaatgtgcaatttattgttccattctcattagaaaatgttgtcagtaaaaccaatagtgttgagtccagtacctaaattctgaggtaaaacaaaatacacaattattgggagaagtttccagagctattttttcctaacttctgcaaaatcctcaagtcggcttgttagataaattatttaaatttgcattacgtaatagggttgcatgaacattcctctgaatttctttttacatggaatattgagaaatttttcactgccaaaaaaaaaatcattactttgtttcaccaagaaagagaaatgttttgatactatatactttcgttcttggccacagctggattttgaagattgatccaagggactgtattaatttcaggaattgatttgaaagacactggctctgccacttaacagccatgtaaccttgggtaagtcacttaaaccacactgagtgtttccttatttataagactgtataacacccacctagcctgtcctaaagagttatgaggatcagataccactaacatgtttgatagagcctagctgtaaggagctgttactcttttcagtattgatattttgtacatttttattctcattgagaattaagatgaaaattggtgtattagagaaagcatggttttagagtgagattggcctggattcctgttcttaaaccagttaccactttgtgtctgtgagtctcaggtttctcatctgcaaaaaaaaaaaaaatacacaaaatttgaatattacacaaaatctacagaggcattactccctagacttgcacctcatgggcaaggatttcctcagtcatttttgtagtccccagcattctggttggcacattataggtgctcaataaatgacagtaaatctgaatattggttaatgttagttagaccttatgtcttcattgcagctgccaaattagaatattctctcaggctatgtgccaactaagaaactctagactatgaaactccatatacttgtgatatttatactcatttttttcttagtggtaattaataattaccttgggctcagaagattttaaatcaaataaattgtagccaatatagtgaggtaaatctataaataatgtgtaagcagtttccaggtaactttatagacagtttataattcagggacctgaaagttcatctagcttcaccctcttgttttacatctgagcaatctaaaactcacagagacagtgacttgcctaaggtcacacagctaattgagggcactttaggggagggacccttgagcttatgtcccctgccttcttttggctggagcaaaataaatttgtcatattttagaattacaataatctggaagaatggggaatttatt

SEQ ID NO: 91379 - DNA, 1279 bp, Homo sapiens
agaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagag

SEQ ID NO: 91380 - DNA, 1798 bp, Homo sapiens
gggttacatgcatggatttttaaattgcctgccatgcctcttttcctccacctggctccatttgcttttttctctcagtactgtagcagttcaaatggctgcatacttatacctggatgggtactttattaactcaatattagatattttgaaatctggttgtcaggccaaagaaaaaatttttagctcacaaataaggtaataataattcatgctttgttaaaacttctttacctatttagtaaacttgttaaacaagaagagagatttgtgcctctgtgatcctcagtctctgccattcagatagcacagataccttagggcatgtttcagcttaacatttgcttggccaaaaggcatggcctgcctgtcttgagctagatactgtgttaggtgctgggagtacagtgaaaggcatcactgcccttcaggaatccaactcagtgaagaagacagaacgaggctgatgggtatgtcagcagataccgcaggagctcaaatagagccgcaagcaaagccctttcgtatggtgttactccatgaaacctaattaaattgttttttattggaaacctataatttgccaagcgctggggattcagtctaaacaaaacaagcagatccttatcctcagggaatagacagcttagtggcagggcagagattttacccagacatgcaggtaaagtacagactttgctaaaggaaaaatataggacttactaaactatgctgtgaggttctagcatttccaatttgtagatgagaaaactgagacttcaagaggcaaaataatttacccatgatcatactggtagaaagtggcagagcgaggactaagcccaagtttttgaactttaaatccaatattctttccattggaaacagttgcttgaagtagcacaggctctcattctgtgctatattaagtttttccatctgtcagttttattagttgtcattgatctgtaatatttctcacacaaaaccattatccaatatttcacacttcattttttagggtttttttaaaactgtatttggaacagtgccatttataatcaagtccaagtttttaacctaccaattaagagcaatacttagattataattatgattagtgtgtatattaacgttatagatttataccaggaaattaggacattttgttctgcttggcagtagttattagcaaaagaaaatttcaattttagaaaccgtaaatttaacttaaggattttctttgttgaaatttcagtgtgggttttcctttgtataataccacggattttacttttatgcggtgtatacaggtgttctacctaagctttcttcctgccaagagacacacagttcttcctgctctgcctttttcatgagcttccatgcttgctttgtttctgaatataaagcagagtgtgaatagcctgtggactgtatgctgacagacaagtacatgaagcgttgaatatcttcaagaaatcgttttatatgatcaagtcactcaactcgtgttgacataagcttaccccaacttgaattactcagccctgttgttgcagagtgagtttagtaacatggctacttttcgttggatccatgtctcctgcgtttcggagagctgcatattcatgtcagtcataacctttgtccctgtaacctgtcagttaactagaaagaattatacattgcatagcacttaaaaatttgcggccgcttttcctttcttgttgcgttggtagctgacgtttagtggtaaacaaagaaaatgcactgggtgaaaaggccttaggctttt

SEQ ID NO: 91381 - DNA, 1313 bp, Homo sapiens
ttactgatttgcaggagctcttcatgtattctgagtacaaggcctttgtggggcgtattgcagatgtcatctaactgtggcttgcctttctactttcttaatgatgtcttttgatgaacagacatttccagtttaatatagtcaaatgtattaatctttttctttgtgtttaggacttttgtgttcttatattctgaaactagttttgattttttgaaatagtctgttgagtaaggtagacgatgatacagaaataaaaatgtgtgctgattttcagggatggcacatcaactatgcgtgcttaggtattactgagcctcatttactaatatggcactaaagctaaaaaaatctaaacagaaaacattccagaaaggctttcagcagggggaatgacagtttggaatggaaatgataaggttgtctctcagtgtagtcagttattgtatgggatttgtataaatagaagtatattagaaatgatgataatagctgatatttttgagaagattgtttgtgggccagacccggtgtgctaagcattcaatacgtgtcagttcagtcctcacagcagcccagtacttaggaatattactaccccaattttgtagacatggaaacagaggctgggctagcttaaataactttccccatgtctcagagccggggcctgaactcttgctcctaataactgtgtcatcctgcctgtctgtgctacaccagggagatctctttatgaagtgtactgctgctgcatgccagcagcccacaccaaatcagggtgtgaaacagaagcaatttcattatgctcagggattctgtgggtcggtcaggaatttggaaaggacgcagtagagatggcttgtcccatacagtctggggtctcatcagggaaggcttgaaggctggaagtgacccagacagctagggtgacagtcctctgaatgctgcctcagcataggctggtggctgtgctggctgttggttgggcatcagctggaacacatacatgatttctccttgtggactttgcaggtctgctagtccccaaaatgagcttcttagataagaagtaggcaaaagctctgttgccttttatgacctaaccttggcagtcacagcccatcacttccaccagagttacaggcttcagtcttttttcatctgtaggcatcgtgattctttagtcaatgtgttggcttagggaaaaacttaagtctttagaaagcttcaatttgtttaaggaaaatagtgaaggagatagttttatcaggaggaaaaaatatatattttgttttgaagagatgaactga

SEQ ID NO: 91382 - DNA, 1030 bp, Homo sapiens
catgcaagtgaccaaaattacaactacgaacaagtaaacaaggctattaacgacgcgatttcacaaagtggcaggtatttcatcctaccccctccctttattgctatatgtaaattaaagccaggattaaatctactagtcctacattgtagcctcctcacggtgtgctgtgtttgttttgtttttaagagttctggggaaatcccctggaaagactcaattaaagagcagtgaagagagtgcagatcccgtcactggaagttcagaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggacaagcagtaatgatatttaaatattttgagtgagggggagtgggtcaaagaggaagtagaggtgtaatcctgtattaaccctctgtcaccccttcttagtgtcgagtgtatttattaataaaagcttattagagtgtagaaatgccagcaagagttaagaaagggcttttcaggaactattctaaaagtcataaaagggtcacagtcttaagcagagcttagttttcttctcacttgtcaaatgcagactgtgaggcctccagtgagaaatgggaggcagttctgggagggggttttttcag

SEQ ID NO: 91383 - DNA, 1051 bp, Homo sapiens
tcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaa

SEQ ID NO: 91384 - DNA, 1023 bp, Homo sapiens
cgaggttttgccatgttggtcaggctgttctcaaactcctgacctcaggtgttccgcccatctctgcctcccaaagtgctgggattacaagcatgagccaccgcggcctgccatgtgtttaataaattgtatagtagacatctgtatagtcttcatttttagtttttgagtgtgtattgttttttaattattgaaactatgttgtaacaatgatgaaaaattttaaatgaaaaacattacttaatattcattacccttaacaaaaagcagttttcatttttcccttccattcttcatcctaagtgcctaaatattttacttatttatgaccccattatagttagtttttataatctaccttatctgctgttacatactatgctttttccatatatacattttcacaaaacttttataattatgtaagtagttatggttttataatttcatatttttgaagtttttattctcttgattattccactatttccatgctcccaactttggatagttagattgtttataatagtacagttaaatcctaacagtgcttacttattctcactttaaagtggcaatgtagtggtatcagttccttctttcttggaattccctcagagcaattaaggaatgtgaaaaatagataatcaagttccagctttgatgaagggggctgccaaatccagtggcactcagaaagatgctgagagaagagtctgcggccaggcaaggtggctcacgcctgtaatcccagcactttgggaggccgaggtgggcacatcacttgagtccaggagttcaagaccagcctggccaacatggcaaaaccctgtctctactaaaaatacaaaaattagccaggtgtggtggtctactcctgtaatcccagctgaagcaggagaatcgcttgaacctgggaggaggaggttgcagtgagtcgagattgcaccactgcactccagcctgggtgacaaagcgagacttcatctcaaaaaaaaaaaaaaaaaaagagagaggagtctg

SEQ ID NO: 91385 - DNA, 1050 bp, Homo sapiens
tcatccatgtcatgggttattgtgaggataaaacaaggccgtattctaaagcatttttgcagcagtaaaatggctctgtcttctacaggatacattctacttttaggggtaaattgcatggtattagttaattacatattcctaacggattgtgaactttctcatggttggcattcttgtcatgtcaaaataatgttttgccaggtattatcatcacatacaatagcatttctattggagcaaaataaaaagctcattttttaaagttggcgatacctcacatcctaattagtttcagctgaagataatttcagaaacttcccaggcgctagttcccttgtattaggagggttgctgcagaggtgaaatagttgtatattccagtagctatgtttatttagttcacacattatatgcagtttatctttttttcatttaatcttagtgatagttgtgggtgtaggggtggattttgtttttgttttgttttgtttttaatttcagttctggccaggaatgatggatgaactctccgagttgagagaattctatgatccagatacagtggagctgatgaactggattaagtaagaggattttttttaacttttaaaattttaagtgccttttaagagtcactatagaccacatttcgttttgggggttttttgtttgtttctgaatctaattacgaagaaacattcgtccttactagatttttctttaaaactccatatttgaaaataatgtctttctatttaagaaatattctctccagctatatctcatgaagaaaggaaaatacccatttggagaggaaaaccgattcaataaataaatttcaaaccactgacagaaatggcaataaaagtttataatatctgttgaaacttaaaatttgatgtctctgccaattttatgtttattattttcattttaataccattctgattttccactaatggtgacacttgaaagtattctttctggccgggctcaatggctcacgcctgtaatcccagcactttgggaggctgaggtgggctgatc

SEQ ID NO: 91386 - DNA, 1032 bp, Homo sapiens
agaatccccagaagagagctcttagggcctcctgagaaattaactccttgaccgcttacaagtgactctcaggtttccaaaaaaaaaaaaaaaaaaaagaggaaaggaattaaatcagctactaagattccttttttccagggaggaaaaaggaaaaatgcttttcctatattctgggagtcttttcttggtccctagtccctgcccctcacacccctggaagacagaaaatcgtagcgtggtgggaactggaaagtgagtttgtgccttagtattagggtgccccgtgttccttaaactgcatatagtttctcataatcaggaccaaaggtatatgtaaaataattgcgttttcacatcagaagtatttgtgtatcccccatattaagtaataagatattggctatttcagaatcttgtttccatgttttgttgttgttgttgttgttaattctgtttttatttatggtggtatctgtgatttttttccttattgcttttttaagcaaaaacccttggaactgactcatgatcacctgcagtttctggcttgatgatttgttacatgttgctctaggtagctcttttgttaagttcaatacgcaaagcagtggcagtcttttaggttatttttgttagactctgcccctctggaacaatagcaggagaggattgtgggtcttggcctagaagcctggactcaagagctacactgcctgccttctaagacaattccttataaaagtaaacctagcaaaacagtaagaagtttccccaccgttattctggtgaacagtcaaaatcatacaaaacattgttgtaaaaaacatggggctggtgcaaaagtaactgaggtttttgccattgaaagtaatggcaaaaaccgcaattacttttgcactcaatagtttgagtacaaatcaaaaccgaagcaaactcccgttttttttccctgactcgtaacacttggtaacatagctggattcttctgaaaaagtttgatattgtcttctttgttgtctttaaggatct

SEQ ID NO: 91387 - DNA, 1427 bp, Homo sapiens
ggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttgactgtgtcatggtatttttttttagttgtttggctgcagatgatatgtttctcagcctgtctgctgtaaacatgtgctttgtgtgtgagaaaaagggtccccattgaatggatatacatttttcagttatagatgtgagattgaaacatgggaacttgatcacttagctcattattcatctactgaccaaggcctacttaacccagtaggcacagtgtcccgggcccacaaaaatgtttttctt

SEQ ID NO: 91388 - DNA, 1029 bp, Homo sapiens
aagtgagtatgaaactcaagttgatttctgtgcttttgcccctagtttactccaagctgcacgtaagctgcttcaattgtaattggttatggacaaatctgcacctactaatgtcaaaaatgctgccaccttgtggccaaccagagtgtttcatgccactgtcccaaatatttattttcgtttattttgggttttaggggaaagacttcaagggagattatggcaagagatagaagtgtccctaatttaaccgaaggttctttgcatgaggtaagttattaaacactggcttttaatcatattttctaaagcccggctttgtcaaaagtaatccatggtaaacacgtctccttgatcgtcatcttcattattccgtgcgccgtatgagttagcagcagttaaaactggaattatttcatgggacagtgtagagtacagacttcactgattgttataactaaaagtacatttctgagcagaggagtggaaagtgttacatgtgtgggaaaccacaggtcttggtgcttataggagatgaaacatcccacatttcactatggttttaatcaccaaagaaagaaaacgacagtttgtatatagatgggtaaatgatgtctccaagtatggtgtacagttgctcagacaattctttatgtggccatcttcccactacatttttttatttatttatttgagacagagtcttgctctgtggcccaggctggagtgcagtggcacgatctcggctcactgcagtctccacctcccgggttcaagcattctcccgcctcagcctcctgagtagctgggattacaggcatgtgccactattcctggctaatttttttgtatttttagtagagacgcagtttcaccacgttggccaggctggtcttgaactcctgacctcaagtgatctgcccgctttggcctcccagtgtgctgggattacaagtgtgagccaccgtgcccggaccctactgcatttttaaatcactcagaagcttgattgaaaacctgtgatcggag

SEQ ID NO: 91389 - DNA, 1035 bp, Homo sapiens
tttgccatgttggccaggctggtctcgactgcctgggctcaagcaatccacccgcctcggcctctcaaaagtgctgagattacaggcgtgagccatcgcgcctggccttttattatttttaaatagagacagggccttgctatgttgcccaggctagtcttgaacacctgggctcaagcaatcctcccacctcagtctcccaaagtggtgggattgcacgcgtgagccaccgtgcccagttaattaatgtgtttcaatgagtacttactatatgggggccctcaacagcctcatgataagcatatgatagtagatcttattatggttgagctggttgcatggagtggttgaatccccagcgtggagtccacagagagggcagagcttttacccagtggtaaaagcagagccgggctccccatgcaggcctgcttttaccactgggctttatggcctccaagctccatttgtaattatttctgagctttttctgcccagtcacactaatactgacatttagatcaaaaacaaataataacctattaaaaaagaataaaaacattactgttccttttccctttcaaattgcagaattcaaaaataatggaattgcttcaggtggtaccaagctgtgttgcttcattagatgatgtggctgaaactgaccgcaaggagtatgtcactgttaagatcaggaaaaaatgtaagagtttacgttctttctgtcacgctcaagttgggtatatttagacattcatgagtagttgctggtgttcatttaattgtatatgtaaagtgtaattataatcatgcctggaggagatacaggcaccaaagaaatgtatgttacctcccaatttatcagactatgggtaagctttttttgttactagttttctggttgatggtaatgatgtttcctgaggaaataggatagaaactgtcaacactaccttgaaggttcaggtgtctgcctatggagatggggaacagtctctgggatagtttctttcatgcctcatgttccaaagtcag

SEQ ID NO: 91390 - DNA, 1069 bp, Homo sapiens
gtttcatctctcctcacctactttccctaccaccaagatgattacaaaggaaatgccagagtgcaaatcatttcatccataaacacatagatgagcatttctaaaaggactctcggccaggtttggtggctcacgcctgtaatcccaacacttcgggaggccgagatgggtggatcacttgtggtcaggagtttgagaccagcctggccaacatggcaaaaccccgtgtctactaaaaatataaaaattagccaggtgtggtggcagatgcctctaatcccagctacttgggaggctgaggcaggagaatggcttgaacccgggaggcagaggttgcagtgagctgagatcacaccattgcactccagcctgggcgacaggacgagactccatctcaaaaaaaccaaaaaggactctcaaaaaatttactcctaataattgagtaattccagcatgtggatagcatcttggatgtcacttttcagcacattgcatcaggtaaccagaaagaagtggagagacttctgagccaagaggaccatgataaagataccgtccaaaagatgtgtcaccctctctgcttctgcgatgactgtgagaaactcgtctctgggtaagagggtgctggtggaggctcagagtgccaggaagcaggagacaggcctcctggaccttctccactgtgcgctgtgtgactgcagataaggactgtcctccctgccccccagctgcctctgctgtacagtggagatgataacagctgcccctttggagaatcagataggttagaggttgtcaaagcacttgctcactggcgggctggctgccagggtaggctggttatagggcctgccccagcctcagaaagggggttttaggatgggaggaatgtcagtttttcccagtaacatttttggtttcccattatccttgtcaggctattttgctgggtgtggaggcctaaagggttggtgggggagagactccagggccaggtgcctctgttcctcatgctgggtgagcactgggacagtgccggagacacacatctcttgggtggcatcctgtg

SEQ ID NO: 91391 - DNA, 1052 bp, Homo sapiens
taatttttgtatttttagtagagaggggtttcaccatgttggccaggctggtctcaaactcctgacctcaagtgatccacgcgcctcggcccctcaaagtgctggggttacaggcatgagccaccgcgcctggcctatttatttatttttgagatggagtctcgctctctcacccaggctagagtgcagtggtgtgatctcagctcactgtaacctctgcctcccaggtttaagtgattcttctgcctcagcctcccaagtaactgggactacaggcatgtaccaccatgccctgctaattttttgtgtttttaatagagattggtttcaccatgttggccaggctcgtattgaactcctgacctcaggtgatccgttcacctcagcctcccaaagtgctgggattataggtgtgagccactgcgcctggccatgtggccatattatttaataggcacgtccaaaaagcaagacccctctctctcctgctggttgacagtgggaaattgagaccagcttgtgaaatggctttcctgcccaaaggcctcagataagacagcagggaattgggctctgcaggcatttggtcagaggcttgaggaggaagggaggccacggcaatgtgagtttccatctggaggacaatggtgtgtgtgcgccgcattccacgctggagatggcacattccacatatacacgcagtcagggtgccgccaccatccccatcccccacagggagcaaccgtcaaagcctccacttccaggaagccttctccccacctgacgtcagcccgtcctccgtctcagtgagcaggtcccatatgagacgggagagaggcgcagccgatactgctctgaagagacagccggggttgttgctgaggtgctgggttttgaaggatctgcactgacatctcgtggtgtgtttggttttttccctgcaggagtctgagggatttggagacaggctgttccttaagcagagaatgagcttactctctcagatgacttcgtctcccaccgactgcctgtttaaggtgagataccaagac

SEQ ID NO: 91392 - DNA, 1049 bp, Homo sapiens
tatcctctgtgttaaccccaaggggaagtttctcctgcttttaatgcatatacacctaaaaaaaaagttgagaaaaatcacgtaattgacttcataaagcttgtgttagcacttgaagctctgtgcgccttacccgctccggctcccccgtcatggccttgctggtaagggtggcctgtccctctgctctatgtggtttaggactcagcgaatgctctctacaccaaatgcctccagcagcttctgagggactctcacctggtaagcagcaggacttctgagagggagaattgtggtgcacccccatgcaaatccaagccctttcactgtgcttttcttgccctctagaaaatgctcgccaagcaggaggcccagatgaacctgatgaagcaggcagtggaggtgagggtggggcggagtggctgggaggcacaccctgttgcccgctcacaccctgaatggggtctgttgattccacagatatacgtccatcatgaaatttacaacctgatctttaaatacgtggggaccatggaggcaagtgaggtaggttctcagttattatcacccaagatggaagccttcttctgtgctttttgagaaatttgaaggttcgttaaaatctgttgttaggatgcggcctttaacaaaatcacaagaagccttcaagatcttcagcagaaagatattggtgtgaaaccggagttcaggtaagggtttgcgccacagcggcttggtgtcctcagaggcaggggtgctgtcttctcccggaagcaggccctctcggtggcagaggtgacacgctggtttgatgtggttagttctgaggagcagcgcagttacttgcaaccaaagataaagggctgccctttataggtgactgtgtgtggccgtccccctcccacactgcaccagcacgccagctggatgggagccgctgggcacggggttttgtgcagctggtccccaagtgggcatgtaatttgcccatgtgggttctgcgtgcaggggacatcccacctgcccacccaagggaaccttgccataga

SEQ ID NO: 91393 - DNA, 1013 bp, Homo sapiens
ctttgtctctgggtgtcagcttcagggctgtctcttatagcgcccagccccagcattgtgcctctttgagatttcgttatttttaataaataataagtcttcatttgccccagaaaattgagataataatgtgctggatgcacactgatgctcttattgtcaggaattggggtcttgcccatggtcccagatagtttggttttgtcccaggaagaggccttgagaggaccaggctctctggactccagggtgtcctgtaactgggctgttcttgtgtagtgtcttgaaataaggacatttgccctcctccccagagggcctaggccctgtaggataggacagagtcaggaaccagcagaggcttcagccggcctgacctgtttgtttctttttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagtcagtagccgtgctgtcctctgcctggcgtgccctgtctcggttcagtgcagggtgctgggagccctcagtttcctctggaactgcctggtgctgcctcactgtttgaagtcttttaaaaatgtttctctctaactataaaagtagtttaaccgggcatggtggtacaagcctgtcttcccagcactttgggaggccgagatgggaggatctcttgaggctgggagttcaagaccagcctgggtaacataaaaagaccccatcattacagaaaatacaaaaattagccaggcatggtggcatgcacgtgtattcccagctacttgggaggccgaggtgggaggatggctttagcccaggagtttgagactgcagcgtgctatagtcataccactgcactctactctgggcaacaaagtgagaccctgtctcttaaaaagaaaaaacaaaccaagtggtaaa

SEQ ID NO: 91394 - DNA, 1073 bp, Homo sapiens
acatggcgaaacctgtctctactaacaatacaaaaattaaccaggcgtggtggcagacacctgtgatcccagttactcgggaggctgaggcatgagaattgcttgagcccaagaggtggaggttgcaatgagccgagatcgcgccactgcactctagcctgggcaacagagtgagactccatctcaaaaaacagataaaaaaacacaataaagaaattgaggtaagctcatagaattagattagttaacaactatctcagttccaaacatattaaatagatcaaaataaatactgatttaacaactatctcagttccaaacatatgaaatagataaaaatactgatttgtatttcattagtatattggagtgatttataaaataatactcgatggaattaaaattttatactttctgccatggtgaaaaataattttgtatttaaaaataaaatcagattttttcctttttcaggtgatgagctatatttagaagattcagactttttggaaaatcttatgtctactgaaaaaaagactgaggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggatt

SEQ ID NO: 91395 - DNA, 1773 bp, Homo sapiens
ggaaaattgctcgagccccggagtttgagactagcctgggcaaaatagcgagacaccatctctattttttttttaattaaaaaaattttttttaacaaacaaaagtactaaaaacattgctctgaaccttgtgtttgtatattactatggatttttcagaatatgggagattgaggacatccgttcgttatttgagtcacaacacataattgagaattacatactgttggttatgtgttttagaattttatcttcggtctaaccatttaagcaaaggcatttgtcaagaatttgttaggtcacttaaattagaaacagtaatcgtggctctaaagtttattttgtggtactacttttaaatcatacgctgttctgtttgtcttttaaaaaatttacagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtatgtatctaaatgttctttaatcactgtgtattgaaacaccactcaaaatataaactattttggcaacgatgatgattcaagcttttagagtattttagtttcttacactcagtgccttgtgttaggtttttttttgagatggagtctcgctctgtcacataggctggagtacagtggcaccatctgggctcaccgcaacctccgtgtctcgggttcaagcacttcttctgtctcagcctcctgagtagctggaattacaggcatgggccaccacactcagctaatttttgtatttttagtagagacgggggtttcaccgtgttggccaggctggtctcgaactccagacctcaggtgatccacccgcctcagattcccaaagtgctgggattacaggtgtgagccactgtgcccagccagtgtaaggttctttaggttgcacaagattcaggctagtcatggaagggggtggccgccatgtaaggtccatgtggggcaaaagtagacagaatgtcatctacacccaggcattagggccatccctctggggctgggaaccagggggttatttgagatcccacagaggtgtagggatctcagcaaagagggaatagggtcttcagtgtagggccaacgcctcccttttggttgcatgactttggccaactcagatgtctttgttctccttactccacgccgtggcccctccttgccttcttgcagactcagctctcactgccccttgtcatggttgccacagctcagctacttttcagaagagagtgaatttttgtaatggtataataggaaaaggtttataaactctttatgagaaaaagcagaaataatttgaatccacttcccccaaatcatcattaataacataatttattttagtatatgtgctgccgaagcaagcacaataacataatttgtttccacgccattgactaattgaagaagttaaaccaggtcaattgtttttaaaaatattccacattttgggttgggcatgctggctcttgcctgtaatcccagcactttgggaggccaaggaaagaagattgcttgagcctaggagttttgtgaacagcctgggcaacatagtaagaccctgtctctacaaaagataaaaagattagtgggcatggtagcacgtgcctgtggccccagctactctggaggctaaggcagaagatcacttgagcctggg

SEQ ID NO: 91396 - DNA, 1050 bp, Homo sapiens
tgtgtttaactgtttggggagcttttgtttttgcgtttgatgttttacatttagtttgttttgggtgagaaaatcgtatgattaaatagagcttcaggagacttcagggggccatgggtgcagccacctttccctaacctgtctgagacagaagatggccaggctgcccagacaaggcataataggaaccctggaaagaaagccagttcatgtggaaatagtacgtggaagtggtttttcggccaggggtggtggctcacgcctgtaatcccagcactttggaaggccaaggcaggaggatcgcttgaggccaggagttcaagaccagcctgggtagcatagtgagacctggaccctacaaagaaaaaaatgtaaaaataaagtgctctgtcgtttgccaaagaagaatggaaattaaattgccaaacttattatttaaaaatctcagtcctgcagctcttttgtgcaaagttggcaaatactaattattaaaccatctgttcatttacagaaacttttaaggtaattttggtcatatattgagattgatatttagaaaatcttgaatagaatttgctttacaggtatgttcattagtatccagtatttgtccacctaaggagccttattagacttttttttttttttgagacagagttttgctcttgttgcccaagctggagtgcagtggcacaatttcagctcactgcaacctctgcctcccaggttcaagcaattctcctgcctcagcctcctgagtagctgggattataggagtgcaccaccacgcccacctaattttttgtagttttagtataagagacagggtttcaccatgttggccaggctgatcttgaattcctgacctcaggtgatctgcctaactcggccttccaaagtgctgggattacaggtgtgaaccaccacacctggccaggaggcttcttagacattgttttcctaaactcctacccctaggtcatgaaatgtcaatttcactgatacactatctatgtgccatatccgtgctttatgtatcaaaagagtacg

SEQ ID NO: 91397 - DNA, 1037 bp, Homo sapiens
tttccaaaccatttgcacagtacagtcccgtaagtatatggatgaatctgaccgggcctggtggctcatgcctgtaagcccagcactttgggaggctgaggcaggcggatcacttgaggtcaggagttcgagaccagcctggccaacatggtgaaacccatctctactaaaaacacaaaaattagccaggcgcagtggtacgcgcctgtaatcccagctactcgggagactgaggcaagagaatcgcttgaacccaggaggtggaggttgcagtgagccaagattgcgccactgcactccaacctgggtgacagagtgagactccgtctcaaaaaaaaaaaaaaaaaaaaaaaaacaaaagaatatagataaatctgtataaaatacacagacgtagaggcatatatatatacgtgtgccccgcaccccatctttgctccctttttctagtgtttgactgcatcgctagtgtttgtacaggacagatccctgccctgggcagttccctctcgggtgcgggcgccatgtctgctgtcttgaatgagcactaccgagtggcctgacttctgcctcctgtggtctgtagagacatcagccccatcctcccacccggtgctcctcctcttctcccttcccgggacgatggcattatggaaggaaaagccacagggagcagtccagttctgactccactggcatgccatgttgcactgtgtactctgaactcagaagctgccttcatgggctgtttggtgaccttcccattctccactcaccccagcccccacagtttccttgtggtggtgagtgcatcactcttgcggctggcgtggcatctacactgatgtgaggataagtccctgctgaggccaatgcgccctaccaggccgccctccagccagccccccccactactcaccgaaggctctgggagtgggatttgctgcacacagcagcccctgccccctgtactgccctctttcagagcggcccactgcccacccttcaggcatgattggggcccctgtgtgtgcaac

SEQ ID NO: 91398 - DNA, 1021 bp, Homo sapiens
atccacgtttgttgttgttgccaagtcctcttccattgtgtggatatactacagtgtatttacccattaactcgttgatggatatttgggttgtggccataggccccttacagatatttatgtacaagtcttcctgtggatctgtgctttcatttctctcgagcattacctaggagtcaaacttttggatcatattgtaggtattaagaagctgccatattgttttccaaagtggtggactattttaccttcccatcagcaatgagagttctagttcctccatgtcacttgtgtaaacattcggctaagtgtgcagtagcacctcattgtggtttaaatttgcgtttccctaatgatggttttatatgcttatttgcaatcttcagactttgatgaagcagacattcagattgtttgcccatattttaattgtgttgatttcgttttattgagttttgagagttccttatatattctggatacatgtcatccggatacttgattttaaaagaattttgcctcatctgtttattctcttgaagaacagaaatttaaaattttgagcaaatccaatgtaacagtctttcctttgatggttcgtgttttgtctctgtcctcccaccaggcttttgcctggccaggtagttttagtgctacagtgcgtatgtccaagaagacatctcatgtgtttcacacagatgcttgctgtttttcctcatcaggattggtgggaagtatttggtttaccagagcaggagtcaaatctgtttctctcagattatgttctgtaaaataatttctctgaaggtagaactttggggttaagtttggaatatttcctttaaaatcgcttgactatatttgtcttattagtcatgaaatgtttaaaattttacaggtttgtgttaatgatgatcttgttgcaaagaactatgcttgttatatgtcacctacaaagaataaaaaccttgattatttagaaaaaccaagattgaatataaaatcagcaccctccttcaat

SEQ ID NO: 91399 - DNA, 2364 bp, Homo sapiens
tctgtgtttccctcataaatgattgccgggtaaaacaacagccattttataatgctcatgggttctgtggtcaggaattcggaatgggcatggcaggagggtttgcctttattccacactgtccagggcctcagacagggagacgtgagggctggcattaactaagtgggggcagtgatctgaggactcaggcacgttctggcagttgatgctggcttttggctgggacctcagctgggactcttgtccgaaatgtcctggtatcctttccatgtggctgcttccccacagcgtcatggctgggcttcaaatgtgagcgtccaagaccacagatcctgagtatgtggccttttcgtaatgtcactttagaagtctcacagcaccacttctgggtgggttatgagcccacccaggttcacaggaaaggatcatagagcccacctcttggcaggaggcagagtcgcattgtaagaagagcctgtgtgttgggagatgttgccatggtcttctgagggaaatgtcatctgacaagttgggaaaatactattgtgttccgttattagctggtatgggaatttttagaacattttaattgtttttacaataaaggttgagacaagattttaaaatttaatcccctcgagtaaggtttactacaaattcatattccataaaaatttaacatattaagattttataatggtatttgcttttattatattcctttttatcctattttctattaatatcactttttggtgtagcttttttattaccatttttattttgcagacaaagctgtaaaatgtaatatggattcattgagagattcacctaaagacaaatctgaaaagaaacaccattgcatctctttaaaagatacaaataaggttgtattttaaaaatgttctttaaatacaaagttcatatagtgttaattttcaaattttctcttttgaaatctatctgaaaccaaaaatatgttttctattaaaaaatcattggccatgatagtttccttcatgagaaaatatagtttgcttgtttgcttattttgaaaggagaaagtagctccagcttcttcatgtcgagctcttgttctcggcctagttttctttctacaaaattggatattgatcctccttttaatgaaggtgtgaaaatctgggattccagggcattgtcctagtgaagtgcaagtctaatctgctctccgtccctttgacaagacaggttgaaagtaattgcaggacattttaagtactgacgatctggaatgccagctgcctgccatttggacatttaatgtagtggttatagcgctggcataatcacccaactttccagttttttatctctctatctctgtgtgtgcatgaaagatgtctgggatggttgttcatgagaataactcccatggaattttggttccaaaagaatgtatattatgttgctagcatacacattctttctgaagaaaagttttcttttacagcgtgttgaatcctcagtgtactggccagcaaaaagaggcataaccatatatgctgatccagatgtaccagaagcaaggtatgatttgaaaattcaaactgggtgtggtggcgcctgcctgtagtcccagctactggggaggctgagctggggggatcgcttaagcccaggaggtcgaggcttcagtgagctatgatcgtaccactgtactccagcctgggtgacagagtgagactcttatctctaaaataataataataataattcggtgtaattgacaagagacttaagagtgatgttgtcttatacagtgttctataagattgatgattggaaaatagtccattttcaaagagtggcccaggaaattttggttaaacatattaacttaaaggaaaaatgtgacacctggttggcagcaaagttgactgaaaactggtagtggccctagagtctgtctcctctttgcctttttggacagagttgtccctgtaaggcaggtctgaagattggcacagagtggtcctgatgagagggatggcctcacgtggccagatggcagcacagggtgggtggttacccagggcggaaagagaagaatggtttcgtgagtatcagaggctgggtctgtactttgtcctcttcaagatacatgtcagtgacgttaacaaaattgcagaaaggatgtaatgttgtaccacttcttgaatggtctaagaacacacttcccctcgtgtcgtggactttatgctgtggttgtcatatgttgtacttttacatatatcataaatgctagactctatctcacttttatttaaatagtcaattatattctagagagagttaactaacaaaaatatcttctctctt

SEQ ID NO: 91400 - DNA, 1182 bp, Homo sapiens
tgtcagaaatgacttttatacttaaaggactaagctccagttctcacagaaatgtgcttatgtagataaaccaattcctcagtggtgcttcttaaatttttaatccagaaaataaagatattttcaggattggggtaaaggggttcacaatttttcatttttttaagagacagggtcttgctcttgttgcccaggctggagtgcggtggcacaatcacagctcactgcagtgtccaactcttgagcttaggcgatcctcccaccttggcctcccgagttgctgggactataggtgcacaccaccatgcccggcattttttatttttttatttttgtcgagatggggactcactgtgttgcccaggctgctgttcacaaattttaatgaatttttttttttcatttctagtgctttaagtcagaagtcaaatgagaaacctcttagattgactgagaagaaagaatatgatgagaagaatagctgtgtgaagtaagaattttttccttggcctgaattgtgtattgaaataattataataaaattataaacaagagaaatctacacattttattattaatttcaaacctgcattcccatcaaaaaataaatgtacagtatatctcctgtagggtttgaggttaatttttgcttttccatccacttgggcacatttttctgtttaaagctttgttccagtgtaagtagtcattttctaccttgccttctggattctcttggtgaagtgaacagtgtcacaaatcaaattagatacagttgatcttttggggctgttgatgttctttgggttggtctttgctttctttccagttctctgaggcaacactgctagagaaactgagcagtttgccttgatttcatacttgtgtaatctgtaaaatatttacatagcaattttcgttttgagacaaggtcttcctctgtcatttaggctggagtgcagtggtgcagtcacagctcactgcagcttcgacctcctaggctcaagcgatcctcccacctcagcctcccaagtagctgggaccataggcatgcaccaccataactgatttacatatatatatatatatatatatatatatatatatatatatatatattttttttttttttttttttttttttttttttttgtaggacgagggtctcgctatgttacccag

SEQ ID NO: 91401 - DNA, 1004 bp, Homo sapiens
ccagtaagcggttgtatttctttctcctcgggcctgttccttcatataactcatttggaaacccccaagttacagtacattctggaagaggtcaccccagatgcagtctttcccattccaggatcacataccaccaggatccccttgggaatcctggatacttgggtagcagaggaagtggcggggcccacacccaggtttaagggctctcctagtgaaattctctctcttaatttttgggtgttcaagagaaactgctctgttttgctaagggcttctggaggtggcaaggcagcctggattgggctgagatcgtgtttctaagctggtgccagcttccgcccagcccgtggaaatatgctaggtggtgggtgagtctcaactctgtgtgttgaccctcgcagcattattttcaggaggcttttggactttgacaatgcagccatatgtgctgcggggagtactttcataactggttaagatgtcctgagcataggagggtggagtggtacctgcttgccactcacgtcatctctgatatttaatgtaccctggagctctctctgcagttctttgtctttccttcttctgtgtccctcttgcctactgtgatattcattctttattcttctgttgtcttcctttaaacattttaacatcagcctactttgtactgcccactgattgaagatggaaaattctccgaatatgcccattctttttttcttttctttttttttttttttttgagacagagtctcgctctgtagcccaggcttgagtgcagcggtacaatctcgccttgctgcaacctccgcctctcgggttcaagcgattctcctgcctcagcctcccgagtagctgggattacaggcgcatgccaccatgcccagctaacttttttgtatttttaatagagacggggtttcgccatgatggccaggctggtctcgaactcctgacctcaggtgatctgcctgccattagcttcccaaagtgctggg

SEQ ID NO: 91402 - DNA, 1050 bp, Homo sapiens
gctcacgcctataatcccagcagtttgggaagccgaggcaggcggttcacctgaggtcaggagttcgagaccagcctggacaacaatggtgaaaccctgtctctactaaaaatacagaaattagctgggtgtggtggtggatgcctgtagtcccagctactcaggaggctgaggcaggagaatctcttgaacctgggaggcggatgttgcagtcagctgagatcacaccactgtactccagcctgagtaacaagagcgaaactccatctcaaaaaaaaaagaaaaaagaaaaaacgcgtttacaggaatgaggctttaggaaggagcgcagtttgccatgtgtgtaacccaccatctttatcctggagtccccgccatgtctgtgccttgtgacttctctgtgactgccactggccttacccatgttggggttgggctggatctagaggaaagcagtttcaaatttcttctcctctcagcagaggtgactgtggacaagtcctatctggtcttgttttctcatccataaaataaagatagtaaagtacactagtgattcctgagcttggctggggcccctcagatactctcagggggacctgggtggcagggttgtggcagcacaggtacaggccctcatgtctcataaaccaagcagaacagaacaggcagcagttgtacagctgagccttgggctgtgcagcccctgctatctctgtcaaggaagaactaaaagaatagctcaactgaggaaacaaacacctttttcttcacattcttcttttaactatcttacagattactgcagtttttaaatcctgatcctttgagagctgacggaatctctgatctccagcaggtattacaggccctaaaaaaagtaaaataaaaagagagaaaaaactgtttattctttaaatccttctccttcctccctccagacttgagattagaagagaaactccttagatgggggacttaacctgaagacatccttttagaaacgatcgaatggattgttgcttctgagaaattgttccttgttttttg

SEQ ID NO: 91403 - DNA, 1838 bp, Homo sapiens
gataacctgaggtcaagagtttgagaccagcctggccaacatggtgaaaccccgtctctactaaaaatacaaaaattcgccaggcatggtggtacatgcctgtagtcccagctacttgggaggctgaggcaggagaatcacttgaacctaggaggcagaggttgcagtgagctgagattgtgccactgaactccagcctgggcaatagagcaagactccgtctcaaaaaaaaaaagaccgaaacaaactctcaaggaaacaaacaatgcagtgaggaggagaaaatgttaaagaataaatatccccagagagaataaatatccccggagagaagacattgcatctctaacagcttactgttaaagggatgtaatgttttttctctctggggatattgaaaataggatattttaaaaaggaacaggcagaataaaagattcttggaaattcaaaatatagaaaaatgtaaaaatcactagtatgtttgagacataaaagagaagctaactcagaaagtagaggaaaaaggcaaagagacggaaataggaggaaaaatttttgagggtcagtttgaggtccggtttctgaaaaatgggatttctaggaagaatgaaggaagatgataggacattttctgaagattaacataggaacattttctggacctaatggacaagaatttccagattaagagggcctacccatcacaggcccagcacaactgctgaagaaagagattctgaagcatctaagttgagggaatctaaagattatgaaggcttcaagagagatgaaactggtcctacacactggaccaggaatcagaatggcttcagatgtctccacagtgcaccaaatgagcattgatgtcaaaattctgatgaggtcaggtgcggtggctcacgcctttaatcctagcactttgggaggctgaggcgcagattgcctgagctcaggagttcaagaccagcgtgggcaacatggtgaaatcctgtctctactaaaatacaaaaaattagctgggtgtggtggcatgtgcctatagtcccagtcgcttggtaggctgagacatgaaaatctcttgaacctgggaggcggaggttgcagtgagccaagatcgtgccactgcactccagcctgggcacagaacgagactctgtctacaataataataataataataataataattctgatgaaaagctctttccaaccagaggtccttactcaaactgtggatggagcgtgagggtagagtgaagacatttgcagacatacagagtcttaaaaaaacgtacttcccttccaacctttgtcaagaagatattaaaatatgttctctaccaaaacaaagaagtaacccgagaaagatgaccacatgggtttgcagacaaaaggtgatggtgaaggatgataccaggatagttgctcaataccaagtgcagagcatggcgggtcctgactgcagctagggctcaggactcgagaggacctcacagagctcatggtgccgatgagctcggccatttggaagatcctatccatgtgggtggagaactctattggaacatttgggttttagtgacagttacatagaaaaataagcaaataaaagtctatcttttaaaaagctttacaagtgaagctgatggactggcagtttattaggagaatgaggaggaaaagccacatctttgatccagtgaactttaagttcctgtcaatgggccatctattggatccttttaatttagaaaattaaagcaagaatcttttttttttttttttttgagtcggagttttgctcttgttgcccaggctggagtgcaatggcatga

SEQ ID NO: 91404 - DNA, 1074 bp, Homo sapiens
gtgcctggctttttttttttttttttttttttttttttttgagatggagtctcgctctgtcacccaggctggagtgcagtggcacagtcttggcttaccgcatcctctgcctcctgtgttcaagtgattctcctgccgcagcctccagagtagctgggattataggcatgcaccaccacacctggctaattttgtatttttggtagagatggggtttcaccatgttggccaggctggtctcggactcctgacctcaggtgatccacccacctcggcctcccaaagtgctgggattacaggcatgagccaccgtgccctgcctagcaagaatcttttaatgggagtcttaataggagaaaaagcaacagtcttttaataggaggttggtactgagaaaagatttggggaaacttaacaagttagggcttggaaaatactgggtttggcaatgtgtagtgctttttggggtgaaatgagccatgcaatggagtttttgttagttttctctaccttattttggtttctggttgtttctgttttgtaggctcttcaaagaaataagtttccgggccccagccacactgaatcttactcttggcctcccatagcgcgtggctgtgatgtggttgtcatttctcactgtgaaagcaaccctttgctctacctcctaccagtgttgacagttttgcaaacaggagcctgctacaagtcattaccaagtagaaatggagtaagtcaaagacagttttgcctcacaaccaaatgggttaaatatttattttaaaattatacacctcacctttgaggaaggtcgtctattactcagtttggttttcaaacttccaggccagaaactgtcctgtgggaaagtgtcctttcccattccaattactgatgctctcatactgattctcacctggagcctatagttgtgggccattggctgaggcttttagaaatggatatggaggccaggcacggtggctcacgcctgtaatcccagcactttgggaggccgaggcgagtggatcatctgaggtcaggagttcgagaccagcctggccaacatggtga

SEQ ID NO: 91405 - DNA, 1048 bp, Homo sapiens
ctcccgggttcaagcaattctcctgtctcagcctcctgagtagctgggactacaggcacacactaccacgcctggctaatttttgtatttttagtagagatggggtttcaccatattggtcaggctggtctcacactcctgacctcgggtgatccacctgactcagcctcccaaagtgctaggattacaggcgtgagccactacacccagccagggttcgtcttttttaaggcccctttcaggaggcatttagttcattcttgtgcttaggatctgtgcaggggatgtggagccagactgcctgggttcaagtcctgttgctaccatgtattagctgtgcagccttgggtaactgacttcacctctctgtacctcaagttcctcacctctgaagtgaagcagtgacagcctctgccccataagagcatcttaagagctaaatgaatgcatacgtgtgaagtgcttcattgagactcagcaaatatgactcaatgtgtctaaatctgttttaatgaaattatatcgtcacttttctgacctgtatgatgattatagcagaaacttacggggtgctgcttctgtgcaaggagatgttcttgatgtttcatatggatgctgaattcctaactactgtctggagtcatttgaatttgtctgtcttcgcagcctctcgcagtcatcgtgtgccctgggtggaagaaggcccaatttatttttgaattattgggagaatatagcatgtcctccaggcctcttcatcctgtgctattaacaattgggctccataaagaggaagccaaaaatacaaagcttccaaggggctgtaagtatccttttcaagcggctataaaagttaaagtatccttttcactgtcttccctacagaagacagtggagcctggctgggcctgggtccacagtgacatggcttgtgtgatgacacactcacagtcactagtccagacctacttgtcagctcccgacggttttgattacgaaggcttgatcttgacttacgtctgcttcactgagaaaactatgtcacttc

SEQ ID NO: 91406 - DNA, 1472 bp, Homo sapiens
ttgatcttggctcactgtaacctccacctcccgggttcaggcaattcttgtgcctcagcctcccgagtagctgggattacaggtgcacaccaccacacccagctaatttgttgtatctttagtagagatggggtttcaccatgttggccaggctggtcttgaattcctgacctcatgatccgcctgcctcagcctcccaaagtgctgggattacagacgtgagccaccacacctggccttttccttttatttttgaaagactttctccactctgagaacagaaaatatacaaacccttacattttatgttctgccacactagttcttactcttttgaaataaaaatgaaattaattatgctaatttttcagatgtttgctatattagataactttaaaaaaaatattgaagttgaagaaagggaatctgcaccacatcagattgttgcagttggagttcattggaacaaacatatagaacatctcatcaaagagttcatgaatgatccctacattgtgatcacagccatggaagaggctgctctctatggcaatgtccaacaggtaactttgtgtgtatgtgtatgtgtatgtgtgtgtgtgtgtgtatgtgttggtggggggctgatgaacacaagcaagtaacttttatttcatggcttagtattaaacaattacagctttgatttcatatataaattatgaatgaaatacaattatagttgaatatttaaatttatattgatttcctatacattcttttctattaaaatcccaacacctgtggaaagtggatctggagcacctaaaatattaaaaagtcacattgtttctgtgcttcattaccaggtagtacatctttgcctagaatgtgaaaaaacttcttctttactccaagctcttgattttattccaagtcaggcacaaaagaccttgatcttcacctgctctgtagctgaaacagaaatagtgtgtaaggtgagtccatctccatataaaaaatgttctgtttgtttcaactggtcgaatctcaagtcatcacaaaattactggggtggttgactctgtggcagggaagtaaagttttacaagtttaacatcaatcagaagaggaggtggggtcttctcacagagcatgcaggctgaggcctggatctggggaggagccaggtgcgggggcagggcttttcctctgcagcagcgttccccagggcagggcagtttcgtcttggtggagtattaaaagtatcaatttatagacatgacaacatcttctgtaccctctgtttaagaagattgaggtggctcatgcctgaatcctagccctttgggaggccaaggtaggaagattgctggaagccaggagttcaagaccagcctgggcaacatagtgaaaccctgtctctacgaaaaaaaaaaaaaagaagaagaaaaagaagattgagaagataacagtaaaagatatcatatagc

SEQ ID NO: 91407 - DNA, 2185 bp, Homo sapiens
agtacatctagctttctgcagcagtcagctagaagtatagttatatggtactgtagtcaaccaggactttctagctgatgtgtctgtgtgtgtgtgtatgtgtgtttatacacacacacaagtatggctgtgttattttaaaaggaagcaaaatagtttcagcaaaatactgcttatttcacttgagcaagattttagacataaacaaccgaattttggaaatatatttcagtttataatcatctcattcttaagaattatgggatcagtgaggtagtgccctcacagataaattaaagtgctttacattgacaattattgatggaacggttggcttccagcctatatccctgactgtgacctggcctctttgatttcatctttaggtagtagaaagcagttcaatattttgcttgaagatgcataaagaaatgatttttaacttacaaaatgttttagaacagtggaagaagaagttaagttctggctctcaaattatattaggtaagtgttttaatttctacttctatttagtgaaggttgagctactaggaattctatctttaattcatttatatatctcatctccagatttctcattattccccaggtttactgagactttattagcaatgttaatttcaaaatgaaaaattaacctccactaagattttgatgttgaggtaaatctctcaggtcagtgggcagccaccattagtctagacattctccctagagttatagcttgaggatcactatcatatatatgatatatattatcatatatatatatgataatatatatcatatatatgatagtgatatatatgatagtgatcatatatatgatagtgatcatatatatgatagtgatatatatgatagtgatcatatatatgatcatatatatcatgatagtgatcctcaagctatatatatattcatgtatatgactatatacatatgactatatatagtcatgcatgattgctaaatttaatattaaaaatataaaagtcaaaatatatagaataagtgaaaaacatatgggccgcttggatttgtaataagagacatttttcaggctaagaaggagaccacttttctctggaatttaagcactgggctgtggcattttggggaaaaaaatggggaagaagtttctttgcatccaaaaaagtaaaatgtgatatggaaatgcactgcagtgtggccgtgggaactgccggttaaagtaagtgcggtaactccagcgcgtgtgacattgtcggactccctctctgcagccctcacagacgactgcgtcccactcttggccatcaccgatgccacgtgtgtgattcacttcagtttccctgcctcaccaaaagtttttggtggacgcctgtattgcatgtctgatcattttcacgctgaacaggtttggtgaatttttattctcttccatattccactggcatcttctgtgtcatgataagctcagagtccacaaggtttcctcagtcagactgggatagatgatccacttcctttattcacccccaattttcagggttctcctgcagaacagggagataagaaagccaaatctgtcttgctgctgacggagaaagatgcgagccatgcggtgggcgtcctgcgctacttggagcgagcggacgccaaggtccccgcagagctgtacgagttcaccgcaggagttctggaagccaaagaagataagaaagccggaaggcctctttgtccatatctgaaggcttttggtttttgcaagtgagccagtaatttgtttcttattaaactgatgtataacctgcagtaaggtgcacagctgttgcaatgtggtgaattgtcatgtatctagaagccaccacccactctgagggagcagtctgggggttccctcgcactcttccccacgtgccctcccctctgcagggctgtcagtgttgattaactttgcatgattttgaactccatagaaatggcatcgtggtatgttctctttcgtgtctggcttctttctctcagcctcatgtctgtgacattcgtctgtgttgttgtgtgtatctatggtttgttttatagctcagtgttctgttgtatggctgtatcacagtgtgtgtatccattctcctattgatgggcctgtgggtggtttccactatcaggctatgatgtttga

SEQ ID NO: 91408 - DNA, 2121 bp, Homo sapiens
gctccctcccttcacacagagcgtctctgccctctgcacactgactttttcctcacacacaggtccccctgcctactctaacctgtgaagggctgtcttctccagcacacacaagctgtggcctctctgtccacttctggattgcctaggtccctgtaggacagtttcatccctgtaaccctggaggctgatatacagtagctcttaataaaatgcatcttgttacctgaaaaaagatcagaaagtttcaagagacagcagtgctattttaagaagaatttctataaaagtgcagttagaaggtaaacaaggaacacttatacctaataatgaagttttaaaataatgaaatttgcaaaataaaaaaatcttccattagatttaaagtgaaactaattctttatgactgtgtgaggtattggttttgctttgcttttttggctagcttcctagttttttctaaatccacgttgctaagctttggtttcttaggttgggtactgatttctgcagatacagggaatgtgtacatatccggtttagactaagtttgtttcttggtcatgtttactatatatgtttcagataatacctttttatattttgaatgcaacaaattactttggccgtatagttgataaacacatggatctttatgcaactctcaatgctgaaatgaatgagtattttaaggattctaataaaacaactgtggaaaaggtggagaagtttggattgtatggattagcagaaaaaacgctttttcacaggtaacacatctgtttacttcatctgtaaagttttgaagcatgaggtaactaagtggtgttgagttccgattttgacctctgtccatttgactgagtgtgtatgtgagcctggtgacagcggggtgtccccccagatgcctgctccagttctttgtgggaaactcttccccaggctcctgagcccagtgacaccgtgacccattgagccatcactgcgtgcgacatacacatacatctttaactcacttaattcttgccaagttcctatcaagtgggcatcattcccattctacagataagaaaacagccttggcgatgttacgaatgtggtgtcaggtcagctcgatacctggcatagtttgttccaacctggtcagtctgaatcacatgctcgtttgtacccacttcccttgaatccacacctggcaccacttggtgatagccttgaattcagaaactttgaaacttgacaggtgacgttgctcatgcctgtaatcccaacactttgggaggctgaggtgaatggattgcttgagcccaggaggtcgaggctgcattgagctatgatcatgccactgcactccagccggggccacagagcaagaccttgtctctacaaaaaacaaacaaacaaaaaagacaaaaggaaaaaaataaaaaaactttgagactttaatttgctatgttaatttttattatgttgttagataaaaggatttactcttattcaaaagtacatgtttttatacttatgtatactttaaataatccaccacttgaatttttgaaggccttagttttttatttctagtatagagtaaaatcatggcgttttggagtctttttatatgttttccatttcatggtaatttgaggcaaagatgatcctttctggaatctctgcgttgaaccgatgccccattgctctccagggttcaggtgttggaagtgaaccaaaaagaagacgcctgggccctggatgacatccttgtagagttcatcgatgaaggcaggacggggctcgtcacaagggaccagctgctgcatctcccagaacatttccacacacttcccccgcaggctgtggagtttattgtctgtagggtgaaacctgctgacaacgaaatagaatggaatccgaaggtgggtgattttggctttttatctattgttgacttttagaatatatttaaccgagaatatacacagaattgaggcctgtctggatttacagtgtcacgtttgggcagggaaagtgcagtctgcttagatccccacggtgtgtgaacgtcccagctgaaccctcggagaggtaccaggcagctgcaacactgtcttcaccactgtcctt

SEQ ID NO: 91409 - DNA, 2026 bp, Homo sapiens
aggactccatgctacattctctgatgctgacagtttctaactttctcattcaccacgcacttaactgagcacctgccacgtgccaggagcagtgctgggcactggggttccttctgtgagcaaagcagacgaagcccccatcctgcagagcagccgtgggagggggcgggggaaagggggaggggaggacacatgacaaggacatgtgactcacgggcctccgtgtctctccacggctgctggcaccaccctccctgcttgttccccaagagctccactcctccactcaaagttctgctgtattagacttaaatcttactatgaatacttaccagatttaacagagtcaatttataaaaacttttgctgaatgttatttttatgaggttggaaaagttttaacatgttaaaagggagtttggatgtaaggtttaagactaagcagaaaatggttttcagaagagaaaatatggattacaaatgcaggtaaatgaggagatttgggcatcttagttgatgttgtgatagtattgtgtttgtttcttgttggggggagaaaagcagatattttattaagcagagatttaaaagagattgaagtaaaaaagaaagcccacctggcagatgtgtccacactgcagcacgtgtggcagtgaccacggcggccagagggaaacagacccaccctcaccatctccacccgttcctgcccccacccattttgagcagagagaggctcctccacacattccccggtggacacacattcctggggttcacctaggaaggggccccagccagggcaggcctggagcaccccccaccctcaccatgggagggacagcccctcctatacccacactgccaccaacagtgccaggctgttgcagatttttatgttttacttaattttgtataaatggaaatggatgaggatgtttggttgcagaaaagacgaacagaagaaatggcccagaacaggattcaggtccttggcttaggtccttcccatcaggcagacgctgagcctcaggaggtaaaagtagttgagaaggaatgagaaagatgtacgaattatgcatctgactaggggtttatcccagatttgcaatttggtcttgactaggggtttatcccagatttgctcttgccacccccccaccacctgcccatatttctgtggcatggggtgaggcctggatgatttggatggaacctcaggtaggaagcaatccagatgctgccatggaaagccctgcacgttgtggcaagcgccgaagtgcagccaacgtggcaggctgaatgaaccagagaggccctgtgggaatgtctatgcttcagttaaaattcagagtgattactgctaatgttcaattttttcattgattcaaggtgcacattacaaacctttccagtttaaaaacctctgtcattgattataatgttcgagctgaaattttgtccatgggcatgggcattgataatccagaacacatagaacaactgaaaaaattacgcgaagatgctaagataccagcttgtgaagaaagcctaagccagaccccgtaagtggatttctgtctcctttttggaagagttgttttttggaaatacaactcacaagtgttaaggacatgttttatgaaagtagaagagttggctgggtgcggtggctcacacctgtaatcccagcactttgggaggccaaggtgggcggctcacgaggtcaggagatcaagaccatcctggccaacatggtgaaaccccgtttttactaaaaatacaaaaattagctgggtgtggcagcacgtgcctgtaatccctgttactcgggaggctgaagcaggagaatcgcttgaacctgggaggcagaggttgcagcgagccaagatcatgccactgcactccagcctggcgacagagtgagactacgtctcaaaaaagaaaaaaaaaaaagtagaagggtttttaatgagtctccatgtacccatcactcagttgtaataatgaccaagattttggaaat

SEQ ID NO: 91410 - DNA, 1029 bp, Homo sapiens
gaggccgaggcaggaggattgctcaagctcaggagttcgagaccagcctgggcaacatagcaagaccctgtctctactaaaaatacaaaaattagctgggtttggtggtacaagcctgtagttctagctacttgggacactgaggtgggaagattggttgagcccaggaggtttaggctgcagtgagctgtgattgtgccactgcactccagcctgggtgacagcaagaccttgtctcaaaaaaaaaaaaaatgacaaagataaacatagtatgatctaaagttttttagttttttaccttaataaaaatggatacctataggattagaatacagggtagtttccctctactttcaagaaaaaaaaaatttcccatacttttaagatacttttttagaaatgaagatgtcattaaactttagtagatttaaccaaaatgaggtttggtggcttatgggaagcactgactttgagccccagccctgtgtaaaggctcccacagccccctttcccactgtagctttgtggttaagggagcttaacatacccgtggtcacgaacacagagcatacagcactgcgaggtttcacagagagcctgctagaagagaccccatatcagacagctcctggagaacaggggatcctgacaggtagagagggaatggcgagaatatttcatgctgtgacccgcagatctggaagccacaggacttggcggttggcagatgttagggaacgtgggtctgcaggtctgagccctggtgcctggggaatgctggtgcggtggacagtgacaggtggtttccaggcacagcccacagcagaggaggagaggctgaggtgggctgtggaggtgccagtttttaaggttactgaaagtctacgcctagggctcaggaaagcagctggggaaggctcttggtttgctgctgtttgaggagagtcaaagctcagtgagtgtgaggaggaaggaatctacctagcagaggaggatctatcgaaggagaagagggtgggcgactgcaca

SEQ ID NO: 91411 - DNA, 1642 bp, Homo sapiens
ctagcttcacggctctgtctttaggatcagtcccagctctgtgatcaggccaggccaccccgggtttcctctgctcgcctcctctcagaagggcttggggattgtgctctccaaggttcttgacgtcactgggtcagtgcactcttttcctgaggccactcgatggcaggcggcatgtgacaccgaggatggcgctttctcagcaggagtctgtttgtttctttgccattgttttctataccatgaataaaccacagagggtggatctgttttccgtctcaggctactgtgattccagcagctgtgaacattcttactccggtgtttggatggaagccttgcctgttggagattgagaagttcacattgcgttgtttgagaatatgtcatgtccagcactggctcctcgtgcgtgctggccgctgtccttagggcatcctggcaggtcaaacagctccagagaagcctgcatgtttgtatccaaggccagccactgcaatgaggttctttttcaaatgagtgacttcacttcctggtcattgaattttaatacttgtcaaaggctgtttttattttaaaataaaattttaggccaggcacagtggcttaagcctgtaatcccaccactttgggaggccgaggcaggtagatcacctgaggtcaggagtccgagaccagcctgaccaacatggtgaaactccattcctactaaaaatacaatattagccgagtgtggtggcgcatgcttgtaatcccagctacttggtaggctgaggcaggagaatcgcttgaactcgaaggcagaggttgcagtgagtcaagatcataccattgcactccagcctgggcaacaagaacgaaactccatctcaaaaataaaaattttaaaattttgtttacctatgtgatggttttaattttttctaactgttctttgcagctagatactagggttactcaatttacacttttatgtgattcctcatctagacgttgcataaggtacaaaaaagtatatatatatgtgtgtacatgatggagttacatataaataacctgtaggaaaatatgaccttgattttgtgcagaaactttatctggaaacactgaaggtgccttcattagcagaactgcacagccgcctctgaaaaggtacgtccactcggcatggaggagtcggcgtcccttacccagttaataagatcaatgaatgcgcaggtctttcttcttctagcttccacccacaaataaaatggttccaaaaagaagatgtcgtcatcttaaagataagaataaggaatgtaaaggactacaagtgtcagtatttaagggatagagtcgttttcaggtaggtttatgtatagtcatataaagtaaaatagaaataatttttagcattttaaaaggctgactttatttctttttataaacccagtgcttgggtgggagacaaattttacctggctgatctggagctgcggggcaacataaggaaagatgactgccaatgtgtgattagaaacgatgaacctgtaatcactctggccaaagagagaagggaggcatggtgtcacctactcagacagagggtgagttgggatgcactcagcgggtggtctttaccctgcgtgtgtcatattca

SEQ ID NO: 91412 - DNA, 1700 bp, Homo sapiens
gttctgagggcagtgagggacaccatcacccacttaggaattcagccttggtggaagtggaccgttcatgtcaagccctgagaaatcagttttctctttgtttatcttggtgctaaacgttctggtttgagtacttttcaacccttggtgataaacacaccttttaataacacactacagatattcttcctagaagaataaattatttgtaagcagaccaatttgacctgctcatttcttacctaaaataatgaaaatataagatacatagagctggaacccaaggcatttttttctgcattgacccaaataatggggggaaataaagatttgctgattagtctacacttatttgttataatatcttactcctttagtagtgaattctaaaaacctgccgtacacagtgacagaggtggttgaagacagtagcagcacttcagaggatgacgacagtgagagtgaaagagaaggtgaatgacgtcctcaagagcggctggaagatgttgaacaaaaatggatattgccatgtgaccgacagttaagaaaacagtcagtcataaccaaatctttttcttttcttttctttttttttttttttttttttttttgagacagagtcttgctctgtcggccaggctggagtgcagtggcatgatcttggctcactgcaacctctgcctcacaggctcaagcaattctcctgcctcagcctcccgagtagctgggattacaggcatgtgccaccatgcctgaccaatttttgtatttttagtagagacagggtttcaccatgttggacaggctggtctcgaactcctgacctcaggtaatcctcccacctcagcctcccaaagtgctgggattacaggtgtgagccaccacacccggccaaccaaatctttctttacctcaaggataaatgattactgtcaccttgtggtgctggacttgataacggtgagaaattcttcattgacttaaaaataggctgatgataagaccatcaaaggagggtggacacagagaaacagcaggtgtggtctgattccgccggcttgtctgtcctgtctggcgcctctcgccactcaccctggcagagcagacatgcatctgggtgatgaaatgcactgtctggagtcagtccattcattttttttcacctagacctttgctacattgctacaaacctgatcttacacatataaattgaggtttctaatgtacacacttagactcagcaactgttgaaccagccctttcaaccatgagatagtgggatttaacataaccatctatgtgaattgatagtgttagcattcttggatagtgatagctcctcagagtaagttgacttctgatgaagagatagtccagggatagaaattggattgctcagtaagacccaggcctttccggggtgaagctgctggttctaaacaatcccttggacctgcagagtcctgagcaaatggcacaaaggttgctttttagtggaaattcacaagggcctgtggggtgcctggaggtgatctttgaatgcctacatgtcgtgagccctgcagacattcgccaccccatctgcattgtggctgcagcactggggggggtcaccaggtttaggggaggagtgtatgtagtcatggccacacccagaggctggcttttgtgctttgggtttctttgttgactgaaaaagc

SEQ ID NO: 91413 - DNA, 1032 bp, Homo sapiens
gtgattttccttttttgtagctaaattgggcaggctcttgggaagtagaaagttctggtgtttttgctggtgaaggttttgactgtggagctcttctaacacccatatcagtgtctgtttctctgcatgtggctgctgccctgttggtggagctctgggggcagagaccaggccgccgtccagtggcgccccgtgcgcaccagctgcctgctgtttacacccaggtgcgccgagtctctttcatacagcacagcaaatgataatagctagtgacaatgtgtttcctgtgcactcgtgaaaatgcagggaggacaactgcatgcttagatctgtttcttttttcagacattcaaatgttctaatatctgaagctaacattttgtaggatataggatgctgattatgtgaacaattagtcattggttttctgtactgctatgaatatgtctgatttcaagttttggtcaaatatctaaaatgcaaggtgaaagtgcctttgtctctatgcttctaaaatcgctcatgcttagttgtggtatggatgtcttccgcagtgtatcatcaataaaatttcactgttttcacagaaatgttgctttttacattttttaaacagtactttccctgaatgccaaacacagaataaaactttactcaccacactttctggtttgactaaaacgcccgtgaaggctgctagggagccagcgatgctgactggcaatgcaggcgaccctcgtgatgagcacaccggctgtggagggttctggatggaggctcagctcttgccattcatcctggcagatagatagatacatggcacgcacatcacaggttcagcacagggcgccagtactttacttttagggtaggggagagtgggtgagaaacatttgtactttaatatttttgtatatttatttactttttgagttggggtctctgtcatccaggctggagtgcagtggcatgatgatggctcactacaccctggactccaggctcaggtgatcctcccacctcagcctcttg

SEQ ID NO: 91414 - DNA, 1495 bp, Homo sapiens
gccaaggtgggaggatcgcttgagcccaggagtttgtgaccagcctaggcaacacagtgagaccctgtctccaaagaaaaaaaaatgaaacaagaaaaatctatgaaaaatatatgtgcgagagatatcagaactgggctgggtgcagtagctgacacctgtaatcccagcactttgggaagccaaggcaggcagatcacttgaggtcaggagttagagaccagcccggccaacatggtaaaaccccatctctactaaaaatacaaaaattagccaggcgtgatggcagatgtctgtaatcccagcaacttgggaagctgaagcaggagagttgcctgaaccggggaggcagaggctgcagtgagccaaggatgcgccactgcactccagcccaggcgacaaagtgagactctgcctcaaaacaaatgagagccaggtggacctctttggttacagagacgggccacaggtattcgtgatgacttaataaaatgaataacaaggtggctaactggatcataaactatgctgtgaagagtaaactccactctaaaatacgatattttaaaagagtcaagtcagattggaactagaaggcatgcccctagcatttgaaagagttacatctaattcattaaaaaatccaaagccactcgtgactctggggctgcaagcttaccttgataggcctttccagctctttccttgtaaatctcatcacgatgagtcctagaatcgtcaggccataaaacagccatgcggcaaagctgaaataattgactaacgagtttatgtcaccagggatgatataaatcgttgctatgataccctaatagaaagaagaatggatttgtaggtcattactacaaaacactgttctcatgtcacagaagaccgaagaagcagtttttcttgtgaataaacactttagcatgaaacgaacttctaggcattccttcatagttggggttaaacctgactttggctatgatagctcttctctatgaagcttgcagaaaagacctgggaaatttctgaatctttgaggttgtgattttaagcaagggaaaaataaaatattaggttggtgcaaaagtaactgtgggtttttttgttttgttttgttttgttttgttttgtttgagatggagtctcactctgtcacccaggctcgaatgcagtggcgtgatctcggttgactgcaacctccgcctcccaagttcaagcgattctcctgcctcggcctcctgagtagctgagattataggcaggcaccaccacacccggctaatttttgtatttttagtgagatggggtttcgccatctcacggttttaatggtaaaaaaccgcaattacttttgcaccaacctaatatgtatgaatattataccagcttcataattaagaattttccacacagagagttttcaatgtgggctggggccctggattagaagctcaggtctagtcttggcctgtgttagttgtgtggc

SEQ ID NO: 91415 - DNA, 1059 bp, Homo sapiens
tgttgcccaggctgaagtgcagtggcgtgatctcagctcactgagccttctcgcctcctgggttcaagtgattctctgcctcagcctcctgaatagctgggattacaggcgcctgccaccacgcctggctaatttttgtatttttagtagagacagggtttcaccaacttggccaggctggtcttgaactcctgacctcgtgatccacccgcctcagcctcccaaagtgctgggattacaggtgtgagccaccacgtctggctcaaaagatctttaaaaggtcatttttatcagctgactctcattagtatttcctaatagcccataattgtgttttgtgaggtcttctgtgccaagtttttatcttcctcttttgattttcagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaaggtaaggatttaatgttttttctttttttttttttttcttttttcgagacagggtcttgctatgttgctcaggctggtcccaaactcctgggctcaagtgatctgcccatcccagcctctcaaagttttgggattacaggcatgagccactgcgcccagctgatttaatgactttttgagtataatgagtcactctgcctgtggttataggcagaatggagagaggttgctcagttctttctgggtttcttcacctatggtcatgcacagcatagtggcacaggtgtctgaaagtgagactgggactttttttttttgggacggactctcactctgttgcgcaggctagaatgcagtggtgcagtctcggcacctgtaacctccacctcctgggttcaagtgattctcctgcctcagcctcctgagtatctgggattacaggggcggctcaccacacctgcctaatttttgtatttttggtagagacggggtttc

SEQ ID NO: 91416 - DNA, 1031 bp, Homo sapiens
agtcccagctacttgggaggctgaggcaggagaatcgcttgaacccgggaggtttaggttgcagtgagctgagatcgtgccactgcacgcgagcctgggcggcagagtgggaatggcttcgggcaacggagctcattctgaccgcaggaggtcaagcctgtgcgggtgttgtagatgcctcctgtgcctcctgcatgcctctgggttcctcatttaagtggccatatagatccctgaaattggaaggatccaaggagagaaatgttggttgttctgggatcctgagctgggagagtcgttaaaaaacaataacaactgcaaccaaagaaaccatttcaaaaaagtataacttcttgccatttaaaaattttctggttgtgtttagatgtaagaaatatattaaccttcctttactctctatcttcagttggatataaagtacctgtcaccattgttgctggcttatgaagatatgatgaaagagaaggacgagctcaatgccaccctcaaggtaggctggcaaatgtcccagaagacacaagatttataaaaatataggaccgcttcaaattttataaaaacattttgaatgtaggtatacccagcatattatagataaccaaatgtttattagaggacagaaaggaggaaggaaggagtgtggcagggtgggaggcagggaaagaaggaagaggggaggaagtaagggagtgattggcagagcaggaggggtggatagggagcgaggggagaggtatggagggtcagagcagtgctgcatgagaagccatggctttctggacagccagcccatatgggctgagatcttggggtgcagggaagacagcaggggggaagtgcttctttcctgttactgtgcagctgcaaataccaccattagaagggacatttgggctgggcgcggtggctcacgcctgtaatctcagcactttgggaggccgaggtgggtggatcacatgaggtcaggagttcaagaccagcctggtcaacatggtgaaaccccgtctcta

SEQ ID NO: 91417 - DNA, 1059 bp, Homo sapiens
tatttagtagagacggggtttcaccgtgttagccaggatggtctcgatctcctcacctcgtgatccacccgcctcggcctcccaaagtgctgggattacaggcgtgagccaccgcacccggcctctgtatgatttttcaaagcacatattcttatgtcatctgaaacaatgactattcctttccaacttgaaatttttattttactttattgtacatgcaaaaacttccacaaactttcaatataacgttaactattcagtgttaaaaaacgttgtaacttttattcattcacacacacagacacacatacacacacagacacacacgcacacacagttcattgcctctgagcgtgaaagaggggagaaaagcaaacgatttgcaatttaataaaatctggataaattggatgttatttcttatagtataatattaaatttttttccctagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagaggtaacgtttccgattgtgaaaatcagcttttcagatttttaagcctttactgttgaattgatttccaatcttgagaggttcttatttattataatttgatgtaagaaaagctctgtccaaggcacaatgtttctaaggaccattctgtttcttgcctccttcccttccttcttccccgtaataaaggcaataaagactgtaaaacattgggacaatacagaagtgtacaaagtaaaagaggccggatgaggtggcttgtgcctataatcccagcactttcagaggctgaggcgggagaattgcttgagctctggagtttgagaccatcctgggggacatggcgagacagtctctacaaataaaaaatttaaaaaaattagctgagcatggtggcgcatgcctgtagccccagctactcaggaggctgaggcaagaggatctcttgagcatgggaggtcaagggtg

SEQ ID NO: 91418 - DNA, 1077 bp, Homo sapiens
gttgggctaggcctcattctaacctgccttcttccctgctggcctgagggattcacccaagagcagagcctcttccttctcacacctttgcttgaaagccctgctggctcctgctgccctgcaagatgaactttccatgccacatcacaataggcacggcctcctgcagctctggcctccctttctggcctcccctcagtacctctcttcctgccacccgctgtgacttcatcaggccacttactgtttcctgtagaagccattcccttcccagggaccaaagaacatggcaccaggcctgatgtggtttttggaacaaagtcagttgattttgatgtaacattgtcaacatcaattaacattgtaaaattttcccctgaaccctttcagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaaggtggggacagacagagtgcctttattagaggaatgagcaggacttcactcaattattttgagagttaatattttatgttgtgatatttgtgttggtaatttatgttgtaatatttcaggtttttttgttaatatccttatgtttgttgagatttgatttcatctgctatatcattattacactaaagaaattcctcaggttggaaagaagctgaatttacaaaaacaaaacagagattccaatacttcttttggaacttgatgcttagcttacatatatttcacttcagtttttatccctaagagaagcataaaaaagctcctcctttaccgtagacttaccaatgattatattttccttgctacttttataggttaaaaaaagaaatagtattttaatttgtatttctgttattattgaacttgaatattttttcatatctttgcaagtcattttctttttctttca

SEQ ID NO: 91419 - DNA, 1803 bp, Homo sapiens
gctcactgcaacctccacctcctgggttcaagtgattcttgtgcccaggctccaagcagctgggactacagacatccaccaccacacctggttaatttttgtattttagtagagatggggtttcaccatgttggccaggctggtcttgaactcctgacctcaagtgatccgccttcctcggcctcccaaactgttgggattacaggtgtgagccaccgcgcctggccaaacttcgtagtttttatcatctatcttgatgatgcctgacgccctttttcttacttttctatgtgcagcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagct

SEQ ID NO: 91420 - DNA, 1021 bp, Homo sapiens
gctattctggaagctgtttgttcagggctaaggtctcgttattacacaagatagggggtggggtgagaaatgtatgggtggggatggtggacccgccaccttgtcccctacagagcagcccctggcaggggctagtagatggccaatagtttctggtgatgccagggagtctttctgacagtcttgtccagatttacctctcagggaagtttccacacacagccccgtgggtgtttcttgtgttccccagcaaagcccaacattcctacctgtcaggaataagtaatgtggtttcgggcccaattactcagtcaaatctaaccctaagtgttcctatgccttatctagaaacctgaccacatatctatgggctggttagggcgtactgattccaggccagcagaagttggggaaagtatacgaacagaaaaaaaaacattcttatccgtagtttggaatggctgcttatctgagctctgggaatgtacgtaaaggaattagttattcaagcttccctgtaaaatgaaacacagcagtggtgatccaggtaattcagagtcaaactgaatcgtcgtcatttttggaagtggaaaggaaagagatgaacagttattttagttatttaatatttaattataatagcttaacattaaagttttttttttttttttttttgagactgagtctcgctgtgtcacccaggctggagtgcagtggtgttatcttggctcactgcaacctctgcctcccgggttcaagtgattctcctgcctcagcctccagagtagctgggattataggcgcatgccactacgcccagctaatttttatatttttagtagagacagggtttcaccatgttggccaggctgttctcgaactcctgtcctcaggtgatctacccgcctcagcctcccaaagtgctgggattacaggcgtgaactactatgcccggccaaagatattttaatcttaaatctgaagaaagacaaaattggaaaccgtttaatgctttaaacga

SEQ ID NO: 91421 - DNA, 1040 bp, Homo sapiens
ctcccgggtccacgccattctcctacctcagcctcctgagtagctgggactacaggcgaccgccaccatgtccggctaatttttttttttttttttgtatttttattagagatggggtttcaccatgttagccaggatggtctcaatctcatgaccttgtgatctgcccgcctcggcttcccaaagtgctgggattacaggcgtgagccactgcgcccggcctggtctcgaactctttgggcccaagcctcagccttccacagtgctcggattacaggcatgagccaccgcacccagctttccctggcttctcactatattttttctttctcattatgttactgtgtttaaacagaggtacagctctataagattattataaattactttctcaacttatattactataatttctcaagaagtggaaatgcaacttcttttccccagatttttatgctcttcctactgaaaatcttggaagaattattgttctctggcctgtagttaaatgcagagtaatgtaattttctagaatgctgcatcctgatagagattccttttctgcaactgcccctgtaccccacagtactaaaactcacaggaaaatctgttgtggccatgaagaaaagcagctggaaggccgggggtggtggctcatgcctgtaatcccagcactttgggaagctgaggtgggtggatcacctgaggttgggagttcgagaccagcctgaccaacatggagaaaccccgtctctactgaaaatacaaaattagctgggtgtggtggtgcatgcctgtaatcccagctactcgggaggctgaggcaggagaatggcttgaacctgagaggcagaggttgcagtgagctgagatcacgccattgcactccagccagggcaacgagcaaaaaactccgtctcaaaaaaaaaaaaaggaaaaaagaaaaaaaaaagaaaagaaaagcagctggaaacaaactagagaaagcctttccccagggccattgaaaggcccaaaatgaaaggtcttggcactatgtg

SEQ ID NO: 91422 - DNA, 1049 bp, Homo sapiens
tctctttatccactctgactgattaaaacaccttgacatcatatctttacacttgatcttagccaaaaggcctagaagcgatgacatcatttctttagatatgttaatatgccagtggaggttgctggtctcacgtcctgcattttaaggtgaccttgcatctgtcagctcagatctgcttgtgttcatttcacagtttaactttcaatgtgtaattctatatctcttggtttcactttcttatggggaaaccttaatgtatccactaagttttacatcaggggatacagggattaataagaaatttatgtggaataattacgtctatataagcactgagatgggaagtagctaagagtttatagttattgggaatttcaagtccatacatgttatttaatcatttactcatagacccaaatactctctaggattgtaaagttctaaactctttttttttcaggatggacaccctctacctttgtgtcttcacgacagaacagagcagacaaatctgttcttggtcctgaagattttatggatgaagaggtgcgtgtgcaaaactttaattgccaattagctggtgggacaggtctagttggttgctgtaactgccttctctctccccagaaggtccaatgtacgatttcctctttgtttgtaaggctttatcttttaggtatttgatgtgcagtgtcctgtacatcagtagagtcttgttcattggaggagcattttatactggggccaatttctaaaatcaagagtgtaaggggaaagtcatatacaggcaatttacttgaaaagcctcgtggctgggtgcggtggctcacgcctgtaatcccagcactttgggaggccgagacaggcggatcacgaggtcaggagatcaagaccatcctggctaacacggtgaaaccccgtctctactaaacaaaatacaaaaaattagccgggtgtggtggcgggtgcctgtagtcccagctactcgggaggctgaggcaggagaatggcgtgaacccaggaggcagagcttgcagtgagctgag

SEQ ID NO: 91423 - DNA, 1026 bp, Homo sapiens
tgcctttcatccctatttggattgttgctaaggagatggccaggtagtcaccctgtagttcttcacctagttttacacatgacgctctcacagttgtgatttgtattttcctccatgcttgtccttttggtggtttttcttgatcttttactccacggggtatatcctttggtgcccctaaggtacttcttctaaaaatcacgtcaatatgcttgtcttggaggaccacagccttgtgacctgggtagcccaatctgtccagggcggtgtgggccgggccttagtcactgagtcaacagaggtgtggggctttgcttaccacttgttcttccctttactgctgctgttgagtgatagcatgtatgacacgtactatttatgttcttagagataagaacgtaaaatgctgatgtgttctgtcttattctaatcatctctacttctggaattaatctatgacatcattttgtagaatcagagaaagaccttcggtacgttggcaaaattttggatggattttccttggcttctaaacctttatcttctaagaaagtaagaaaaactttttttctttctttttttactggtttagttcttaaaatatttgctgctatgtgatctgagttctattaacaacaggaaagataagtaaattctgttttcaaaaaacaacagcctggttactagtgattgtctagaaaaacattctacattagaaataccagggcgaggcgcagtggctcatacctgtaatcccagcactttgggaggccaaggtgggtggatcacctgaggtcgggagtttaagaccagcctgaccaacatggagaaaccccgtctctactaaaaatacaaaattagccgcacgtggtgtcgcatgcctgtaatcccagctactagggaggctgaggtgggagaatcacttgaacccaggaggtggaggttacagtgagccaagatcacaccactgcactccagcctggacaacacgtaaaactctgtctcaaaaaaaaaaaaaaaaaatca

SEQ ID NO: 91424 - DNA, 1032 bp, Homo sapiens
tctattgtcatctttatagttcttatcctataaaacaggcacattagcttctttctgtagaaatgggtgggaggatattcgaaatgcctgaccactggaacacggtggctcttgtgaccctccaggtccagaggggatgctggctggacctctggccagcctgttcttgtgctacctgcctgctgagtgttaacccgggaaggggcggggttaacaaggctcagaggtaacaggttttcctgattaaatcaaacatgatcttgcagcctgtattttctgggttttgtcttggtttgttaagatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggtatgtgccatggagaagacggaaatcatttcacataattcgagttatcaaaatcaaaatggaaagttgttgttttcccactgaagttttttacatgaatttgtattcccaaactgtggaaataccactatttattgtaaatggcatacataatagtgtgcatatcttttacttctttttttaagttttatttttaaacttatttattttgagataatgtctaggtctgtcacccaggctgaaggcagtggtaactctctataacctggaactcctgggttcaagcgttcctcccacctcagactcccatgttgctgggactataggcatgtgccaccaccacacctggcacattttttaaatagagatgagggtctcactatgttgcccaggctggtctggaacttctggcttcccaaagtgctgggattacaggtgtgagcctctgcgcccagccaaggcttgtttttccaccttcagtttggttgatgtcattcaaatcacaacttttgttgtaagctcagct

SEQ ID NO: 91425 - DNA, 1045 bp, Homo sapiens
cttattcccaccttactcagtgtgcctaccatgcatgcttggcatgtagtaggtgctcagtaaatacttgttgagtgagcaaagcctcagggaaggcaggcagggggccatcgcaggatgggctatgccggctgggcaggcctaggggtgtgggattctccactgacccgaggccacgaggctacaccttggaggtgccggctggcaggacgggttgttggtgggttttctcccagctctgccagagatgcgggggacaggacctaggctgtagtccactgcatagggttgggggctacagctgcctcaagtctagggggccctccttggcctcccgtacacaccacctccatgaagtcacaagttgtggccttgcccttggccatggccacccttggctggactcgatcccaccatgggggaggcctgtgctgaagcccccttccccccactgcaacccgcatcccaaccaaagatgggccggcctttctcggcctcctctcccgacagcggcctgcagtgggaagctggagcagcacacggagcggcgtggggtcatctacagcccggcctggcccctcaactacccgccaggcaccaactgcagctggtacatccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggcgtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatg

SEQ ID NO: 91426 - DNA, 1128 bp, Homo sapiens
gcagcagccatggccagccaccttgtgctcaacaatggcaccaagatgcccatcctggggctgggcacctggaagtcccctccaggccgggtgactgaggccgtgaatgtggccatcaatgtcgggtactgccacattgactgtgcccacgtgtactagcatgagaatgaggtgggggtggccattcaggagaagctcagggagcaggtggtaaagcgtgaggagctcttcatcgttagtaagctgtggtgcacataccatgggaagggcctggtgaagggagcctgccagaagaccctcagcagcctgaagctggactacctggacctctaccttattcattggccgactggctttaagcctgggagggaatttttccattgaatgagttgggtaatgtggttcccagtgacaccaacattctggacacatgggcagccatggaagagctggtggatgaatggctgatgaaagctattggcatctccaacttcaaccacctccaagtggagaggctcttaaacaaacctggcttaaagtataagcctgtggttaaccagattgagtgccacccttacctcactcaggagaagttaatccagtactgccagtccaaaggcatcgtggtgaccgcctatagccccgttggcactcccagcaggccctgggtcaaccccgaggacccttccctcctgagggatcccaggatcaaggcgattgcagccaagcacaataaaactacagcccaggtcctgatccggttccccatgcagaggaatttgggtgtgatccccaagtctgtgacaccagaactcattgctgacaactttaaggtttttgactttgaactgaacagccaggatatgaccgccttactcagctacaacaggaattggagagtctgtgccttggtgagctgtgcctcccacaaggattaccccttccatgaagagttttgaagctgtggatgcctgctcatccctaagtgacctatacctgtgtttcctgtctcatttttttccttgcaaatgtagcatggcctgtgtcactcagcagtgggacagcaacctgtagagtggccagcaagggcatgtctagcttgatgttggatctgaagagccctgtcaa

SEQ ID NO: 91427 - DNA, 2640 bp, Homo sapiens
aagaacacgcaacacctacgggtcgaatagagaagaaatgaagcacttcgcaggcatagttggagggagcggagcagggccgacagccagcggaggtgaccagatgcgaaggatggaaatgcatgtgtcgcggggggaggagagtgttttccagggcagctggtgtgttgcttctcttccgcaggtttacgtgttgggttttcctcttgtttgaagtttatactgtaatctggcatcctgaaatgtataagatttagaaaggtctcaatgttgatgggtgacaccaaaattggtagttgtgtcagaattgactgcttatatgaataggttgtcacttaaggcagacttctcccaaagaaatgtgactcccagagaaaattttaaaagaaaatcctataagggcttgctttacgaagacattctacacctagaagctcttgatatttaagatgtggtcatctgttagcccttgagtagtatttgggataagctgttcataaggtcgattctgcttctggaaaaagttgctgtaaacaaggctaaataattacagggtacaagggagctgaagcatatttcagcttcttgattcctgcttttggtgggcacacttggctggttcagttatttttaatacctgcttttaaaaaaagtagatggaaacaaaacttcattgagaatatcctttaaattctcaagatcacatcatgtctgtctgcaaggctgtctgatcttggagagatggtttcatccctgggaaattaaacactatgtgctgagcccctggtaaagacaaataggacctcgtggggctgaatttggtctcgtggtctaagattgcctcacttggtcacagtaatggtaaatacaggtagccacgattccagctgtattgtgcgttcttgggagggttggttccatgggttgttatattgataggtacactggcctcctgcgtttgtggctttctagctctatcagtaaaaaaaagacaaaaatgagcatgacctcctaatggatgttcatttacaaatagtctatttgttttgtgtgttgtaaatcacttcaaaaggattgggttagaaagatgatgttgatgttcttctaatgctccagtgacccacttctgtactcccagaaaggggacgtccccttcctcatggaccctgcgctagatgcttgtgaagatctgcagggagacacgatgcggctggagttgacagacctagggaacaaattttcccagatgcccaaagaaaagagaaagcacagaccatttaggatacagatagtggtttagtactgtcaagatgtggtgtgagggaggagagagggtcaggaccttggatttgatcctgtagactggagccagagatgaattttcaccaggagaatgactcactcaggtttgagtgttcaattgctctggagacagaggttggaggaagcaggctagaccagagaccagtgtccctgagagatgatagtggcctaaggtgatttcgatgggattgggatggagaggaagagtagatgggaagttttttttttgtttgttttaggtggaattgtcaaatcccagagactaaacagagttaggaccaaggagaaacatctgtgactattttgaaatgttgaccttcattgaggaaatcgagtgaaaaatttattttggtgggcaaggggaggaatattgggttctaggtctgtggagaaaagggacaaaagggttaggaaaattcttgataggtttattttcccaggtgaaacttgagaaaaatttgattttgttttactcattctaacattctgcgctttcagtgtgactgacgtgaatgaacattacttgaattaagtttgaattaaaacaaagcctattacccacttagtccaccattctcaatattcattgggaatcagcagcagaggccctcagacttcagtgtattcagagttacttggaggtctccttatgaaaagattactcagctctgttcttagaactcctgattctaagtctggggcagcctgagaagttacatttctaaagagttcctggatgatgatgatgctggtccagggaccacactttgagaaccactgctcttcagctttcctgctgtttcctccttgagtgattcacatggaaggaagccaggcgccgccctgcatcctgtagcctgaactttggaatagtgtttgtccacagaggagccagacttgaatttaggactgagtgtccagctttcaaataaacactttttgcctgttgtaggtgttcagtaaatgtgtgtggaggaacaaagcgtaaatgagagtggccttttcagtgtaaaatcacttagctctttgatccccttttacttggttaatcttcactttaagagctatttatatggttaaagaacttactaaacaaaacattcttggagttattttgattatctccaagtttctctttcttacattttcaccagtttgtaggttcagtgaatactcttttcaggccaaagggcttacctttaaaacctcacctaccacacacgttcagcctagtaccttgcaagatgagtcaggcagaggtgaaaaagcccttccctgttcctgtatctttggatacggaaacaggcgtgaacgttg

SEQ ID NO: 91428 - DNA, 3954 bp, Homo sapiens
gcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatgacttgtctttcatcgtggctttctttatattagataccaaaaagcagtccagatgttaaacagctgggaagcccaggcaggtgccttgctgtctttcctgttcccacactggacggctgggggtaggggtggggaaagtggggagacaggcagaggtatttgtgtccaagtctagatctccccgtttgcccttagtggataggaaaatagttttctctgaacatgggatacatctttagttatatttttagtcacttggtctaaactaaaaattataccagaatagggaaaggaataactgaataaatgggttcccgcttaatcacctagtgtctcagaacatggtttccatttagagagggaagaaattcttatgtttcgagatagatagtcaagaatttaaagtaaggcctttccccatctggagttttgtagtacatgtggacactgtcctcatttacgtcatagagtgtctgtagagatgaatttgctgatttcataaactgttgagtccagggagctgatgtgaattgaatatttcaagggaatgccatttaaatgcttttcttctctgatgcctcaattattttcatgtcttgggaaataaatctctgcttgctgcatcttaatgaaaagtggaggtcaggaattatttctatgggaagtgtggcccgtttcacttttttgaattagttgtgatttagaatccaataacgtgtcttggggaattttaccgagtgatgacatctttgtgaggggggccggt

SEQ ID NO: 91429 - DNA, 1073 bp, Homo sapiens
aaaaccaccttgcctaggagtacttctcacacttgtctgtcaggagcatctggcgggcgcttgtgaaatacacaattcctgggccattgcccctagacgttgggtcagatggtctgtgggggtcccaggaatctcttaccaaatgccccagtggttctgatgcctgttaggcttgggaaaccttgcagcaagtgacagggtgacaccagagccccgagtcccaggggctcaaagcaggctcctcggggaggactctgcccttgtcccgccaggccagtctgaggcagaagcagccgttagagggcctgtgctgccagcaccatcttcctggaactgacttgatactgacaccaggtgagccatcttttcagggtgcacggggtcccaaatgctcatctgcaaaggaataaaggggaagccacgcacaaaggaccattttaggaaaccttttattgcaaatgccattctgcatattgatttttgacagaaagtatcagaaatgcttctttcctgggaaaaggaatataaatgacagcaagacacattttagttgctactaaagaacagcattattttcaatcattttaagtcgctcatttaataagcaaggtataaaacagattaaaggtgggagcctgcaaaagggtaattaaaaaagtgtttcctccccgggaaacagcactgtttggtctgatcaaatgccgaagctgggatctgattctgggtgccgtctctcgctactggagtgctgaccagcaggctgcccatcacgaaaagaggttgcaaggccaggcccccaggtgcgctgggatttctggctggctctacttggggccagagaagggggtaaaggccttgtcacagcctgccatgcatgcttcaatctcttccacagtgcggggcacgcaggtcagcagctctatgccgctgtcagtcaccacgacgtcctcctcgatgcggacctgggtcaagccgacagacacacattatcatagagcagcctcatgtgccaggctagagggccgggcccattccaggcccaccccaccatgggatgggagcagctgacactc

SEQ ID NO: 91430 - DNA, 1111 bp, Homo sapiens
tcaagggaagatgtcactagggcccctgtcttgggactaaggagtctgcagctgcagtggaggtggcagatgttctgggagcaagaatggggcccgtgggcactcaccccgccaaaaccgcgaaagcgctgcaggacctcgcggttaaggaaggaggcgcgggccgggtccgccagggcctcatccaggaggtggtcgatgaagtagatgcccggctccacggtgagcaccatgcctggctgcaggtgccgtgcagtgcgcaggctccgcaggccgggctcgtcgatgcgctccacgccctgtggggaacagaggtgaggggcctgatgagcagctccagggctcaccgtggcctcatcaggagagatgggcatgtgagggccggtgccagtctcgtgggctctcttgaccattggggtcctcagcctagactcgcccctgctgtgctgggccatgggcaccctgataagaccttccaccctgcacatacccctggatcttgagtgtccctggccacactaccctagggcttgcttgagaagccctgtggccacccatgtgcacacacccggggcaagctgcccagacaggcctgtggggctggctgagggttgggctgcccttagccaggccccgctgctggccagaggagtggcagatgccaaaccactgaagccaaaaaagctcttaaggcggctgtgaagccccttggggccacagctttccttccaggcagcccaagtagaaactggccccagaagtcgtggtcccagctcccctaggccgaggcccagattttccgtgtgactgtccagggaggacaggtgccgtcatcagggtgggtctgccagccttagtgcgccagtgcaaatgtgccgtgtgcgcgtggcttggcaggtgtggctcccagaggagagctcggggccttacggcagggccctgggaaatagcccccagccttggagaacgcctgagggacagtggtagagccgctccctgcaggggcccctgtctgcgccccacactgccccagtgcacacccagcctggccttgtccactcacaggcacagctgagggggcctcagcttggctgagggcagcgggtgctct

SEQ ID NO: 91431 - DNA, 1033 bp, Homo sapiens
aagcatactcgtgcccactggctcagaggccctggccgccggccggatggtgccccggggacctgaggcgagcaggagctctcctgtaattcccagagcacccgctgccctcagccaagctgaggccccctcagctgtgcctgtgagtggacaaggccaggctgggtgtgcactggggcagtgtggggcgcagacaggggcccctgcagggagcggctctaccactgtccctcaggcgttctccaaggctgggggctatttcccagggccctgccgtaaggccccgagctctcctctgggagccacacctgccaagccacgcgcacacggcacatttgcactggcgcactaaggctggcagacccaccctgatgacggcacctgtcctccctggacagtcacacggaaaatctgggcctcggcctaggggagctgggaccacgacttctggggccagtttctacttgggctgcctggaaggaaagctgtggccccaaggggcttcacagccgccttaagagcttttttggcttcagtggtttggcatctgccactcctctggccagcagcggggcctggctaagggcagcccaaccctcagccagccccacaggcctgtctgggcagcttgccccgggtgtgtgcacatgggtggccacagggcttctcaagcaagccctagggtagtgtggccagggacactcaagatccaggggtatgtgcagggtggaaggtcttatcagggtgcccatggcccagcacagcaggggcgagtctaggctgaggaccccaatggtcaagagagcccacgagactggcaccggccctcacatgcccatctctcctgatgaggccacggtgagccctggagctgctcatcaggcccctcacctctgttccccacagggcgtggagcgcatcgacgagcccggcctgcggagcctgcgcactgcacggcacctgcagccaggcatggtgctcaccgtggagccgggcatctacttcatcgaccacctcctggatgaggccctgg

SEQ ID NO: 91432 - DNA, 1028 bp, Homo sapiens
gatggggagctgggctctgaggaggatccctgctctgtgtggggggtgggggcaggtctgggcatctccacccctgccacccttaggctgctgccgtggctggggcgctgtgctgtgaatggcgggcaacagccatactgcctgcccaaagccgtgcacccccagcccgcctgagaccccagcaccacagtggccaactctggcacttaaaggggtcccaacatgaaggacttgtgcccagtgtgtcgggggtgatggcctgtgtcccagtgtggactctcatccctgttcgccagccgagcccatcatctgccctccgccagccacagaggttcagaaccctgcttctcacagcccagccctcgccagctcagggtctccccggcccctcccacagcagtgatcgggaccatgcagagcaggctctggctctgcgccaaggcaagcctggcagggaggccctcgggagccaaggtcactccgcctggtggggctggacctctccaggaggtgccgcagggacttgctgggcgccctctccagccagtgagctgcacattgataggggccccccgccacgtgcctggccagagtgtcctggggccccggcctctgccagcacgtggcctgcccaaacccagcccccatggggccagggcaggaggcctcaccggcctcgagtccttatctggtgctcaagccaagtccagcagtggaagctaccatgaggagaggctgatgctgggattccacagagtccggggatgggacgggcgcacccgtgggctgctgaggctctacgtggagagctctctaagggcctccttcctagcggccatgctccagagccccacagagcctgtgtggcccccaaagctctgtgcttaggaagttctctctttggtggcctttgccccacaaacatgcggcagagatgagttggatttgaagccgggagttggacatctggctcccctggagatggtgcccctgctgttggcaggcggggccccgaacccctgccagcc

SEQ ID NO: 91433 - DNA, 1011 bp, Homo sapiens
attttccacctctgtgaatttgtggcagccccaaatgaccgaattggctggagactgttctgttgcttataaccaaagatgcagaacctgcgtgccttggggggccagctgtgcctgggccggtgtgggcagggaaagcccctctgcgctgcaggctggaccctggcagctgccgaacagatctcagtcagagtcgtgggagccatgtgcctgtagagggccaggcctaggggttggccagcacatggtgatcccataggaacctgcccaggctctggtgaatccaaggattacggcaggggtgctgtgttgaagccctggaaggcttgaagcaagaacatgagaagaccacatccctcaattctctcctctgggcaaaggtgacaagccaggacctcccatcactgctgggaaatggtttctattgttgcagggcagagagctggggttcgatcctgtgggtgctagactccacccctgccagggctatggaggacccaggggtcactcggcaggaggctggctgagcgggatggggacagcgggaggtgcccagggggaactcctgaaagctggccttgttgggaggatgctggctcccctccaggggacctcctctgcctgccctgacagacatcaacggcgcgcggtgggaggtcaagaggtaccagtggggcctgtgcaggctgcctggggttgggagggctgagggcaggacaggttggcctacgctggccgctgggagagagaaacaccaggcccatcctggcctcaacatggccatcatggtggtgactgtgacccctgcagggcactaccacaggccaggcggccttgcaggtgctttacacagcttaactcagtctccatgagtcggctgcttccccatttacagatgtggaaacggccacccagaggagggctttccatccaaggtcacagagcgctgagcggcacgtgaacctgctctgaccccatgccagtgtccagagtgggttgagccctccctgg

SEQ ID NO: 91434 - DNA, 1101 bp, Homo sapiens
cagggaaggaggggaagagggcactggtggctgctgagtgtgagggctgggacaggtctctcctcctagccaggctggccacccaccccccatgcccaggagcaacacaaaagaccaggcccagcaggggtgaggcctggcccatcgtcctgagacaacactgccctcttctggccagttctggaaggacaggcttgctgcccaccagctgcatcccgactgggacaaccaaggcctggggcatcctgggacacgtgctctagaaactctgcgaggggccacagtagattaaggcccccctccaacccccaccacctgatcgggaagtgagggaggcaggaggagtgtcccagctgctttcccaaccagagccctccacctctgccctgtggggtgagcctctccaggacctggggcggcctcaggcccggagtgctgcaagggatggtccctctctgggcgcactgcttcccagaatcgtggaccatgcgccccctgccctagctgcgaagcttgctggcctgcagtggctctggtgcccacagcccaggctgtttgtggaaggagggggcagcacatgggggctcagaagacgaccaggagaagcagggggatgagtcctggccacctctgtgctcacacaaacctgttcggggctggagtgagtggggaggggtcttctggggcctcccacttaggaatggcctccagtgatctcaggcacctcaatctgtgtgaacatgttgaaagtgttaattagcaagtgtgctgcgcttttgtaaccctgttcttgaaggtctgcctgaggggtttaaaaaggaaaacaaaaaaagcagcgaatggcccctctggtacagtgacttggagatggggttcatggcgaaccccaggatcacagcgggaaaagactctgagaacaacagcaaaacccccggaggcttgacggctacaggccccacatggggccgcttggctctgaaccaggctgagggtgtatgcagccaccacaaagtcccgtccctcacccctgcgtgcatgcgagtgggtgtggtggcatcacacccagagaagcgggaaggggcccgggggtggctggctggg

SEQ ID NO: 91435 - DNA, 1002 bp, Homo sapiens
aaggtatgaaactaaagcatgagcccagcgtagaattcccccgaagccgagcgcctcccagagcagtgcgcctgctgcaatggcctgctctgggttttagtcctttgactgggggaagacaccccagagatattttagcttctaggaatgggattttgtggggaatcagagctggtccagggcagccagattatacagctgtactgcagaagggtggggggtactaagaggaggccagccttttccatccctctctccacagtcccagatatgagcactcccccaacacgcacacacatggatacacacacagggaactgaccgaggctgtgctgcgttgcaatgatcacagtgtaagcccctgcctccctctctcgcagtggccacctggcacagcgtgggccctcttcgggcaagagcagcaggcccggtgtcctcaccgagctgggcaggccaggccctgatgcccacttccagcagctggttctgcagcacaggctggaggtgggagccacaggcagagctcaggccaggcctggtttattctcagacagctcccgtcccctggttgtcctgttccgtgtcttcgacccaaaagtgtcctccatgatgcgtacatcaagcggggtttggggctggctaggcccccctcctactgctccgtccttacccttccagcagcttccctggagctaggctgagtccactgttggccacagtcatggtccaagagggcctatgaaccagacaccctggttcctgcttcaggtcaggcttgtcagccaaggactgagacagacttcctgagggccgtccctcacccccagccagccacccccgggccccttcccgcttctctgggtgtgatgccaccacacccactcgcatgcacgcaggggtgagggacgggactttgtggtggctgcatacaccctcagcctggttcagagccaagcggccccatgtggggcctgtagccgtcaagcctccgggggttttgct

SEQ ID NO: 91436 - DNA, 1071 bp, Homo sapiens
gactgtggccaacagtggactcagcctagctccagggaagctgctggaagggtaaggacggagcagtaggaggggggcctagccagccccaaaccccgcttgatgtacgcatcatggaggacacttttgggtcgaagacacggaacaggacaaccaggggacgggagctgtctgagaataaaccaggcctggcctgagctctgcctgtggctcccacctccagcctgtgctgcagaaccagctgctggaagtgggcatcagggcctggcctgcccagctcggtgaggacaccgggcctgctgctcttgcccgaagagggcccacgctgtgccaggtggccactgcgagagagggaggcaggggcttacactgtgatcattgcaacgcagcacagcctcggtcagttccctgtgtgtgtatccatgtgtgtgcgtgttgggggagtgctcatatctgggactgtggagagagggatggaaaaggctggcctcctcttagtaccccccacccttctgcagtacagctgtataatctggctgccctggaccagctctgattccccacaaaatcccattcctagaagctaaaatatctctggggtgtcttcccccagtcaaaggactaaaacccagagcaggccattgcagcaggcgcactgctctgggaggcgctcggcttcgggggaattctacgctgggctcatgctttagtttcataccttaggatgaagcatcgtggctttcatgttgggataacagactgatttattatttaccgaacgcagtaggcgctcggcagatcaatttcaatacaacaatggactataaatgccaccagcaatctggcagtagcagtaatcaacaaaacatgttgttctaaatgctgcataataaattgactacaataaactcataattactctactggctacatttcaaagttagcactagaaaaatcaaatcaccaatttggacttggcattaacatcctcggatcactcctgcctctacagctgcagctgggagatgcaggtgccatgtgctgtcccggagggccgaggccacagcatct

SEQ ID NO: 91437 - DNA, 1036 bp, Homo sapiens
tgcctcagcctcccgagtagctgggactacaggtgtgtgccaccacgcccggctaattttttttttttattttatttttagtagagatgggttttcactgtgttagccaggatggtcttgatctcctgacctcatgatctacccgcctcagcctcccaaagtgctgagattataggcgtgagccaccgcgcccaggcttttttttttttgagacagagtctcactctgtcacccagcctgaagtgcaatggagcaatctcagctcactgcaacctccgcctcccgggttcaagcaattcttctgcctcagcctcccaagtagctgggattacaggtgccccccaccctccaccatgcccggctaatttttcatatttttagtagagatggggtttcaccatgttggtcaggctggtctcgaactcctgacctcaggtaatccacccacctcggcctcctaaagtgctgggattacaggcatgagccactgtgccaggcccagggactattattaagccccttttacaggtgaggaacaaagaggctcagtaacctgtccaagatcacaccacaagctagtgggggaggccaactttgaaccctgatctttggccccagggcctgtgctccacttttccatggtgatctctgccccacagaaggagacctgcttcttccaacccggtagttactgtctcagtgcagggcactggaaaggcacagttgtcttgcagagaagttctagttttaaaatacccataaaaaggacaaatacctattgcattatgaattatgatgacaaatgacatgttaccagagtcaggccagctctagtgaggaagaagtttctgcctgatgaagtggaaagagactgcctgggaaggggctcagatcccccagccacctctgggtcaaggtcggcctcagccaggaagccaggggccattgctgcagccccaacactgttttctctgtggcagagtcaggcatacagcaggcgctcataaatgctcctgagtgaagggaaggaacaggg

SEQ ID NO: 91438 - DNA, 1451 bp, Homo sapiens
gagtggtgattgctgacctccatgtctgcacctggggatagaactcttcccatgtcacaaccttcagaagcagcacggtggcacaggtggccctcctgggcatcccagctagggcgaagtgcaccatagctacttctccagcccaaggtgaccgcagttcattgctggagggccctggcggtctagtcccccacacagccaatgtctgggtggctggttgagtcggagcctggctgggctttgctggtgctgttttactttcttactgtccatcccagcaagataagaggggctagatgcccttcgtggggcctgctgatggctgtggagactggcgcatagactggacagtgggaggcacatcggaaagccgtggtcctgggaccctatcagcagaggtggcagaaaggcctcaccaccctcggtgcggggtcctgatgcccgctgggccctcccctctgggtggtgagcagccgtggctgagagcatgctgcttttgcaaaaggggtcccagcttcaaggctggggaccgaagttcctcctggatgcactgtgcaaacaggggacccctcacttctgctaggccagcatgtgactgtggggctctcggccaccctgtgctgagaggtcgcagaggcttggggatggcatgggcacctggtgctggttgaagctgggcaagtgtcatgatcccacgggtgaaaagactccagagagtgtccacgtgcccgggtgggtctaggtcttagcagccaggatgacccgtccggtgaggatgcagccagtgcgtctctccccagtgttggctgattcataataggctttaagcagtccatatattttcagcatgagctggagtctttgaatcatttatcttggcagctcttcttaaagctggagaaaggtagaaattcatctaggtgctgagaaaggagcccagaagaaaaaagtgtctggcggctgccgtgatgggtggcgtgcctggagatagtgctggtggctccgagatcaaacagatgagaaatggcttcccaggaagaactcggggaattctaagtaggtaatgagtagtgactgtcttttgatttacggcaagacttggcaatcaatctgtaatgctttgaagaggaaagaaatgaatcccgaacaggctgcggggtccaggtggtttggacaggcggcccttccttggtggtgggggcaggggcaggcaggctagaggtcgtggatttctctcttctgccacggggaataattcaggccgctcctggtgggcagcaggctgtggccagagctggcttgggggaagggactcatcacacctgtctgatgtcctctgaggtcctggctttgagcctggtgggactcgagttcagagctcaggtcatgggcagtgcaggccctggtggttcacacactcactggtggatctggggtcctttcttccaccc

SEQ ID NO: 91439 - DNA, 1043 bp, Homo sapiens
agtcccagcactttgggagtccaaggcaggaggattgcttgaggccaggagttcaagaccagcctgggcaacataggagacctctgcctctacaaaaaaaaaaaaaaaatgtttttaattagctgagtgtggtgacgcacccctatagtcccagctacttggaaggctgaggcaggaggattgcttgagcccaggaagccaaggcggcagttagctatgatcacaccactgcactcccatctgggcgacagagtgagactccatctcttaaaaaaaaaaagagaaaaaaaagccaaaaacctgatgctgactgttgatttcagataaatatttatcacgagtttaaggaagtagcattgtcttcctggcttactagattttatcaggaaaggatgtcgaattttatcagctgccttttcagcatctcccttggccttttccacgtgtgtgtttaatcagtaaactttttattttaggatagttttggattacggaaaagtcacaggaacattagagagttccatgtacctggcacccattttccctattatgtattagtaaagttattaacattactttagaacatttgttaccatggatgcacgttattgatacttaattattatcttaagtccatgctttattccagcggccttagcttttacctaatgccctcctcctgttccaggatcccatctgggagaccatatcacgttccattgtcacatctccttagcctcctctgggctgtgacagtttcttagaattgccttggttttgatgaccttgacactttcgaggagtatggctaggtactttgaagaatgcctttcaattttagtttttctttcagcgagacaggagttatgagttactgggaaggagagcacagaagtgccattgtcatcacatcacatcagcatgacttatcactgatgatgttgaccttgatcacctggctaaggtagtgcttgtcaggtttctccactgtaaagtcactcccctacccactcttctgtactcttggaaagcagtcactgtgt

SEQ ID NO: 91440 - DNA, 1112 bp, Homo sapiens
agttgacccacaatcagtgatgctaagactgatcactgggttacattttcccccttgacctggagagtaatctacctggtgttactttggtaccatgtgaataaatgcagccttcatacatatatctgttttgttttgttgttcctagagttttaatttgcctttcgtctttcttattgagagaagaaacatatcttcttcaccatatcactaagagctttaagcttcctattgattttatctgcagaaaggaatccatgccattctttttgtggatgtttttctcagagccacatacttggagttctaatttctactgattgctttctaggcttgctgtccagtgtctaattatacttttggattgactccagtttttaaaaatatcccattatatcacctccttctctttattggcttgtgctttctccctctccccacccttctacccttctctctctgctggagtacatccttaagtacttccccaatttctgagtttttgaatgtctaaaaaggactagtttccttctgtatttggttagtagtttgtctgggtgtagggttctataatttttgcatggagtgcaacaaaaagggggtgagtgtaacagagtgggtcatgcgctctttgacattgtctcagttaagtctcagtgtcgctatctgtaaaatgggaaggtagtacctgttctaggttgggttccatgggaagctgagtctgtgagccaagtaggcaggaagcgtattgaggagtgctctcaggatcagcgtgtgtgtcagagtaagggagcaggcttgggctgcgatgctgtcacaagggcatctcagctgctcccatggggagttttggtgctggagtggcccccagagatgtccccagctgaagcgagggagctgagtcttggctccctccatcgaatcaaggagaccagtagaggggtgtggcctcaggggatgagttgggcagtgcacccagcatccactgcaacttacaggacccaccatgcggcgggtccccagtaaatggcaatttaaagtgaagggaagctgcgtttgcctgctgagatttctctagctttgtgggcctgtcatgaatactggggagtaat

SEQ ID NO: 91441 - DNA, 1069 bp, Homo sapiens
cacccctcacccacagcccccgggagagcctggagagggcgggagagccctgcccactggatgtgcttgggtccctggactggctggtgactggccctgggggtctgtggcctgcattgctggctgatgccatagcagacaaggcccctgcgctcgaggctgctgcacgtggacagtgggcagctcccagccccaactttgggacctggatccccagcccctcccctatcatgcatcccctacagcccccatgtcttctgttgtcctctggtggaccaaggcagtgatggaggaaccgccttataattatgtatgagcccaagctgctggaatctctgtgtgtgatgtaggggtgatgagggattatgagctcatgaatatgtatcacctcccacctccccctatgctaagagcagtggggcgggtggaggggcgggtagtaggtttgctttttcactgcacagatcttcgtgtcctcctgggagtttccccaaagcggccccgcctcccacgcctggcagcaattagcccagcttgttgaaatgctggccatggagctgctctctctccccaggcccccaggccctcagaggggctacgggcacagccagctgctgcctgtcccagtcccgggactccctgaatccccccagcactacctggtgctgggtctccagtgtcctgcacacctttcctcgaccatgccatggaacctctctatggcctctgtttgggtctctgcagcagggggaccctcagctcctccacgtgtaacctggtgctgcctgggcttgtggtgggcactggaggagatcatgctcacctggagcctggcacagagctggtgctcagtgacagttgcccgcatgcaaaccccagcaaatcccattgctcctctgtgcctcagtctccccatctgcgtggtgggccaggtgggctccaggatcaccaattcccagtttcccagatgtcagtgagtcgagggccttctcagcggtgagagctttgcttgctcctcctctagagagaatgctgagcccccctggaccacgtctggcagctgtgtggt

SEQ ID NO: 91442 - DNA, 1029 bp, Homo sapiens
actgatggctgagatgcccctctgtagggcgctggcctcaaaatcagatcctttgtacttccccactctgccgtgaggttgccttccactcctgtcacagctggaggcaatgaagggagggggctagaggcagagctgggaacaactgagggacgcagggtgtttgttatggagccagaaagtccgagttgatgtgttgatcccagccacgcatttcgctgatggccctgccttttgtatttctgacacctgcttttgtgccgggctgtggggtcaactcggtgctgagagtgtggttgctcagtagcaaagggtctgtaggcttcccttgagccagctgcacaataagccctgcgtctggggcctccgaagtccaggcgaggcgctcgtcatcaattcgtgccccataactgctcgaggccgtgctaatggaggtgtcagaccttggccatttaacttttgagtcctgtctcaaatgcacaagtgaatgtgactgaatcatgcaaatttaattaacagcaggagcttgataccccgtgatcatttcagagaagccaaaagggagagaaagcaaagggcattgtgggctgcactgagcagtccattgattacggtgagaccagcgtctcccgggccctcagtgctccttgttgttgctccctgcagccgtccctgggccctgtggccagtacttcctggtttgggtggggagggaagtggtggaggactcagagagaggagcagattctgtttcctgcaggtgatgctggtccttagtgtcacaaaggctgagaatggcacataggacaccagttcaggagctcactcgtgaagttcatcacctccaagtcccaaggttctctccctccaccgtgttccgtggggttctccaggcacattatccttggcacccacaacacccccccccgccccccagttatccgtagagggtcttgactgcaagttgtccaggttgttgccattttgaacaaagaattggacaaaacacacaaaggaaagaatgaagca

SEQ ID NO: 91443 - DNA, 1058 bp, Homo sapiens
agcctaggcgacaaagcgagactgtctcaaaataaatttttttttttaaattgaggttggtgcctggatgtagatatggcatcagtgtcctgcaacctcagaaagttggctgggcatgagcaatctgcatggtgacagcgtggtgacagtaggctgtttggtgctgtctttggcgccatattcagggctcatctgactccagagcggctgtgttccctccagaggaaacccacggacccagacaacccggggacagagctgcattagctcaggtgccagaggatgcggcagacgccatctcatttcttatcagctggaggatgtgtgaccctgtggtcagtaaatcagcatggcagatcgtgaggcttacaaattggtcatggaaaaaagttgtgacttttaccctgtacaaaactacctgtcatttgtgatgtggtgttctagcctgcactggctggattcattcccggacccttagaaactcagcaatgcagcctgggccaccgagagactggggaagcctccgtgcaggtgggttgacaccaagaagcagccctggccccattgccaaagccaccttttaggaagtcagagagtatctgtgcaataatttggatgtttgtcccctgtgaatcttaccttgaaatgtgatccccagtgttagaggtggggcctggtgggaggtaggtcatgggggtggcccctttatgaatagattaatgctattgtgaggcagggagtgagttcttgctctattagttcccacaagagctggttgttaaaaagagcctagcacctaccccctacctctgtgatctcggcacacaccggctcctcttctccttccattttaagtggaagggcacgaggccctcaccagatgcaaatgcaggtgccatgcttcttgtacaggctgcagaattgtgagccaaataagccgctttttttttccttttttttttttttttctttttagagacagagtctcgctctattgcccaggctggagtacagtggtgctatcataactcactgcagccttgaacttccaggctcaa

SEQ ID NO: 91444 - DNA, 1015 bp, Homo sapiens
aatgattctcagtcccacactcctggtgccaggcctgttgtcactgtccctcgccctgcccctgcatgtttatggagcaggtattaggtgtcttgcactgtaccaggccctgtggacatgaggtgagcaaagctaagggtggtccctgcccttgtgagttagatggagaccctcctcatttattcctcattcactaattcattttctgccagacaaagacattaataaaaaaaatgactaatgtgtgattctaggctgtgataaggatataaagaatataaggaaataaacactcaggtactatgagacctaccaaagagcaatctgacctgcactgagaggttaggaggacttctcggaggaggtggcccttcagctgcggtctgaaggaggagtgggaactaagcagggttggtggggagtgtgggaggaaaggatggggagagagaatccagcatgccaggcaggcacaggcaagagcatgcaaagggcttcctgtggagggaatgtgtgagagggcatgaggagcaccatctgggagctgtgggaaggcccatgtcgccagcagagtgaagaagcaggtgacatgtggctggagacccatctgtgcagggtcttcacaaccagggagggacttgggactttatcctatgaactgctgcagagtaggaagaccagcgaggctggagctgcaggaatcttgcagaaagaccactgtggccttaaataggagtgaatgggcttcccctcagacattggtctggtccatcaggctctgtctcctggagccggggtggttgagcctaatgtgcaatggagtctgtctacactggttgaaaccagtgtgtgatgtaggcagtgcatctacgctggttgaaactagtgggcggtgtaggcggtgcgtctacgctggttgagctagtgcacaaagcaggcactgtaacactggttgagcccctagttcatgatgcaggccatctgtttatactggtggatctcagcacaccattcacgc

SEQ ID NO: 91445 - DNA, 1052 bp, Homo sapiens
cagcctctctctggcttgctgaggccagagctcttggttctttctgacaccttccctttttcctatgtgattctttctcccgggaatattcctccttacacctcctatagacatctgggtctgatttgattctgacttccaaagactcagctttcgtgtgtctgtttgaatctccttggcagaggctgacatgggctgggagtggcactgggatcgcacgtggatttcccctccctgttgctgtgcctggggctgggcctgtgctggtgcagaggctacctgctgtcagtggtcatcactaccttgccatccctcgcgacagccactcacacgcctctttctcacaaaagtcatttagcgaggattaccaccttggtgtgcgtggtaaattgcatttctcctggttggggccatcttgctgtttcctgcttagatttggggcctcatgaggtttggcctcatctgcaaatttaatttcatgaccattcatccctgtgaaagcacaatctatgcctattatttcactcttcttgattccctcttccacgagttaatgtgtcagcgcacagccatggcaaccactccccgccctccctccaccccaggcagccacctctaggttgcggctgaagctgggacctggagtcagaccacctgggttcaatcctagccttaccactcggtcactgtgtgggctagggacccagtttcctcatccacaaaacggggttaacaagagaatccacctcctagagctgttgtgcctaagagtccacaatcagtggcagctgctactgctattattactattattattactactcccgttttatcttgggtgtcaggaagcatattggtcaagggccttgcctggtgatgtgacagaggcttagggggcaggcagccccactggccagtgtcccctcaagttctgctttttcttttcttgtctctctctctctctttttttttttttttttccagacagggtctccctctgtcacccaggctggagtgcagtggtgcgatctcagctcacagcaacctccatc

SEQ ID NO: 91446 - DNA, 1020 bp, Homo sapiens
ttttgttttggtattttttgtagagacagggtttccccatgttgtccaggctggtctcgaactcctgggcttaagcgatcctcccgccttggcctcccaaagtcctgggattacaggcatgagccaccactcccgactccattgctggactgttttctaaaggggtcgtactgatgtttccacctcctcaccagtatatgcatgagtgttccgtacgtaactctcccactccacgtcctgtccaatacttggcattgtgagtttttcccattttagccattctatgagtatgccgaggtatcacaccgtggttttaattttatttctcagatgacgaatgcagttcatttttttaccaaggatattttggacctggaaacattattcaacaaatttgaaaatttcctttcgtccccaaattgtagaactcacttccatccccacattgtggaaacgtctggcagtgcttctgatttcttctgggcgggtttgaatctcccaggctggaagccaagggatggagtagacaagagtttctctggatgagtctggggaactggccacctgccccagaatcacgtgggttgctggtcagagatgcaggtgctgagccctggcccagccccggactcatcagacagcccttgacccattggtccttctagggctgttttttttttttcttgtcacgaaaccaaaaaaaaaaaaaaaaaaaaaaaagcatggatgctgccctttctgtcatgtccacggctgtgtcacaatgcccagaatagtcctgcacagggcagacctgctgggttgaagggtttcccattgttgtctccatcctctcccaccccagctgacttggcggggactcgttagtcaactgggctgccgtggtgagggctctggaagttggtttctcgctcgctggggggtgtcccatgtctgaatgacctcctccttctccaaagccaacttccaacagagctgcagccgtgcccccagcagccttgctcacccccagtcctctag

SEQ ID NO: 91447 - DNA, 1062 bp, Homo sapiens
ccactgatgggcacttaggttgatttcacatcttgactattgtgactagtgccgcaataaacgtgggagtgtagatatctttgtaatacgctggtttcctttcttttggatatatacccaggagtggatcatatggtagttctatttttagtttttttgtggaatctccatactgttcttcatagtggctgtactaatttacatccccaccaacagtgtacaagagttcccctttctccatatccttactagcatctgttatgccagacagactatttataagtgaattatatttgtagtttaggccagaggtcagcagactttttcgtaaacgaccatggagtaaatattctaggcttcatggacaaaaaggtcactgtggaagtcactcaattgccatcataatgtgaaggcacccacagatgatacagaacaggcgtggctgtgttccaataaaactttatttccaggaacaggtggctggagggtgtggtccatgggccacagtttgccgaacactggtttaatggattgcaagacacagatgggtatggaaatggaggaagatggcaaatggaaatgtgttggacatttaatcagaactagcatgtcgaaaggattgtttgagtatcttcaaaactgaaaaaaaaaaaaagcttttctcaagtgcaatcctgtagcctcttcctgctggaccagggtgaggctggggccgcagaacccaggagcagtgtcccccaaggaacacttcctctgtgactcctgatgggtagagggtggaggggatgggcaggccttcctcaagcctgagtttgcacatggttcacactcagtgggcatccgggaaagtgatcagggccccagtggcccacccagctctgggcaggcagcagacaaggtcagactggggtggacaaatgacaaaatgacatcctcaggtttgggaggggacaagtggtgtctctgcagctggaggccgaaaggcaggcctctggctccgggacggggtgtcggaaacggctgtgccccacacagctttctcgtggatcatgtctgtgcagg

SEQ ID NO: 91448 - DNA, 1034 bp, Homo sapiens
ttccagtctccaggattgccaggccctgaggccagagcttctgctttcaggaaattcactttttgacccagtagacaagacttacctcttctccaagagaaagacttggagaccaggccagaaccaggaataacaaacaccaatggccaggtgtggtggcacgtgcctgtaatctcagtactttgggaggcctgggtgggagaatcacttgagcctaggagttctagaccagcctgggcaacatagcaagaccctgtctctacaaaaaaaaataaataaaattagctgagtgtagcggtacacacctgtagtctcagcaacttaggaagctgaggtgggaggatcctttcagcccaggaggtcgagactgcagtgagctgattgtgccactgcgctccagcctgggtgacagggccggactttgtctcaaacaacaaaaaattcccaatgtactggctctgggggctgcagaaggctgactccacatttggtcgagcaaactgaattttacgagctgctttctttgtgaatgttttatcatagcgaatttggaacacatgcagtagtggagtaggatagtgccatgaacaccacataccgggcacccagcaccccccaccaacaccaggctggccccatccatagcaccatccacttccctcctttcatgtgatttttgaagtctataccagacatcctatcaattcagctataactatttcttttttctttctttctttttttttttttttgagatggagtttcgttcttgttgcccaggctggagtgcaatggtgcgatctcagcccaccgcaaactccacctcctgagttcaagcaattctccggcctcagcctctcgagtagctgggattacaggcatgcaccaccacccctggctaattttgtatttttagtagagacagggtttctccatgtcggtcaggctgatctcgaatccccaacctcaggtgatctgcccacctcggcctcccaaagtgctgggattacaggtgagagccaccgtgcccagcc

SEQ ID NO: 91449 - DNA, 1005 bp, Homo sapiens
aaactcccccgccctccttctgaaacccacttaccatgtaaagttacacggttttaacttgactctgcatccatttccacctgcagagaaagaggaaaatgaaagttctgggagatttagaatctcattgtaactgttaatttcagccaggatggaatccctttcctatccttgtcccagccatgactattatcatcctccgttgacctctctcccccctcctccacaagatgaagtgttaacaagcagaggaaaattagctccactcccccagcacaacatcccctgccctgcagaagtcgtggaagccataagccatccctccctgccttcctcccccttcatcagggctgagtggccagttgtcttcctcccctgaggatttcatcatcctcagatatcccagagagtgtttgcagttgttcatcctaaattacactgttgttttagcctgttgtgtgctcagagctgattaataaacagaaattaagtcacttatttactttttgcttcaaatcacagtgtgcgactcgagtggttgatatctcactgatatttgtgaatgcgtggatgagtgactggatctgcttgtgtgttgaatggaattcaaggttccttccatcagtcccaaaacatcattcctaagagctcacatgtgcctgtctgtttttttacaaaaacaccttttgtctcttctaatagtccctgaatgcttaggtaagagtggagaatgagagctctcttctctgacatccaggctctgggcatctctcaaaaagagatggtcaaagaatctgatgaggtctgctgaaaaggaagggtgccatagagaaccagaccagcccccatcctggtgagcggtgcctcctcacacaaaaagctaatggtttgggttggtgtggtcagaggagagcagctctcagagacagaggtgaggatggaggccctttcattttcctggtgagtctttccatactactttttaaaagaaagtcggtactttaa

SEQ ID NO: 91450 - DNA, 1102 bp, Homo sapiens
ttgctcacagctgcacccgtccttagagatctgacctcagctgataggatactcctcttctggaaggcgacaccttccccctggagttggcctgcaacccattcacatgctggtaaaccccttctccagggaggaagagaatagagccctgatttgtagcacttgccaatatctatggtgtaaatactcccactgcatccagctctaagctaccatgtaaaaataaacaatacgttgcttaggggatatagacatatgccacacacacatacacacacacacacatacacactactaagaagagaaaggaatgataaacacagaattctgtgaagtgattaccccggcaggagcaggagagggctgtccaagaggggcaaagagggagcgtcaatgatattgatagaattctgtttctgaaactgggtggtgaatacctggctgtttgttttcttcgtctttatagtgttatatattttcttttgcatgaatgaaatgtttcatgacaaaaaacaagtctaaggaaggcttttaagctttgagatttttttttaactgacacacaaggggggttcctagctctttgtggaggccgaggaggtggctcagcgggtctcctggctcccctgcacttgcccgctgggtatgatgacaaagtccacacttctaatgagttctggtggagaaggaacatggcctggggaaggagattttcctttccctcaggacaggcaggaagaggaggtggatgaggggctgtccacagagctgtcccgtccagtgctccctcctgccaaggacccaggggaatgccgcctgccactcacccaaagccaggctgttcgcactgtctgatccacggcatctagggccttaatcaatagtcatgtagctatgccccaggcactcgccaggcccaggcactcagcttccactggatggcggtgagctcagggaccctccacatcccccattatcatctccactctccaagggcagaagtgcaggacctaatgggtccgaacctgaccaagtccccacacctggtgagaagtggagacacagcttctgccaggacagatggggcctgcagcccatgctc

SEQ ID NO: 91451 - DNA, 1091 bp, Homo sapiens
ccaagtgacttgccctcatccatgtgcctggacttctgctgaacggcttccctgtgtctggccagatgcaagctgtatcttatcaccatggggatggtattaagagaggtcctaggttccctggcccatggagggtgaggggtgctttctgagccttggtccacaaggctgttgcaagaggagacacgcttggtaacatggcttgaaaggaaaataccaggaaaatctggtttgttctgaaatattttggggcaataatggtgagcatatgtttcagtgctgtcattagccgaattagcagacatggagctgcccagaaaacacatgtgtgagtgtgactgtgtgtgtgtgcatgtatgtgtgtgtcatctgctacagcctggaggcctgctttggggtgtggagacagatagagagatagtggcggtggagtcaatcagggagggctgcatggacctcgcagggtctcagagagcatgcagaaaggacaattctaagtgtctttgaccccatggtacatgactaggaggaataagccttctctggttttgtcgatgcctcccgcagatactctgggcagggatggaagcctagatgcctcaccgcaaggagcggccgagcgggtcctcgcttcacacacacggcagcaccggcaccgcggtgagcctgcagggtgggctgggtccctgccgggagttccctctttcccttcttccccagtgcctgtttactggctgtccttccttgggaccatgacactccaggtggctgttgactggctgtaggattatgtatttttgaaacaaaaatgctcttaatttgatgtgaaatttactacatgtataaaactcaacgccttaggtgctgaggaagtcactaatttagaggtgtctcgttactgagacaaacttgcaaaaaacccctgaatcccaattcacaaattggtgattcgtttgtcaggggatatttcacatctaacacataagcccacgacctttaattagaattttgcagtttgttttatgcccctggaggctgacaccttgaaaaattttttttcttgatttcttattgctaataagcatctttct

SEQ ID NO: 91452 - DNA, 1031 bp, Homo sapiens
accaagcccttggctactcccacccctctttagggttcctagttatccctagctcgacctggggtctgccagggcagttgccaaaccagagctggccaccctgggcactggggaggtggtatcagccctggctctgaggcctggctccttctccccggagtggacagggacaggcatcaggggctccccaagacccttctcctggtcttgcatttgttagaaccattgcccttcagaggacagggtaccggcacctgccttctctccagtccccatccgccaccactaggtgtggtgtgcatacgctctggcatgtgtgcacatatgtatgcactgtggtgcatgtgtgtgcatggtttctgtgtgcgtgtgtgtatgcctgtgttgtggcatgtgtgcaagggccctgttgcatgtgtgtgctgtggcacacttgccatccctcctgtctgcctctgtttctccctgtgggctccctgagtgagcggcagtaggggatttgtgccgtcatgtctctgggtgcctggtgttgacaggtgtgtgtcctttcctggatgtgtctggatctgcatgatatgtgtgtgttgggaaggaagggaccatgtgaccctgtgcctgttgcacaggcctgtgtgtctcacactcgtttacatgggttgggtggggaggatgtatgtcctggctcgtttactgggtgtgtggctgttggccggggtgttggatggttcatgtgcattttctgggtgggtctatctggcaagggtgtgtgcaccaggcctgtgaccagctggtttgtgtgtagggggtaaggtgcctgtgtcttgctatacctttccaggcctgtaacataacgtgtgttggcaggctggtgtgtacagctgggtgtgtccctctctggctgtgacttgcgggtgtaggcaggatgtgtggtgtgtcctgttaactgtagcctggctgccccaggtgtgtgcagatgttgtcaggcctggaacagttccagagtcacccatgtcaggtccctcgcccctcca

SEQ ID NO: 91453 - DNA, 1067 bp, Homo sapiens
ctccggcccgcggcctcctcgttccctcccctccctccgtcgagctccgggaggcctctcgcctcccttctccgggccccggcgtcgcgggccggaccgcggcctccccgcggctccctggtttccgccccccggaatgtccgcgcctgaagcccggggaactacgggactgagtgcgcggcgggcggccctgaagtccgagaacgggccggagaacacggagaaacgcgtcttccaactccgaaattcggggcttctgccgtcttagcacaaaacaaagccggagtattcaaagaatttttccgcccagcttgagttcatcgcggatgcgttgactacacagcacccattttctcactttgttcatttcaattcgtggcgatcttcctctggtgaactcttgagtaatgtgctaaaactttgggtttgctctgcgacgcagacattctcgaaatgccatcgatgccgtggagcagatcccatctccctcggctcatcctctgttggtatttacctgttaaaccggaatcctcaaagcctgttgtgcaaccacctcattagggcgcgtggtaaaaatgcttgctgctgccccgacgcccctgtttctggaaacgggttcaagcttgatccaggatccttcttgaccaggcaagcttgacctttgatccaggctcagtgggcgttgactgatccctctggaggctctctgggaaagggaattcggccgagaaggaaggtgcccctacccacagtgttaatatttggcatccctagagtctgtgtgggttttgtttccgttcacacgtgcagggcctttgctccgccaggaaaccagaaagaaaataaactttagctcctgaatcttaaaggaaatctcacaacagtgtaaaatactttgagggaagctagataacctaggtgattttcccagcacttctggtagaggtgggaactgcatagcatggttagggaccctgtggataggttaggtccaaggataaagaagaagattttcgaaatctgtaaaattttaaaaatcgttaacagataggggagtggtttcacgg

SEQ ID NO: 91454 - DNA, 1057 bp, Homo sapiens
tatgctatctgtttttcttgtgaatgtcgaagcagttgtttcagaaaatttcttctattttctgtgataaatactaatactgaatgtatttcatctaccttttgaagactgtgtcctatcagggcaaactgctggtaatggaaaaaaaaacaaaataagtaaatgaagaccgtgtcctctttgattcttctcttcttctttactgccttttttctttattttgatacacctttttctttccttccatcattgcctccctcctttccctcttttcttcccttctttccatctttcctgtaaaatttttcttgattccctgatttttctactctttttttctttagtaggtcctttcagtacctgctgcttgccaaaacgtgaaatgcagattctctttttacttgactctgaattcacctggctaagctctgttaggccttaggaagcttaatagagcttctctaattttgtagaagaagggcctttgactttttccctctctgcttcaggatgatctcatctgctactttggaagcatgagactttatttgttttgatggtactgaggttaggggtgagattgatttatttgtaattagtcctttctcctccttatccttccttttggataaaggtaaaaatataaaatcctcctgcctgctaaagtactgtttggccatcagagaaagggagcttcaggtagggcattccgcagtccctgtccccatcttagcaagttgaagatgctagtcaaaatttctctggggggcaggagagggcagaggatacttacgtatggattctggggttggtctttcagtttcaactaactcattctgtacctgaatgatactatttaataaaatttcgtggtatgagtttgagaacttgtcatgattttagggatattttaacttcctttttgtttctttcctttagttttagggaaggatcttctgccaaactacctgtgccactgtctttcctggaagtctcataagtactagaaagaacttttagaataagagtgtaggacattatttacactgaaataaca

SEQ ID NO: 91455 - DNA, 1001 bp, Homo sapiens
cgtgggaggttgagatagaaggatcgcctgagcccgggaagctgaggctgcaggaagccatgaccacaccactgcactccagcctaggggacagagacccagtctcatcaataaataaataatgaaaggacattttaacaccccactacaaccactaaagatacaaataaataaaaatataagaggaacacaacctcataatacagatagtcttttatattgcatatatttaacttcgggcaaaagccactctattttcctctttaaaaaaacttttttagctatagattaatgaatactttctcagacatttcagaactactgcttagtacttgaaatacaacatttagaatctggggtactacctgaatgtgatgagtagtcacacatctcatatcctttgttttcttgccagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcaggtaactgatggtaaatttgtcttggagtacaggtaaactccgcacagggttagccttggcttttttctctctagttgaatgttcatgtagcttatcatttccaagttactgggatacctgaaattactggataatgttctcatctaggtttttctctttgtatcataaattagaactaaggtaagaaacagctgaggaatttattatgaaatattttctaatttcaacaacaattaccatagctaacattgaaggctactctgtagaagtgctgtgcatataagataccctctgaggttggtactataattattctcacttttaacaagtgaggaagttcagatggagccacaatttgaacagatccaggcagcctgcttcagaatctaggatccgtgctaccatgctattgagatatggtt

SEQ ID NO: 91456 - DNA, 1074 bp, Homo sapiens
cctaaaaaacaaaaaacaaaatgtgttttataagtgattataaaatgtttttttcataggccaaaacttacataaaccatgatttcccattataatccagtggaaaaattgtaatgcttctattagtggtaacttaattttgaaatgttaagtagattgtgcctgtgtcggtttctgggttttgataaatgatcatttatttggctaactttgccattaatggctgaaatggtattgcacatttgtaagtgcatactttagataatcataaattggggaaatattactaataaattatccctgaatcatctaggtacataataatgcattgtcagcactcaccagttgtttgacacctgcaaatatgcacagatggacagtaacatttgcagcatatttgggggatttttttacgtgaaatgagcattttttttaagcaaaacattatattttggaataattatgagatgtgagtgcctaagcagagatgtacagcaaacattatcaggacagaaagcatgatgggagcacccgatgttacattcttcagttcatgctgtgaccaggcgacctcataaaaggaaaaatataatgtataagtacaaaccccattttttgttttggctcttttatatttgtattttttgagacagagtctagttttgtcacccaggctggatgcagtggaccgatctcggctcactacaacctctgcctcccaggctcaagcaatccacccacttcagccccctgagtagctggggttacaggcatgtgccaccacacctggctaatttttgtattttttttgtagagacaggctttcgccatgttgttcaggctggtctcgaactcctgagctcaagcgatctgcccatctcagcctcccaaattgctgggattataggtgtgagcaaccgcgcccagccaaaccccatattaagcaaaaacttgccaagagatcttttaaaaggcaaggaatgagtatggctactgtgtaattatctgaagggttttttttgtttgttttttggttttgtttgtttgtttttttgctggccttttagtttttat

SEQ ID NO: 91457 - DNA, 1314 bp, Homo sapiens
ccatctgccagccaaaaggcaggagagaatcaggagcacaggcgaggtagaactttagctgtttactgttccttaattgactgatcaatgttttccactcactttattttcattagaaggatttacttcatgtgaatgatcccagaaaattaaactgaatatgatagaatgtttggtctttcaaatttgactcaaagtggtggtggtgtgggtatagttttttgggcattgcacaggctttgttttgggttttttggtttgtttgtttgcatttctaactatggaagtttttgatgatgtaccctgagttgatttggcactttgcatgtcttcttctgtagctgaagtacacaaagtttcaaggccagaaaatgagcaactcagaaatgataacaagagacaagtaggtaagttcttggatctaaaagtcatattctatgcttctcaacagggagaatattttaaatatatgatacataattactataaaaaaatgaaaggcgggggttgtgactgtaaaggaggagcacaggggagtgtcactgtggtgacagaacagtcctttatcttgattgtggtggtagttttgcaaatctatatatggtagaacatcatagaactatgcataaagacataccaaaaaatgagtacatgtacaaactggtgacatctgagcaaggtctgtagtttagttaattagattgtgcctgtgtcggtttcttggtttcgataatgtaccataattatataagatgtgactgttggagtttgggaagttgggtgatgggcacaagggacgactctgaactagtttttcaatttttcttttctataattactttaaaataaaaagattttttaaaattttacttttctgggcccggcacagtggctcacgcctgtaattccagcactttgggaggccggggcgggcggatcacgaggtcaggagctcgagaccagcctggctaacatggtgaaaccccgtctccactaaaaatacaaaaaattagccgggcgcagtggcgggcgcctgtagtcccagctactcaggaggctgaggcaggagaatggcgtgaactggggaggtggagcttgcagtgagccgagattgctccactgcactccagcctaggcgacagagccagactctgtctcaaaaaaaaaaaaattttacttttctggaaaaaaattctacttagtggtaggcctttttttttctgagatggagtttcactcttgttacccaggctgtagtgcagtggtgtgatctcagctcacggcagcctccgcctcccgggttcaagtaattct

SEQ ID NO: 91458 - DNA, 1687 bp, Homo sapiens
aatatttttttttaagacagaaggatcatggtgtaattctggcttgtggccgaggcatttttaatagtagaggtgaatgtttcaaacatcctacttatctagatttatgtctggatatgctgctgtggggttttgtggtttgttttctcaaacccaggcagtttgccaaacctcagcaaacagcgcaaacctatcttgttaccctgtagtcacttctcatccttgtcagtatgtgtggagcatttcacgcaattgtgatcattaaactcatactggtttctgttctgcgtttttcagttaacatcaaatattcttcctctgtttttttcttgttagtcatttttcttgtgttggatatttgggttcccacgtttttcactataaattatgctgctttgtattgctttatcatgtctcttatgattggctgaaattttactgtgttatagaggagagagaatgtgtagatacaggaaggcttgaataatatagagccatctggagagacacagtaaagatggagtaggaagtgttttgagtcagtaaggattggtgcttgtctgttttttatctgtgatgtggaaataacacctattttcttgcaatttgtgccgattagtgtttatttttcttactataaatcttggttcctgttattctttccataaaaggctttctacattttgagaacccactgtgtgtctggcacttcagtttgccggtgttggggatatagcagtaaggaaaacaaagcccctgacctcaaggagcatacattaatttagtgcagaagcctccacacttgcctggctgtatactctgtcagtaacacatgtgagtgtggactccataaatacaaatgtttagaaattttgtgtgagctattctcagtctacatattaaatattagtgaaacttaattttttattttgtataaaaaatacaaatacaataaaatatatagagagacctgtaagcatttctgttgttgactgttgaatctaaagagcacaatagcaacatctgtgctaaaccagctattacatattgaatgtcctttgtatatattctttattatcatagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaaggtaagctttgatttttcttttcagaaaataatcttatttgatctgtgaattacagatgtttctcagattaggtgtttttatgtaattcagattagctgtcttgacttttctgatatgtgcttttgttcttagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaataggtacagtttttaagctgttcttttatcttatgatattgattgaagtgtaaaatggtttcatgtaaattcacgaggtttaatgaatactaccataattgttttgttttgttttgagac

SEQ ID NO: 91459 - DNA, 1022 bp, Homo sapiens
atattacaggaacatattgaactcatatgccatgaacaactcgtgataacttagataagatgcttttttttttttttttttgagatggagtttcgctcttgtcacccagactgtagtgcagtggctcgatctcgactcactgcaacctccacctcccaggttcaggtgattctcctgcctcaaccccccaagtagctgggattacaggcacctgccaccatgcccagctattttttgtatttttggtagagaatgagtttcaccattttggccaggctagtctcgaactcctgacttcaggcgatccgccccctcggcctcccaaagtgctgggattacaggcgtgagccatcacgcctagccaagatgcttatttctaattagctttagtaattacttaggcttaatttgggagtagcactgcatattttggctgagggatattcttttaaacctgatatgctgaagattatttgcttttataatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatatagggtaagtgttactgttaataaattctttggggttgacatgcattttacaagactcaaaacatttttacttgtttttgttttgggtgaattgttttgaggacattagaataacttccattttgacttttcagtagaggatatacgtgattcagatgtatatataaagacattatacaaaaaaagacagtatagtatcacctttatttcatgttaacagaatatacttttaacacccaaagagtctatctaggaagcacatactcccagaatggaagggcaagctttaacatttaatagcagtta

SEQ ID NO: 91460 - DNA, 1227 bp, Homo sapiens
ttagatgataaggaaactaaggaccccaagaagttaattgtcatgattgaggtacaagctaacaaatccaaaactcactctcttgacttgtggcctgattttccttaagggtaatattgtaaatataggccagtgcaatggtgtacacatgtaataccagcattttgggaggccagggcaggattgcttaagcccaggaattcaaggacagcatgggcaacataaggagtccctatctctataaaaaagtttaaaaattagctggagtggtggcacatgcctgtagtcccagctactcaggaggctaaggcaggaggatcagttgaacctgggaggtcaaggctgcagtgagccatgatcgcaccactgcactccagcctgggtgacagagcgaggcctgtctcaaaaaaaaaaaagaaaagaaagaaatataaccttatggtaagtttggttgtatggtgttttccccctcccaccgcccattcttttttgaggtgagaatggaaatcaggactagcaataataatgtaaccagctcctgttttatatgctgctgtcagggaggttaagccaccatggtgggtgataaaaatcacatctgtgtttcctcagatggggttcaaagacaacaaggtgtctgaatgactcagcataatgctctctctcctctccccctttcattttctcctttctccctctcctgtccccatctctttctctttttttttttttttttttttttacctttcagaaaaccacagcttttggaccctaaaaggtctggattgatcgtactgctttctgaaaggtaaaaaaaacaaatactttgggaggtgtgaaggttggctttgtgggggacagcaggttcatcttgtagctcattgctgtcaacttatgccataccatatgtatttcagtttaataacggggtgcaaatgttttggtgttgtatacacagatgaagttaagtctcacctaggaaatgtctgtttctaacagttggggtgagaatcagcagtaaaaaccaggtatatggtagcagctggtctagaggaaaataaaagcccttggctccagccctttgtacaggcctttagtttagggtcagtctctctggaaatcttgagatttttattgcttcctcactggttactttttaaaaattccccagtcagctttctacttttcagagcttatttcagatttaagagttatccttgtaaaatt

SEQ ID NO: 91461 - DNA, 2097 bp, Homo sapiens
agacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagc

SEQ ID NO: 91462 - DNA, 1319 bp, Homo sapiens
atcagaaaaaatgtcatacacattagctatctatagaaaagatataagtcaaaagatatttcgtaaatgtagtttgaagaatctcagggaaaactttaaattcaaccaaactgacccagctataaccccaggaaggcatgcatggaatgtgtttgtagctggaaagcttaaacttaattttgtatcctcagaagaaatacttgtgtttctgggagaggattgggacagtgtctggaaattggggtggcgggtccaagagaggaattacgtggtgtgtgtgtagcactctctgggggcctgaccagaggagcagtgcagcgttccctccacaaagccatctgcactaacacacagatgggcgtgtccctgttgttgcctctggctgcaagggtctctcccttgcttagcgtctgtcctcccagtaccatctgagtagaagatagctgcacgtggagatttcttggtaaggagagaatgtgagtggttgagggctctgcatctaagctgcttggatcagatcctggtcttgggatgctggctaatctttcagttttctgatttgtagaatggggataatagtagcacctttctcttagtgttgcagtgagggctctgagcgtgctacccggcacctgtgataagtattcaatgacagtattagctctcgttggtattcataaagtagtaactggcctctggttcatacatcagttttctttgagcttagatagcctaaataattaatccccatggaactgcttgcttctgggtgcattgaataagctgataaacagacactgggaagtaatgacagataagctcttcctacactgctcatccagggaatccagcctgcagttctcaggggagacttctggagaaggctgttcttgagctgagtactgtgggaaaaagtaagtccagtgccacagcaagaggggaggactcttgggcaggggcatgacacgtccaaaggtgtggaggtgagagcaagcatgaggtatttgagctgcaggagattgagggtagagtctggacaggtatgaataaggagtagagggaaatgacattggaaagtgggagcagtccttgaaataactaataacaatgtctaactgggcactaacagcacttcaggtcctgtgctgagtccttcgactcactgcgctaaccaggtttgatgctgagagctttgtctacattgcattgtttaatcctcacaacaaccctttgatgtaggtacttacctctggtatgtgtggcatcatgtcacatgtcacctggtaggtctccctgcctttttttttgaaatggaatct

SEQ ID NO: 91463 - DNA, 1003 bp, Homo sapiens
ataatgttttcaaggttcatccatgtatcagtactttattccttttcatggctgaataatattccattgtacagttatactacattttgtttgtccatttgtcaattgatagacatttgagttgtttccagtttttggtattatgataatactgctccaaacgttcatctgcatgttggtttgtagacatgtttttcatttctcttggatatatatacctaggagtaaaatttcttggttgtgtggtaattttatgtttaaccatttgaggaactgccactgtgttttccaacatgtctgtaccattttgtattaccctgagcagtatatgaggattccaaattctctaacattttgtcaacacttgttattgtctgtttgattatagtaatcctagtggttgcgaagaggtatctcattgtgattttgatttgcatttccctgatagttagtgatgttgactgtcttttcatatgcttattggcatatcatctttggagggttcatctatatttgtgttttgtttgtttttttttctttagagatggagtcttgctctgtcttccagactggtgtgcagtggtgccatcttggctcactgcagcctatgtttcctaggttcaagcagttctcctgcctcagcttcctgagtagctgggattacaggtgtgcgccaccacgcccagctaattttttatttttggtagagatggggtttcgccatgttgaccaggctggtctcatgctcctgacctcaggtgatctgcctgcctcggcctcccaaagtgctgggattacaggggtgagcacctgtgcccagcccatccatatttgatcatcagttttggcaaggtaaattaagttgcaaaacctgaaactttaaaggaacaaacataacacatttgattgtagaaatgagggaaaaagagtgtgtgtgggtatgtgtgtttatgtacatatgtgtatatgtacagtggaagatgccataaacagatttgtaaaa

SEQ ID NO: 91464 - DNA, 1039 bp, Homo sapiens
aacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctg

SEQ ID NO: 91465 - DNA, 1104 bp, Homo sapiens
ccagagcaatatttgttgtttctggaatttatgtactgccaggggatttagccataggccaataagggtctctctcagaattttcagcaactcagatgaaatggctaggcatttggattttttccttttggttttttaaggatttttataagcaaggccctgagagtcactttgacattcatccctggggaaagaggtctgtggcctaacattgccaggcaaggcctctactcaggagctcagtccaggactgtgggtgagaaaagctctggattcgagagtattcaaatatttgaccatttaagagttaggacaaaggatgatcctgtccccttgccatgtggccagtgcatgtgtgcagtgttcccaggtgcttctgacttacagccaagtttgggctgtggttattgattgacagatactgatgcctttgtccaggaatggtggttgctgactgtgtgctctgccaccctgccttggaaccagcagggcatatgtgagtcctgtccagtctatactcaccagtgactttgccccttagcccgagtggttcaccctcacagtctctctgttagagaagtgagttgtgactatggggtttcactagctgactagtgcctgtgacactggtacatcagcctaggaagtcagttactgggcacagagtcagaagacctgggtttggaaggtgacatctatcacttaaataaaattactttttcagtggaagtgtacataaataaaagaatcaaagtgacttgtgatttgtgcattcattccacagatatttattgtatgccttgtttctgcctgatactactccagcatgtcgattgcagtagtgaacatgacagaaatctctcccttcatgtagctagaagggagtttcgatcttagagaaggtagttagaaaaggtaccactgagaaggtgacattcgagtaaaggcctgaaagggatgagagagcaagcctgttggcccagaaaagaggattccaggcggagggagcgccgagcacagagtcccagaggcaggagccagcctggagtgttggaagagcaggaaagaacctgctgtggctaaaacagagtgaatggaagggag

SEQ ID NO: 91466 - DNA, 1068 bp, Homo sapiens
cccagcctcctgactgttcagctcacacacgtgaacctaacacctgccttggtcccctgctccatcttctagacaactcatgctgaggaccagcccacaggaggaggcctccgagttctctcttgacgtcttcaccttgaccttttttgccaccattttagtctgtccaggcctttctgccctttctacattccctttgctttcagccagtgatgccaccccctactacactgagcaaatagaatctccctgatggcagcccttcttcctcatgtggccaagccaccaccactcctgccatccctcttcacaaccatcttttcttccttcccctgcctcatgacagcagaggaggtgccctctcctcctgtccaggcttgccccgtgctggccttgcccccatcctcgagggcccagcttctgtggtgcgacctagtgttttctctccctcatcctcagcctgttcccaccagtacacaaagatgcttcccacagaaaagtccactctgccctgccctgtttctctgctcttttctcagccaacttcttggagtagttgtctacctttttttcacctttcattcattctaaaaaattactattttatttttactgcaccttgtggctccttactgctcctggcacaccccgtggacagtttactcagagtagtctaaaaagtaattattattgaagtatttcaggcacatagaacatttcacacccatcagtgtatcttccttttagctgcctgccatatttgctcatgcctgttacatatttttaacagaaaaatatcaccagtgcacttttttttttttttttttgagactgggtcttgctctgttgcccaggctggagtgcggtagtgatcacagcttactgcaatcttgacctcctcggctcaagcaatcctcctgagtagctcagactataggcatgcaccaccatgcttggctaattatttattttattttactttttatttatttttttaaagacagggtcttgctatgttcccaggccggtcccaagctcctaggctcctgcacccggtctgtaaatgca

SEQ ID NO: 91467 - DNA, 1054 bp, Homo sapiens
aagtaggtaagtcttttttccagggttcctaaaataaagggagatttcggccgggctcggtggctcaagccagtaatcccagcacttcgggaggccgaggtgggtggatcacctgaggtcaggagttcgaggccagcctgaccaacatcatgaaaccttgtctctactaaaaatacaaaactcaaccaggcgcagtggtgggtgcctgtaatcccagctactcgggaggctgaggcaggagaatcgcttgaactcgggaggcggaggttgcaatgagctgagatagcgccactacactccagccagggtgacagagtaagaccttgtctcaaaataaaataaaataaaataaaataaaataataaaataaaaaataaagggaaatttcctttctcttcaggatggttaattaggctttcaaaatttgggctgctcactttgcaatacaaacaatctagaacttctagtttatttgcttagatggtttattgctgcattttacttgagggggtttttcttgttgttgttattgttggtctaatgttgctagaactgtaccaccctcttttacctaccagttactatatatgttacaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagtaagtttttcagaactgacatactgatttccacgggatagaaacaagggagggagttaaagttgtgatgttgaatcaattagaaagggttatagagtagtaattgaccttttaatagctatagaaatttaagatttctatttccattgaactttgtcatcttataatttgctttacgatcttgattgttaaaaataatttatttccaggcatataagatagctctggaaagcttaggacactgtgaatatgcaatgaaagccggcttccacctgaatccaaaggcgattgaagcaagtttgcaggtacacttttcc

SEQ ID NO: 91468 - DNA, 1032 bp, Homo sapiens
agaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataatactttgtatccttgtttaaaatgaactgcagaggacattatgtcaaaagccctgcctgactcattgctttgaaaagctgcatactgagttggtttttaggtcagcctgtcctctgattctagcaaggggaagaccacttgggatattacggtgag

SEQ ID NO: 91469 - DNA, 1110 bp, Homo sapiens
tttcatcttggttttcctcaatagcccttaccaccagcagacacacatcatctgttgtacttgcttatttggcacatatgtatccacagcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagaggtagggagagaggagctgaggccccagatcagcggccgcgggcaaggtcgctcagcgggcacccggcctgggtatcggggcgcgggtcgggggcggggccggggctcaggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcaggtgcgggcgggccggaggcgggggctgccacgcgcggcgcccggaaccgggcacgcgggcctggggtctggaggcgggggcagcggtgcccggggaccccagtccccgacctccaggccacggactggggcccaggccgagtccgcacttcgtccttggagtctccttggagtgcgttcctgggggcttgcagcctcgccgggagtctcggccccgggtctgcttcgttacgaggaaaaacgggcccctccgtggggacatttcccctcctcctccccgtgcagctctggccatttgagcaggggctcctttcgcagttgtgaagagaggccttggctgacgcagcaagcgggaaagggctgtccctttccatccgctcctggccacatgagcttgggagcgtctgcagggcgggcagcccgggcgggggtgtttgagggag

SEQ ID NO: 91470 - DNA, 1031 bp, Homo sapiens
agccaagatcacgctactgcactccagcctgggtgacagagtgaggctctgtctcaaaaaaaaaaaaccaacaaaaaaaccaacccatctctggaaaaaataaataaatcagctaggtgtggtggtgtatcccagctacttgggaggctggggtgggaggattgcttgagcccgggaggttgagtctgtactgagctgagattgtgccactgtcctccagctcaggtgacagagtgagacgcctccagggcaaggaagttgtggggtcctgatgggaatctggatttcctgaatgtcacttagggtgatcagtccatgtgatggtctttgggtgtgtggcggggcctttccagccatctgctgtgagtggcagagctgaagtgcattaaaagcctagtgctgtgtgatcagtctgggtgtgctcagccatgccacatggcgaggatggcactgcaccgtctggggtgctgtttccaggaaagccttcccttaaagctggccactggagtacctgactcaggctgataaggtatttatagttcaaaaaaagttgctgaatggcagtaatcccctggtgaggaacattccccatggctgtgctctccaaagtttgccaagattgggtgaagacgttcactgtgaccttgattgtagtggcaaaacctgaaaccaagctgtactcatttgtcaggggacttacaaagtagagtcagcacatattcatatactgtcatcctgggcaccaatagggattagggagctatagttggattgatctgccatgctgttcaggatggactgggaagttgaaaaaggaagttgcagaattggtgggtatggtaaagactcatttggtcaaatgaaggctgggtgtaattgtaataaagatagacacatttggcttggtgcagtggctcacacctgtaatcccagcaccttgggaggccgaggtgggtggatcacgaggtcaggagttcaagacaagcctggccaacataatgaaaccccatctctactaaaaaaaaatacaa

SEQ ID NO: 91471 - DNA, 1246 bp, Homo sapiens
taatcccagcactttgggaggctgaggcgggcagatcacagggtcaggagatcgagaccatcctggctaacacggtgaaaccctgtctctactaaaaatacaaaaaactagctgggtgtggtggcgggcgcctgtagtcccagctactcaggaggctgaggcaggagaatgacgtgaacctgggaggcagagattgcagggagccgagatcatgccactgcactccagcctgggcaacagagcaaggcttcatctcaaaaaaaaaaaaaaaaaaaaaaaaaaaaaaaaaaaatatatatatatatatatatatggtaaattaaaaacaaaaaaatagaggcacctgcgagggcctgaaagctgggactgaggtaccaggacacggcagtaatgatgtttttgagcagcggattatgcctgggggtttgggctgatggcatcttcgcccctgtgccagcgtgtccggagcggtgactggaaggggtacacaggcaagaccatcacggacgtcatcaacattggcattggcggctccgacctggtgaggagaaaactgccttggggtagggtgggagtctgggcactgttggtcccactcaggtctttactttctccagggatgggacctggctgtctccacttttcgtgggccctgaattcttattctctgatgctatgtctccccgcagggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaaggtatgagtgccgaaaactgcccggcccctggccctgtgtgtgttggggtggggagggacagctgtcttgccatccccctggccattggtcccttttggtgggttccgagtgaaccatggtttgtggatcaggtcagtacagctgccctagactgtttccatgcctagcagcaaataaggttgactgatgaaatcctgaacacatcagtttgaacctttgtgtcctgaccacacccgctcgccttgcggcatctctgctcagcctgggactgctcgccactttcttacaaacctgtcctttatgcctgctccttttcttgttgttgtttttgagacagagtctggctctgtcacccaggctggagtgtagtggcgtgatctcggctcactgcaatctccgtctcccaggtt

SEQ ID NO: 91472 - DNA, 1536 bp, Homo sapiens
ccgccatgcccagccatgcttgctcctttctgatcccagagccatgccctgataatagaggggttttgtttgtttttatttatgttctatttactcacatgaatgtacataaaatatgaagaattccatctgaattctgagataccttccagcctgggccgaagagagcctcaggttgactgcagcccctcaggggagaagctgcggcctttgacctgcaggcttagggttggggggtgtgtttaccgtcccccctcctctggttttaaagagctggaatctcaggaggttatgtggcgtcactgtcactgacctgcaaatactgctccatgggacagctgggcattgccttggcctctactgctgaaccctggctcaaggcctgcacccacccctaagctcgggcgcccactgctgttctctttggttgcagacctttactacccaggagaccatcacgaatgcagagacggcgaaggagtggtttctccaggcggccaaggatgtgagtgggctatagggccttcctcgtggttagcctctgggctgggaagagcagggtgggcccctgagtgaccaagtctggccgtgtttctcctgaagttggaagtgaaggcggccttgccggtgcctgcctttgctagatgagatgattgttcatcttggctttgtcagacccagccttgcagatgtgacagaacctgctctcgctggctgacagcccttgcatggccctttctctgcaggcccttggcgctgcaggaactcttggccacacctattttataggggagggacgtccctgagccccgtatgcttgtaagatgggatgagcaggcggcctgtgacccgtctgctttcttgaccttgacctcgatgtgggccttctccaacagtctcagaaccaaggactgggaatctcagtcccatgcagggccttggttcctctagtgatgggaagtgactaccctttgtctccctgggctggctgtggtaacttggctctgtctcttgtagccttctgcagtggcgaagcactttgttgccctgtctactaacacagtaagtgcccccgtggtcccctgtactgccttcctgggagtgcccagcatgtccaggtcatggcctctcagagacgcggttcgtaggtctggtggatcttggcttggctgatggtatggaaggtttggttgcctgtgggctgcaagccttccttgccttttccgcatttacccattcaacctctgcagctttgaggagggaggcttggagtcagtgggatcacgataaccccttcttccgtctcccaggcctgactgatacacagaacccttcatacacatgaccttcctaggcctttgtgcccagcatctccccaaatgtgacatgctaggtaggggtagaggatgcattccatttttcacttaaggacataaagccccaatgaagggaggtgacattttgccccctacttagtgtgtgtggttttgttttttttttttttttttttttttttaagacagtctcactctgttg

SEQ ID NO: 91473 - DNA, 6909 bp, Homo sapiens
ccctggctctggggaaggtgaggctcagctcacggagcacagctccctgcctcccggagctcctgttcccatcccgctagcaaatgcttctttgcatttctctccctttgtttttttttttgtagaccaaagtgaaggagtttggaattgaccctcaaaacatgttcgagttctgggatgtaagtacaagcacttctgcactgggtgaattaagtgtcctttgccaagtcatggctgttgagaggcccatgaggtcaggtcagtgtttattgagtacctgctgcatacctagcttggggaaaggtagagaggccctcagagaggcttggagggcaagagcaacccaggcaggatgagggctccacttccacctgagggcgggctgagcttgcagggccacatgacactcccttgggtgcctgcctgcaacacccactgtggggtaacccgagtcccccttgccacgctcacagagttgaggttgtgagttattctcagtgatgacctttctctgaactgcagccaccatctgtaaaggccaagggcagggtgaggcatgaggtatgaccgggtaggcctggaaaggagcaacaggagctgcaggaggagctgggggggtggcgtagaggaggcgccaggctggggcagcttgcagagcaaaccctgccttgagtgacagggctgccgacccctctgtagcaacaggtggtccatgggaccacctctgctggagccgagcagtgagccacagctttccttgtgcacttgcctgagctcagcagtggtgtgaggagggctctgactgtgaagcccagggtgcaggggtgcagtgcagggtgtgatgcaggcactgtgaatgctgtgggcatggccgggcttacgtgcagggctctaacgctgtggcaggcgcagcagagagggcattgcccatttggtggttttcccacctggggctgtctccaggcatttggaccagaggccctttgcttggtgatggcatccacagacataacctcattcctttgaaagctctaaaggccttttactaccagggtctgggagagaatgaagccctaatcccttaagccatccactgtgtataatgagttaacttctttctagaatgagactagttacataccatccttggaagaattgacgagaatcactcaagtcattttctgcatcctgtggctcagatgcggaacactggtcaagagagactgtgcggcttctaataaatgttgcatggctgataatggagggcaggcaccttccacctcctccttgggatctggagcctgagcaggtggtgggcagggatgtgtgggtgctgctgccagccaaggagccaagcagatcggggtgtccttgcttgtcaccacccagcatgtagagatgagttagggtgtggcttaaggagaggatgggtctggcctcccaggtaaggcctaggaatgatagctggacacaggaacatggggccagggctggctggtgagacctaagtggaggcctcctgggccaggctagacagcccacaacggctggaggagggacctgcctgagttactagagtgtatcctgctgaatcaagaaggtgatatctgaagaacccagggataggagcaggcgaagttcctgcaggtggggtctcgggtgagctacagccatcagctcaggcctagggatgcagtgccggccctcaggtgagatcagaagagtcccgtctggtaggggtatgtagaagaggtaattcttggtccgccagggccagttttgcggcagccatgggtgtcgggatcaggcaggggtgtggtgggaaaccatggggtctctcagggctcggccagggtcagcgcacgccacagggccagttttggctggagaggcctgaagcagagccagagcaggtccaggtgagttctgaagaggagccaggacaggagagggacccataggtctgtgaattccagaggagaggcaggtatttagaggtggttctgtcaggtgaagtctgaggagccaaagctatgtatgtgcatatgtcagccgggctctgtgggaggtggtgtagacctatggcatgggacaggtgtgcacgctgggatctctggccggttccgaaaagtgaggatcaggtagtgggtggctgattgcacaagtttagaacccaggattagggacacacaggtcagcacctgcttctcagcatcctgactgggtgtgatgggcagagctcagggcgtcagaggcctctgagaatttgtgactgaagtccaagtctgtggcatcagggtctgcagagcccagatgcgggagaggtaggaatgtacctggtgatatgaggcaaggacaggggagctggggcaggtgaggcaggcaggtggcatgaggagctgtgctgggtgggtgcggtctgagtggctcaggttgggtaaagggccagagacctgggtctacagggcagacatcaaggctgagccagtcagacagtgtttgtcaacactgggctctcaccaggctccctcaggccgaggtcagcagccagggatctgtcatgtgtgaggaaagtgtctgttcaggttaggtgtgtataatgcagcctttcagagccgcgtctgtctgaggtcctaggagctggaatcagacaggtttgtatggctgggtttctaggggaggcctgaggagccaagactgtactcaggtaggcagaactggaccagtctggtaaggacgttggagctaaagataggcagacaggtcgagctgggtctgacaagtgagggctgaaaatctgtgattgggtccaggttggagctgtgtccttgggcgatgtctgagcagctctggtgggtgagcctgggtcccctgggaagagaccagacaaagggatggggtcagacaaagggatgacgaaccgcatccatcagaaaggtggatgaagcctgggtctggtcgaggtacgtagagcagatctagcaggcgaggtttcaggggttaaggtgagacacaggtatgtatttttgggtctcacaggttaaggtctgagccactgaggtcaggctctggtttgtatcccaagaccgagaagctgtgttaagcatggtgggtagagtttgtcaggtgacatctatgaaaccaggagcatgcaaagataggttgaccggaacagccatggtcaaaccaattaaactgtcctgcagttgaggtcaggcacaggtagaacggatctatcaggtgaggcccaaggagtccggattaggctcatctagaaagacctggatgtggtagatgacctctgaggatatgaagtgaaggcaggtggatagagccaggtctctcaggaggtctgaggagctgggatctggcacagtgagcaggtctggatttcccaggtggtgtcaagacagatgggtaggccaggcacagtggctcacacctataatcccagcaatttggaaggccaaggcaggcagatcagttgaagtcaagagctcgagaccagcctggccagcatagcgaaaccccgtctctactaaaactacaaaaattagccaggcatggtggtgcatgcctacagtcctagctacttgggaggctgaggcaccagaattgcttgaactggggaggcagagtgagccaagatggtgctactgcactccagcctgggtgacagtgagactatctccaaaaaaaaaaaaaaaaaaaagcgggggttgggtgtggtggctcatgcctgtaatcccagcactttgggaggccaaggtgggtggatcatctgaggtcaggagttcaagaccagcctggccaacatggtgacggggtgaaaccccatttctactaaaaaatacaaaaattagctgggtgtggtggcacacgcctgtaatcccagctactcaggaggctgaggcaggagaattgcttgaacccgggaggtggggtttgcagtgagccgagatcatgccactgcacttcaacttgggcaacaagagtgaaactttgtctcaaacaaaaaacaaaaaaaaaaaaaaaagaaaaaagatgggtgggtagaagttcttctcctgggtgaggttgaggagctgtggccaggtacaggtatgtaggtatgtggaattgagtttcttgggtgaggtctttggagcctggcccaggtacatcttcgggtctatcaggtctgaagaacgggagttaaacacaggtgtgtagaacagggtttggcaggtaaggtctttggagccaggatcagggcagcttcacaaagctgagtgtgttcatgagacctaaaaagtcatagtcaagcccaggtaagaagaaccaagtgtgttggatgaggtgtaagcagctgaggtgtgaagtagaggtaggcagagctggcccacaaggtacaagctcaggaaccctcatcacatgcaggtagggggtgctggtccaccaggcacaagcccaggagccagcattgagcacaggtaggcagacttggcccaccaagtatgatctgaagagccaacatcaggctcaggtaggtagatctggcatgccaggtgtactccaaagagccagagtcaaacacaggtaggtagagatagtctttcaggtgtggtttaaggagccaaggtcaactacaggtaggtagagctggcccactgggtgtggtttgaggagccagggtaagcacaggtaggcaaagctggcccaccaggtatggtctgaggagccagggtcagactcaggtaggtagagctgcctgccaggtatggtctgaagagccaggatcaagtacaggtaggtagtctgggtcactaggtgtggtctgagaacccagcgaaaagctcaggtaggtagagatagcctttcaggtgtggtctgagaacccagggtcaagcacaggtatgtagagatagcctttcaggtgtggtctgagaacccaggttcaagcacaggtaggtagagatagcctttcacgtgtggtctgagaacccaggttcaagcacaggtaggtagagatagcctttcaggtgtggtctgagaacccagggtcaagcacaggtaggcagagctggcccaccatgtgtggtctgaggagccagggtcaggcaggtagacaaaactggtctgccaggagtagtctcttgaaggagagctgaggagttaggttgaatgcaggtagatagagttggctctttcaggagttggattcaggcacaggaatgtgcccctgggtgtttgaggtgaagcctgaagaaccagagttgagcctaggtgtatagagcggcctcccaggtcaaccccatagcatgggggtctctacaggcaggcagaacattgtgggtttcctaggaggtctgtggcccctaagttagacgtgggtaggtagatgtatctctctcaagcaaggactttgtagctagagagacatacagctggggtcttgcaggtgaggtcattggtgcgtggttctggcttagttgtgctgactcagtcttaggcctggggacagtgggttagtcacaagttggtagaactacgcatctcagctggggagcacaggtaggcagagatgttccatttgatgaggtctgaggctcctcagtgagctcattggtgctgacgttaagcagagattggcagcattggatctgtctgtgagacatgaaaagccaagccagacacaggatgtggactgccgaggccaggctcacataaataaagctggaccctgggaggctgtaaggaatctgagttgggcttaggcaagggaaccgggtctgtcagtcaaggtgtgaggggtcaggttatgtgaagcctggtctatcagctgagatgtctggaacccatctttgacaggtatataactctgtagcctgaggcactggagttggacacaaataggcagaactaggtctcccaggtgaaaccattgcatcgatgctcagtgctggtatgtttatctggtgttgtcagtgagtctgccgatgcaggctcagtgctggtatgtttacctgattatgtcagtgagtctgtggatccaggctcagtgctggtatatttacttggttgtgtcagtgagtctacggatccaggctcaatggtggtatgtttacctggtgttgtcgtgagtctgtggatccaggctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagtgctggtatgttgacctgacattagcagtgagtctgtggatccaggctcagttccacagaggttgtataaacatggtctcaggtgggttcttgacacctgggttcaagcacaaaagtactgctgggcttgttaggtgaagtgggtggggtctagcacaggaatgcataatggtgaggctggccaggcctggggaaggtgggtcagacacaggtgagaccttcggtggtagggtcagacacaattaggtgagtagtgtgggctcttatatcaagggaaagccgtagtcattgtaggtgtttgtacctgggtctgcctggtgatgtctagggaaccctaaagatcagctgggacaggtatctgttctcagcaccctggtcaggtatgatagacagagctcagggtaatacagagggctgaggatctgtaaccagtccatggtgttggtctgcatccaagatggcattgtgctccagttgacacagggtctgagttaaaagtgaggaaagttgccaggcgcagtggctcacgcctgtcatcccagcactttgggaggccgaggtgg

SEQ ID NO: 91474 - DNA, 1648 bp, Homo sapiens
catctcctaaaaatacaaaaattagccatgcatggtggcacatgtctgtaatcccagttactcaggaggctgaggcaggagaattgcttgaacctggcaggcagaggttgcagtgagctgagatcatgccactacactcaggcctgggcgacagagtgagagaccctgtctcaaaaaaaaagaaagtgagtaaagtgaggaaaaaggtagatgatggttagataaggtgagatctggggcactggggcaggttaggcccaggacattgaactgactgaggagctgcatctataatgtatggtctcagaggccactgcacttaaaggtgaggtctagagacccatgtctgcagattgagggttcggaggctcaggtcagacactgcttggcattgctgggctgtcacaaaactgggatctgaggacctgttctcggccaaggtgagcagcctggactctgtcagccagagggctggctgtgtgctgaagtttagtttctagagctgagtctgggctgggtgtggtggctcatggctgtaatccctgagcttcgggaggctgagatgggaggctgaggccaggtgttcaaaacctgcctggacaacagagcaagaccccatctctacaaaaaatttaaaaaatagtcaagcatggtggtgtgtgcctgtagtcccagctactggggaggctgagatgggaggatcacttgagcccaggagtttgaggctgcggtgagctgtgatcatgccactgcactccacctgggcaacagagcaagaccctgtctcttaaaaaaaaaagaaaaaaatagaactgcatctgttagatgagatgtgagagcctatgtcaagcatgatgtagtctgtaggactgcgtctgtcaggtaaggttcccggaaacccagagcctttccaagtgagtggccccaccggtcatctcattgcccaagccagaaacctctcggccacactggagagctcccagaatgagtcctctgcactccccagtccatctccggggcttcaaagtggcttgtttgcttctgtccttgtcttagccgcagactgttctcagtcctcccaccgtgcctctcagcttccaccctgcggtccccaccccttcctttatcctctggaaggtgctatgcttccccctgcctcagtgggcttccaggagagaattaagccctcacagcccaaggcatctactggatgtaataagtgggcacctctccttcgtgtctagaaggttactagtcttggaccatccttgggagaactgagaagtcactcagatcattttctgtgggccttaattctgtcacgcttgagaaagactgctttggccacgggacctttgcatgtgctgttatggctgctggaatgctccctcagtgcttctctgggtcatgcctgctcgttcttgagatcaagggtcaagtacccctcaggttccttttataagtggcctcagcaccatgttccaatttctcctcagcacttgtttctcagtttcacatttattggcatgattatttgatgtacgtctctctcccacactctgtgtccgttgcctgtgctagaaatgtgggaggtgctccataaacagctgttaggaagacatccgtgaagttctgaggactctgatgg

SEQ ID NO: 91475 - DNA, 2909 bp, Homo sapiens
acaggtatgaaatctgggtcttcctgtgtctgagaaggtagcacctggcacaggtatgaggatctgggtcttcccaatgtttgaggaggtagcatctggcacaggtatgaggatatgggtcttccatgtctgaggaggtagcacctggcacaggtatgagaatctgggtcttccagtgtctgaggaggtagcacctggcacaggtatgagtatctgggtcttcccgtgtctgaggaggtagcacctggcacaggtatgaggatctgggtcttcctgtgtctgaggaggtagcacctggcacaggtatgaggatctgggtcttcccgtgtctgagtaggtagcacctggcacaggtatgaggatatgggtcttccatgtctgaggaggtagcacctggcacagatatgaggatctgcgtcttccagtgtttgaggaggtgagtttggactcaggtttgaggcccttgggcttccagtgcctgaggagatagcatctggcacaggtatgaagccctgagtcttctagtgtctggggaagtgaggctgggtacaagtatgaggatctgtgtccatcagtatctgaggaggtgggatcgggtcctggtatgaggatctgggtctgtccatgtctaaggaggtaagatctggccctggtatgaggatctaggactgtccatgtctgaggagttaccatctggtacaggaatgaggatctgggtctgtcaatatcagaggaggtaggaatctggtacaggtatgaggatctgcgtctgtcaaagtctgaggagttaccatctggtacaggaatgaggagatgtgtcttccagtgacttaggaggtacgatctcttataggtatgaggatctgggtctgtcaatgtctgaggaggtaggatctggccctggtatgagaatccgggtctgtccatgtctgagcaggtaggatgtgtccctggtatgaggatccgggtctgtcaatttctgaagaggtgggaatttggtacatgtatgaggatctgggtctgtcagtatctgaggaggtaggatctggtacagttgtgaggatctgggtcttcgggtgtctgaggaggtggcatttggcacaggtatgagaatctggatcttctagtgtctgaggaggtgggatctggtattaattatgagaatctggttctgtcagtgactgaggaggtaggatctggcataagcatgaggatctgggtctgtcaatgtctgaggaggcagtatctggtacaggtatgaggatctgggtctgtcatgtctggaggtaagatctggcatgagtatgaggatttggttctgttcatgtctgaggaggtaggatctggtgcaggtataaggatctgggtctttcaatgtctgagaaggtaggatctggtacaggtgtgaggatctgggtctgttaatgtctgaggaggtaggatctggcactggtaagaggatctgcatctgtcagtttctgaggaggtaggatctggccctagtaagaagatctcagtctgtcaatttctgaggaggttggatctggcccccttatgaggatctgagtctgtcaatatctgaagaggtaggaatctggtacaggtatgaggatctgtgtgtgtgtcagtgtctgaggaattaggaatctggtacaggtgtgaggatcttcatgtctctgtatctgaggaagtaggatctgatacaggtattaggatctgggtctatgtctgaggaggtagcatctgatacaggtatgaagacctgagtctgtcagtgtctgaagtggttggatctggccctggtatgaggatctgggtttgtcagtatttgaggaggtaggatctgtccctggtaggagggtctgtgtcttctagtgtctgaagaagtaggatctggccctggtatgaggatctgggtctgtcagtatctgaggaggtaggatctcatacaggtatgaggatctgggtttttcaatgtctgaggaggtaggatctggcacaggcatgagcatctgggtctgaccatgtctaaagagttgaagctgtgtgcaggtatgaggccttgggtctgccagtgtctggggaggtgaggctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggtgagtgtgtttctgtgtcttgcagcccctgtgggagacagtgttgcagtctaaggtcggggtagggggcttgtgtccctgaacatcatgctgtcctcacaggctgctggcctctctgcagctggctgggatatttatttcatgtccagaaggaaggtctgggtttttttgcgtgtgcaagttggcccccgtctttgcccctcacaactgcagtcctgtttctctcctatcctaggcagagtcagatccctgcactc

SEQ ID NO: 91476 - DNA, 1042 bp, Homo sapiens
taattttgtatttttagtagagacagggtttctccatgttaatcaggctggtctcaaacttccaacctcaggtgatccgcctgccttggcctcccaaagtgctggaattacaggcttgagccactgcgctcagcctctttctttctttttaaatgttctttcattttgccaagaactgggtttctgttccttttccagggcgacatggagtccaatgggaaatacatcaccaaatctggaacccgtgtggaccaccagacaggccccattgtgtggggggagccagggaccaatggccagcatgctttttaccagctcatccaccaaggtaggcccctgtggcctgggaagggtgatgttgggggagggaaaggatcttccagaagagatatctcacttaggtcagtgccctcctctaggccatatggctagctcccatgggctggggtcatgtgggtgaccacagtgcccttcacaggcaccaagatgataccctgtgacttcctcatcccggtccagacccagcaccccatacggaagggtctgcatcacaaggtaagagcccccatctggccccatctggggggtctggctcacattgcacccagacctctgaaaacctggtgcattggttggcaatcacgttagttttctattcctgccgtaacaaatgataacaaacatggaggcttaaaacaacactcttcttttgtggggtggggaggggggacagagtcttgctctgtcgcccaggctggagtgcagtggcacgatcttggctcactgcaaccttcccctcccggcctcaagtgattcttatgcctcagcctcccaagtagctgggactactggcactcaccaccatggccagctaatttttgtagttttggtaaagggggggtttcactatgttggccaggctggtcttgaactcatgacctcaagtaatctacctgcctcggcctccctaagtgctgggattataggcatgagccaccttcctgggctatctgaagagtttctgaagctcaaatatccagca

SEQ ID NO: 91477 - DNA, 1103 bp, Homo sapiens
atcttcgttcagggcatcatctgggacatcaacagctttgaccagtgggggtgagttgctcacttaggggagggccgggaatacctttgtgtcggctcagggatttcagtagcaacgttagagccttcctcataccactcttcccttcccttcccttcttggcagagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactgcagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgc

SEQ ID NO: 91478 - DNA, 1467 bp, Homo sapiens
tgaggtttttagtaagtggataggctgaaggaggaggctccaggaatgccctccagaatcacacctcagaactggccgtgaaggagctgctatgccacctctcctgctgtcaggaagcttaggtgtgatctggtgaactagaggctgtctttgccaccgaaccgttggctccaaagccttgttctgtctgtgtctacacaatggctaccttttgctatgtggtctttctttctacttcactctgtctcaagttcatgtttctctctagtagacctgattagcagacccctaatcatatctgaaaccctagctgctaaggggtctgggaaaggtagttctttcttttcagttcctgcaatacatgaagcacaacagaaagatattggaacggatggttgaataacccctgtactatatctgtcacactcaccccaaaaaggaaagacaagtattttaagtcacctccaacgtgcttttgagtacatagggtctagaaagtttgattggagtgtaccagaggggaaggggatggtgtgaaggctccctctggaaggcgcggcggtgggtggctggagccgaaggattagaataaacctcccaaatgtgctcggacctcattcactgagtatttttccagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaaggtgaggatgtgtgctgctgaggttgagaggtgactggattgggaagcagccacaagagttacccttcagtttcaccacaggacctggggaaactttcaggcagaacttgtatgtaggacctttttgcttcacttccttatcagccaacttgagttagcttgaaaaccctgctctatttataattgccgttaagaaagtgaagatgaacaaacagaagttagagatggcaagtatttatagaagacgcgttcactgactcttaaattttcttttatatttctaatatgtctttatagcagagacaggcaagttagaaaactaccatttgatctgggataataagattggggtgaaaaaatggaaaaaggaaaagaaaaacgccatttgtttattgactcttggctgtggctccagaactggcccaggacctcagagatgctttcagatcctcaattctgtaaaatgagagtgatggtgata

SEQ ID NO: 91479 - DNA, 1035 bp, Homo sapiens
tttcctgttcacatcctttgcctatatttttttgggggtgacacttgttaatttgtaagagctctttacgtatagggacatcagttttctaacctgtaaggaagtcttggctgggagttgaaaccccaggctagaaggcgacccttagactttttaggtctgatggcgggcctatgctggtgtgggaataacaccgccggtctcagctggaggtcgccagccctttgcaagagcctgccggtccccgcgggctgcagcacaccccggcgcgatgtgccctgcctgtgtctgccggaggctgtagtgcgcaggagcggaaaccaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctggtgagggccgggcgcgcgcgcgtgaatggcgggctgtggtgcgggggctgggattcgggggttccggggctccaggggctctgaggctcagggcccggagcccgggaccggagttgcggagcgggggcaggctgagaggctcgggttgtgccccccccgcgggaggagactgttctttgggcacggggcgggcctccgctcgctgggccggctccggacgccgaggaggccgcgggcccccgcctccccggcagcgccaatgtgtggcgcttcgtgggcgtgaagccgcctcttatcctcccttcaaaacaaattcccggctgttaggagatgcgggagaggattgagtccctcgcggatgttgtgactttaattttgaggtccctgtcgtaactccgaagtaacgacgcggggcggaggatggcaatgatagcgaccaacgcgtcccgagcgctggtcacgagcgggtttacacacggaacgcgcaccatct

SEQ ID NO: 91480 - DNA, 1095 bp, Homo sapiens
ttttctatttcttgtagccaccagggtctcactattttgcttaggctggtcttgaaggtctgggctcaagcgattctctcactttgtcctcccaaagtgttgggattacaggtatgagccaccactcccggtgtagagaaatatgttaatatattttcagttagtgtttacctcgacagcacatatagttttaatgaattcacatatttttatggcatccagggagtttcctgaaatattttccaggatgattaaacaaacaaaatataccattctttcaaagtatttttgagaagtttatctctgacattaaatctagattcttacatgcattaaattattctttatcagtttaacaattttggtatggcgattcgaaaaacgctttctccactaatgtagcagatatcaaaagttctggattacaggtgctgagagtagtgatacagctcaaacatacgtaaacgtttgtcatttatctggggtttatgcatttgtagattgatctggatactattgatgtaagcaacctcaacagacagtttttgtttcaaaagaaacatgttggaagatcaaaggcacaggtaactatatttctcataccatttctataacttgatggagcttctatttgtgataccagattaatcctgcctgtcatataggagggaaaaaatgggtgaagctctcatttcagctgagagattgtgaaggataaagatatatcaagtaaaggactaaagattaagccctccttttttgttctaaaaaggaaataatcccgtgatggtgtaactttcatggcctctttatatttaagtttctgatgctttgcttaggatgcaccttgtgttcctacaccccctagaggttgactactgctatgtttgggggctagaggagcgttatgctgctgtcctagttgaaacaagacagttcccccgatctttgtttagtttttttagtgttccttggtgattcagagtcttaaaacatcttttccctttgcctgtctcccaacctgtttggcaaacccccacttgtttctctttttctttcatattttggcttcctcctccaggagtactttcctaa

SEQ ID NO: 91481 - DNA, 1828 bp, Homo sapiens
ttgccattcatgtagaagtgtgtttggtggtacgtgggtcagggggggctctccggttattttataagtataaaagtataattttataagtgtagcttaaccctaatgcaattttctcacatttttggacttctttggtgtttaatataaataaggtactatgtaagtagataacagcattgtggcttccagaagcagatttcagataggaacagaaatattgtagtaattcagtgttgtttatttttccaggttgccaaggaaagtgtactgcagttttacccgaaagctaatatcgttgcctaccatgacagcatcatgaagtatgctatagtgattacattgcaaagttgtataagggttttgtaagccaaatatataagctcaaagtcattcagcttttttaaaaaaaatgatttttctagaattattaaacagtggtggtttctgcttacagagtggcattctttttaccagttcataaatacatggtttgaatgatttagaatggtgagatagtttaatacttttaataaataagttacttggaaatttataaagaccttatatgcttgccttaagtaagaagatattttaaactatgaaatatccttatttatgatgattcagacttttctaaagtgtttgcctttttttgtttaaaagtttccctcccaaaataatctgtagtatgactctgacttctgtaatataacacttggaattgtggtagggcagtagtattgacagtacataaatatatttatctcagtaaagatagagtaaatatataattttggaggagttggagcaaaggaactgtgggccgaaattgtcctttatctatggtggtttagcttgcaagtaaatagtgttaaaaatagtccttgtttgaggtactggaattgaggtacttaacactttctcagggcatttgtatctccggattgtgttttttttgtgtgtgagatagggttttgcgcttattgcccaggctggagtacagtggcatgatcttggctcactgcaacctccgcctcctgggttcaagcgattctcctgtctcagcctcctgagtagttgggattacaggcgcacgccaccacactcagctaatttttgtattttagtaggcggggtttcatcatgttggccaggctggtctcaaactcccgacctcaggtgatccacccgccttggcctcccaaagtgcagggattacaggcgtgagccactgcacccggcctgtatctccggcttgttttttagttttttactctgtgaacctgcctgtagccctataacctccttaccctgtgttgctttcccagtgctgctaaaaacagagaccctaggggcctgaaccctgcctgatcctgatcatgtgaggtgaagtcagaggccaggcagatcctgggaatgtgttctttatgcgttcccaggcacttgctgcccaaagaaggcctagtgggactagtgaagtcatgccatctttctgccagtttgagatctttctcttgtgccctagctggccaaaaaggataggaatttgaaggaaataatttctttaaaatctgcttatgtttggaaagagtcaaaccttactatctatatgacatataatcctgatatcagttttgtttacagttactatgtttttttcagaactgtttattatactgcaaagatcatgtggaaggctagttattttggtgacctttttttattttgttttgtagccctgactataatgtggaatttttccgacagtttatactggttatgaatgctttagataacagaggtgaggttattttaatacttttaa

SEQ ID NO: 91482 - DNA, 1024 bp, Homo sapiens
aacctgactcatcttttttccctagccttaaactactttaatagttccaagttgatattccacattctgccttcatttctatcatgtattatctgctagttatattagaatagtggtgagtttaggaacaccttgaaacagtgttttgtgtaaggtacagcaatagaagagaaatatggcacgttggatttttaagattatgtgtttctgtgggtacttctcctggagtaaatttgtgatataaattctatttgatattttgctaagtgaatgtctcttaaatgtctgtaattaacagttgtattattctggccatagctataagaaaattgtacaaaaaatgaagccagtaagatagttttgagtctgtgtcatcctaattaaagataactaattttttttttcccaaaaactcatactgtttgttttacttccagctgcccgaaaccatgttaatagaatgtgcctggcagctgatgttcctcttattgaaagtggaacagctgggtatcttggacaagtaactactatcaaaaaggtaaagaaaagttttatttttttaacttcccaaatatttatttgagaccttggagcaggaggaaataaactttgtatttatataaaatgaacaggtgaacatccaaaatgtaaggacttttatgcttatataaaacttaaaatgcggggccaggtgcagtggctcatacctgtaatcccagcacttcgggaggccgaggtgggcggatcacctgaggtcaggagtttgagaccagcctggcaagcatggtgaaaccccatctctactaaaaatacaaaaattagctggacatggtggccggcgcctgtaatcccagctacttgggaggctgagccaggcgaatcacttgaacctgagaggcagaggttgcagtaagctgagattgcaccactgccctccagcctgggctacagatcaagcctctgtctcaaaaaacaaacttaaaatgctataaacgtgctcaaaagactatgggcaaggaaatct

SEQ ID NO: 91483 - DNA, 1133 bp, Homo sapiens
tcagttttgttttggtttatttatttatttgtttatttttttgagacagaatttcgctcttgttgcccaggctgcagtgcagtggcgcgatctcagctcgccgcaacctccgtctccctggttcaagcgattctcctgcctcagtctcccgagtagctgggattacaggcgtgcgccaccacgcctggctaattttgtatttttagtagagacggggtttctctatgttggtcaggctggtcttcaactcctgacctcaggtgatccacctgcctcggcctcccaaagtgctgggattataggtgtgagccgccatgcctggcacatatctcagtttttaaaacctcaacacggcttcatttgctattcagatattttttctttcagttcttttaagaagttaaatattgtagttacatttgaagagtcgttttccatgttttgaaactatagaaagagaattataatgtacttaacatttgctggttgcgtctaattttttttggcagcttattcatgttagaaattgtgtctttgtttcttttaactgttaaatgttattcttggaaccttattgaataccattctacaaaagactgttgtgtatgtcagtgcgtattaagttgttgaataagtggaggccttcagtatctgttgacagatcaagacggaagttctctgtctgcattgcagtatgagtctcatgactgcttgccatgtggctaccctcaagaaagcatattggaaggctgagggcatcagaaatggtgtttcagagaaaactctaaatctgctgcaatttatattaaaacagtatttgagagttttgattcttgaacaattagcctggctaatttttgcatttttggtagagatgaggttttgccatgttagccaggctggtctcaaactcctgacctcaggtgatccgcctgccttggcctcccaaagtgctgggattacaggtatgagccaccacgcccggccagacattgctttttatatccttgttactgtgattctgacacaccactgtgtattaagactgaaggtggctgggcatggtggcttacgcctgtaatcccagcactttgggaggccaaggcgggcggatcacctgaggtaaggagttc

SEQ ID NO: 91484 - DNA, 1050 bp, Homo sapiens
agtttacttaatttcaggagattataaggatatggctgtattccccagacccacttagttttgctcaaaaaaaaaaaaaaaacacatataagaaaatggctgcgaataatatttagataacatttacaactttgagaaataatttcttggaaagctgctgtttgtctttccagtagtttttctgtttagtgtgatcaaggtaaactcatatttgacactcaggtgtagtaatttttatttgggcttgtaagtcatgttcactgaaccaggagtcggcgtcctggcacagccttagctatgactggtagattcagttagcttttgtgttagtttatcataaagtaagcattttggagtcactaatattttaaaatttccttgacaacgtaaaacgtagttggaatatagatgaatgaagtgtttatattaccttataatgttgagaaactgccatcatggagtaaatttttctcatatcctgacttcatagggtgtgaccgagtgttatgagtgtcatcctaagccgacccagagaacctttcctggctgtacaattcgtaacacaccttcagaacctatacattgcatcgtttgggcaaagtacttgttcaagtaagagtgtatatttcttggcatgcttttcggtactgatgatggaaaatggagtcatttttatttaattaccttgaagagattgaactcaggatgtttaaatatggtgaagggatgctttagtagctttcttgcagtatttcttaggttaaatgtagctggccgggtgcggtggctcacacctgtaatcccggcactttgggaaactgaggtggtcggatcacctgagcgcaggagtttgagaccagcgtggccagcatggtgaaacacatctctactaaaaatacaaaaattagttggccgtgatggcgagtgcctgtaatcccagctactcgggaggctgaggcaagagaattgcttgaacccaggaggtggaggttggagtgagccgagatcgcgccactgcactccagcttggcaacagagtgagaatttgtc

SEQ ID NO: 91485 - DNA, 1014 bp, Homo sapiens
aggcaaggtggctcacgcccgtagtcccagcattttgggaggctgaagcagctggattgcatgaggtcaggagtttgagaccagcctggccaacatggcaaaaccctgtctctacaaaaaatataaaaattagccaggcatggtggtgcatacctgtagtcccaactacttgtgaggttgagacgggaagatggcttgagcccaagaggtagaagctacagtgagccgagatcttaacactgcactccagcctgggcaacagagtgagactttgtctccaaaaacaagaaagaaagaaactgggatacaaaaagatgctgatgaatgtgttattttcttattccttgaactcagaatgtgttgcatttggggatttccatgagtgactttctttttattcccaaaggtgagtgaaaagagttcagttctacatttattacggttgaaaataaaataatgatcgttttataggggaaccaacggaagccgaagccagagctagagcatctaatgaagatggtgacattaaacgtatttctactaaggaatgggctaaatcaactggatatgatccagttaaactttttaccaaggttagatttactttttttataatcatggatagatgtattgttgtgcatagatgtattgttctagttctgcttgttttaaaatagtccataaaattgaattaagcttctatgtatatgccttgtgatgtcctaataaaatgattgatgcagtcaggatatgcaagttttaaaatgttaccatctacactaaatctatcagtataacatctaaataggaggtaaaatgagaggtggcttgtataccttcttggttgtctttccttctctcactttttacagaacttcttcgttttcctgctgcttctcatcttcactttttttttttttttttttttgagatggagtctcactcttgtcgcccaggctggagtgcagtggcacgatctcggctcactgcagccccgcctcctgggttcaagtg

SEQ ID NO: 91486 - DNA, 1687 bp, Homo sapiens
ttatttttggaggggagggcacattttaaagatatcgcagttcagaagttctgttgtgaagcactttagtttaaaaatctgtatactttgtgtgcatgtccccatgagcttggaggcattgctgactggcatccctaggctcagtgattgtctgtagttgtacatttatttacaactacataatgtacatttatttgtatgattgtgcttcagactgatctttggagctaaatttagggaagcttttggagaggtgacttaggaaggcaggggcagtcggcagttcagggctcctttactctgcattcctcagagcacttctgcatttcgctgttttcaatgtagagattctgttagaacttccttttacaaatgtttttccttttgaaaattgttatgctgctggtatatgacatgtatctttaaatcagatttcatagtgtaatatagatcagcaatgacgttttcttgtatcttatcaattagggattatggggttcatgggatctgtctttcttttgtaagctttttaaagatgacatcaggtatctgttgacaatggacaaactatggcggaaaaggaaacctccagttccgttggactgggctgaagtacaaagtcaaggtaaagaatacattttagtcttggaacacctaagctggaaatatcctcgcgtaaagtctttgtatagccctgttgttgcttgaaaatgatatgtcttcatatattcaaacagtgcaaaaaaatatgaagaacaaaagtcactgaagtcccacacttcagaaatagccactaataacattttcaggagtgttctggtggtccgccctatgtacacagatgcaggcattcgttatacactgcgtaaatggaatcatactattgataaactctcacttgcttttgtcagtcagtatagttaactagtctcttattaacatgtagtgtttttgtattttccctgaaataaagttttgaaattgctatatatttatgtatatcttttttttttttttttttttttttgagaccgtgtctcgctctgttgccaaggctggagcgcagtggcacgatctcagctcaccgcaacctgggttcaagcgattctcccgcctcagcctcccgagtagctgggataacaggtgtgagccactgcgcctagcctatttatgtacacctttgtacccttgtgattatctctttaagatttaatctagaaacacatttttaatgtaaaatttttttaatgtttagaaatgaaaagttttttgaggcatagtcttgctatgttgcccagattagagtgcagtggctgttcacaggctgtcatagcacaaggcatccctggactcctgggctcaagccatcctcctccctcagtctcctgagtagctgggactgtatgcaactgtgcccagcatattttaaaattttaaatgtaggaaaactattgtagtggctgctttctcatcccactcccctttaacactccttgtctctcctttatctgaactgtattaggattaatttatgcacagcagtatagcacccattgaaacttaaaagatcccgggagacttgggatatcattttggagcagttctcaacaatcagggatagttatcaaacagatttaattatgactctagtagtgtccgcttactgagttctcattctcactaggtg

SEQ ID NO: 91487 - DNA, 1148 bp, Homo sapiens
ggtactgaggtggtcttgtacctttcctatctcaggtttaacagtttttttttttttttttttttttttttttgagacagagtcttgctctgtcgcccaggctggagtgcagtggcgcgatcttggctcactgcaagctccgcctcccgggttcgcgccattctcctgcctcagcctcctgagtagctgggactacaggcgcccgccaccatgcctgcatattttttgtatttttagtagagacggggtttcaccatgttagccaggatggtctcgatctcctgacctcatgatccgtctgcctcggcctcccaaagtgctgggattacaggcgtgagccaccgtgcctggccccatgataattattttaatggaatttatttcatatttgatttcttaatggtcggggattgaacttgttaaacagagcacagtagaggaatgatgttaattagtgaaatttctaatatatatatttttttctttaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggttcgttttgacaatgtgtggcaagtacttacatgtcaaaagtgtgttttagttcttgagatgtaatagaagctagtcattttttgaatatttactagattttgaggaaatatattgatttggcttggatattttcagctctaattgctgtatggagctgaattttctgtacatgaattcaagcaatatcataaaacttcatttgggattctagtgatgtgttcagggtttataattatgttgactagaaaaataacgtgaatatattaaagtgaaatgtttcttgtgtagagtagatgtattcatagaagtcataaaatcatttggagaaaacatctcattggcctgatttgcccttgaaaatagtaagattgtctttgaattgaaatagttattactatttcagaggtctgaaagacagagctcttgatacaaaaatgagatgtaattattcttagaagttaaaatcatatttaatagtactctgcagtta

SEQ ID NO: 91488 - DNA, 1026 bp, Homo sapiens
tcaggcaatctgcttgcctcaacctactaaattgcttgagactacaggcatgagccaccatgcccagcctaaaacagttttcttaaattgctcgtcttttggcctggattctgtgtttgtccagcaaccttctctttactgatgaatggaaccaggaaagggttgccattgtcagtgagtggaattgagattccggtgtatacaactgagtctccggtgcctttgtttaggctggagtgagttcctagaagctggtgattcttggtgttcttgtcagactcattactggaccagaggagctgatgatgagaccccaccccctacttaacccacctccatgctactgtgaggtcctagctgactggtctttccctcagcaacctcttgttctagtcgaaagtctatagtattataaacacgtgaaagtattgttctgaaagtaatgcttcaaaatagtcaatttgtggagaaacttgttaaattgtttaaattattggcaggatgacccatctgcaatggattttgtcacctctgctgcaaacctcaggatgcatattttcagtatgaatatgaagagtagatttgatatcaaatgtaagttatttgtactaaagttgtatcactaaaaccttgaagttgttttttaaacagtgaaacatactcatccttttttttttttcccagcaatggcagggaacattattcctgctattgctactactaatgcagtaattgctgggttgatagtattggaaggattgaagattttatcaggaaaaatagaccagtgcagaacagtgagtatttctgtttgcatttttatgcaaccccccttaaaaaaatcattaattaaaagtacattaaacagataatttttaaaatgaaaacaataaaattggtttaaagcaatggaaaagtaatttttctggttaccaagtgagtgtgtgtttaagcttcctggaaattgcaacaaaaaggaaaaattaagaagttgcttttgcttttaacatttccaattttactgaa

SEQ ID NO: 91489 - DNA, 1050 bp, Homo sapiens
ctctgtccagattttgggattgattgattgattgattgattgactggagacagagtcctaaaaattttttttgctgctctgttgcctagcaggctggagtgcagtggtacagtcacacgcctcactgtgtaactcctgggcttcaggaatcaatccttccctggcctcccaaagtgctgagattatagatgtgagctactgtgcctgccttcctcctcctataaggacatcagtcagatcagattagagcccaccctacttgccccatttaaatttaatcattcctttaaaaagtcttatctccaaatacaatcagattctgagatactggggattagggtttcaacctttggattttggtgaacgggacacaaatcagcccataacagaggtttagctttttaaaaaatcaacctgactgctctatgaagatgtaactgaagtatctaaattattcacgtttcctagctaataatcacaagaagttgtcagaatttggaattagaaatggcagccggcttcaagcagatgacttcctccaggactatactttattgatcaacatccttcataggtaagagctattagtattttaattgtaagaaattatttgaatatataaactttagacaaaatgaaggaaaagtgttttcttatccttaaaccctgctgttcatttgaaactgtatagtatatttggttgagttggtcactgagttccgtgatgtttgacctacagaaaaatttgaggattcagaaattggcggggtgtggcggatcacctgaggtcaggagttcgagaccaacctggccaacacggtgaaaccccgtctctgctaaaaatgcaaaaattagccgggcatagtggcaggcgcctgtagtcccagctacttgggaggctaaggtaggagaatcccttgaacccgagaggtggaggttgcagtcagccgggatcgcgccattgcactccaacctgggagacagagtgagactccaacttaaaaaaaaaaaaaagaaaaccagaaataaaagaaataagcaaaaaatgtt

SEQ ID NO: 91490 - DNA, 2352 bp, Homo sapiens
ctgcactccatccagcctgggtgacagagcgaggcttccggctccaaacaaacaagtcatttaagactgggggaaattcttatggaaatttcttacagaaaataagaacactttgttattttttgttaattggtttttaacagtttgaaatgatagtttactagtgtgcaaagtcagcctatgtagtagcaggttggggttttgtatgcttgttttaaggagcaataaatccatgcatctgactattttgagtgaacaggtgcttgttaagtatggaatttaggcatgttagagtttccttgtcaccagtatgacttgggtatagtcctttcccctggattttcagtgctggtgcttggtatttttccaaataactgattgtttactgtattctgatttgaatatttactcctctccctttcttcctttagttaggaaactaaaggttaccagattttgacttctttgttttcatttctttgaccctatgtctgtggcattctttggaatatgtttactcttggctctaatgttctcttgagaattttggagacgaacattcagattatggcctgggtcattggttcataacctgttttttcccccctcactgaaattagaaaggtccgtcatcttcctttgaggaagagactatctggtagattttccaaaatcataatttgaaatgtacatttattgattctctactgtgggtaggtttccaaggttacagccatgagtaagataggtattctgcctttgattttgttggacgaggagataaaaccacctttagtatcagttctgcattggggatggttcctggcttcatcctctgctactatgtaagcttgggaagtcattcactgagtttcctttcctggaaagcagatactcatgtgatcttctttatagggttgtgatgattaaatgagttgtcatatgcacagtgctcagaacagttcctggcacattgtaagtgctgtattgttgttgctattgttaccactactaccattattagaatatgtaccctctgcttttctattggagaatgtggaggtagaatcaaggatgtgtaatgagtactttgagttacataatgcttgtcacaattttttgttttgattagaaaataaataggttcttatataaaacatttaaaacagtatggaaatacgtaatgtgtaaagtgaaaatgcagccattcttaagtctggtgtgtattagaagagtcagctttcaattatagaaaatacaggtgagcacaggtaactcccacgcttttacccattttctttttcccttttttctgaaataagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcggtcgggcacggtggctcatgcctgtaatcccagcactttggaaggctgaggcaggtggatcacctgaggtcagtagttcaagaccaacctggtcaa

SEQ ID NO: 91491 - DNA, 1048 bp, Homo sapiens
ggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcg

SEQ ID NO: 91492 - DNA, 1994 bp, Homo sapiens
tcttttttttttttctttcttcttttttttttttttttgagacagggtcttcctctgtcgccgagactggagtgcagcggcgcgtcctcggcttactgtagccgtcgcctctcaagctgaagcgatcctctcgcctcagcctcccgagaagctgggactacaggtgcacaccaccatgcccagcttttcttcttcttactttttttttttttttttttttgtagagacagagtctccctatgttgcccaggctggtcttaaactcctgggctcaagcgatccgccctcctcggcctcccaaggtgctaggattacaggcttgagccagtgcgcccggcctgatcttttcttctttgcgtttggtgctctcattctatctgatcctttcatgcttcgtgatgagcagaaaggggtgcttccccgtctgccccgccacggtatgggtgtggacagcaaccgggagatggagtggcccaggtaccaccggataccgcctgacccaggctttggtgatggtagcggctggagagggagactgtgtgagggaagaaaagcccactttgcgggagaggggaaccgtgccagtcacacggggctgccctcgcccggactgtgctgtggacataggatgtttcctaaaggaatcctgctgcaggtgcatctgcaaagcccagcagcctcacagcctccacttcccagtgtggcccaggccccctgatctctagttcttgggacagctcttggggtgagattgtgagcggggcagaggtatactgtggggcctggggcgagaacttcccaacccgccttctgtattaagcacctggctttggtggatggatggtcaccatgcctgggaccgtggctgtcctggggtttgtgtctttgagcgttcaatggtgtcagcagctcacggctgccctgaactggatcttttttttttttttttttttttttttttgagacggaatctcgctctgtcgccaggctggagtgcagtggcgtgatcttggctcactgcaacctccgactccctggttcaagcgattctcctgcctcagcctccccagtagctgggattacaggcatgcgccaccacgcccagctaatttttgtatttttagtagaggcggggtttcaccatgttggccaggatggtcttgatctcctgacctcatgatccgcctgcctcagcctcccaaaatgttgggattacaggcgtgagccaccgtgcccggccctgaactggatcttgaggggtgaggagtctgtcagtgaggggccaggtgggggcattccagagagagggaagaatgagcagaggaggccaggcgggatgagagattgccccgctcttccccctggggttgcagcccagagggctcaggtggtcgagggcatatgtgggctaagaggaggtgcgcctgctttgggatggagagcgcctcccatctgtgaggtcatggtgagactctgtggctgggcaggtctcgtggcgcctgttggatggcctgggagcagggagatgtgccaggagctgtcatctcccgtgtcaggcaggtgccaggaagagaggctggggctgagttttgaagggcatgctttccagtgccctctgcaggggagagtgcccatttcccggcccctgtgtactgcagagcccgggggaggggggtgttctgtagacacccctgaatctttatatgatataggggtggctgaggtcccaggcaggtaatgtggagatgatacaagaaggtagggtgtggtggcacattttttttctgaggagctgctaggccgggtgcggtggctcacacctgtaatcccagcactttgggaggctgaggtgggaggagcacttgaacccaggagttccaggctgcaacgagctatgatcgtgccactgcactctggcctggatgacagagtgagatcctgtcttttctttaaaaaaaaaaaaaaaaaaaagctgctcagatcgggctgttgta

SEQ ID NO: 91493 - DNA, 1113 bp, Homo sapiens
gactgtgggaggtttgtcatcctcaccacgcaggtcttcctgtcaccactgacaccctaagcctttgtcagtttgttttttttttttttttgagacagagttttgctcttgttgcccagggtagagttcaatggtgagatctcagctcaccgcaacctccgcctcccaggttcaagtgattctcctggctcagccttccaagtagctgggattagaggtgcccaccaccacacctggctaatattttgtatttttggtagagacagggtttcactgtgttaaccaggatggtctcatctcctgacctcgtgatctgcccaccttggcctcccaaagtgctgggattacaggcgtgagccaccgcgcctggccgcctttgtcagtttcctctcttattctctcaacaaccttcctccctcctgggacccctacctttgcttctgacttcccttggaatcttgaggtcagcagttgtagtctgtcttcaccaccgtcctgccccttccctgtaggtgctccagtccatgtgggtctgactctcctgccgtctgagaggacaagggtccttccatcaccaacctccacctcctgcaccttcagttctcctcttttcattggccccttccctttgtttctttttaattttttttttttagagacaggatctagctctgttgccaggctggagtgcagtggtgcgatcacagctcactgcagcctgaactcctggcctcaagtgatcctcctgtctcagactcccaaagtgctgagattacaggcatgagccaccaagcccagtccctgcctgcttttttttttttttttttttgagacggagtcttgctccgtcacccaggctggagtgcagtggtgtgatctcggctcactgcaacctccgcctcccagatgcaagcgattctcccacctcagcctcccaagcaactgggattagtgtccaccaccacgcccggctaatttttatatttttagtagagatgaggtttcaccatgttggccaggctggtctcaaactcctggcctcaagtgatcaaccctcctcggcctccgaaagtgttgggattacaggcgtgagccactgcgcctggcccctgc

SEQ ID NO: 91494 - DNA, 1022 bp, Homo sapiens
ccccctgtgccctgcagcctcagggtaggccgtgggtcaccaggctggagagggcccctgccttggccaggggtgcgaggtgacccggctgcattgctgggtgggagctgctgtctgttgttcaggggcctggcccccgccctcccccccgaccccgacctcgcaaagcgcactcccgggcagggtgtggtctggaaggcggggctggcggggacatgggtgttcctgcatctcctagcgcagttcctgctggtgggtggaagggtgcctggtttaggcggggtcccaggagggggtgaggggtgacacccttggggagggggcctgcaaagggcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttctaagatcttggaccagccttgttatttttaaagcaaatgccggcaaactcacaagtgtctagtttgtctgttacggagctggttttcaggtggtaagaaccttgtggtttcaggacttttgtcctgaaattcctctaaaacttcgccacgcgtgtccacctttcagactttagggtagtgtggggttccgtgtgtgtccgggtgttaagggcggtcgccccatgaaatgcagtgtggaggtccctccgtgctccccgggacacactgacgggaatgtggggtctggacatgggaggccctggtcctgatgcggaatccccaggggttcaggggacatctggactgaagtcactcgcccctg

SEQ ID NO: 91495 - DNA, 1030 bp, Homo sapiens
ttcacggaccagggagaggggcaggagttgtgcacgaaacgagatggagctgcatgaggtgggagaagaggaaaccgtgacatcgcagcggccaagggagccttccaggaggaagaagcgtctcccagggtcagggcttctaagagcagttggggaagacgaggactggaatttggatttggccacctgggggtgttttctgaacttggaggagcattcttgtgcccctacgatgcttgcagcagctaaggactccagacctgcagagtctgtcctgagacaggtcagacctcggcggtgggacgggaaaggggaactctctgtctagagacttgcgctccgatgtagttggaggtgctacactgtggctggccacagaccaacacgagcaatggaccacgagaggcctggggtagttagcctttccttcctgtgcagccaagaacggaaggatgagaggggttctttctgcctcctccttggcatgagcacctccacctccatgcccactctgtcctttctcccaggagcagctggccggagagtaacacgactccagccggacatggtcatgactatttcagcctgcaaggtcatgactctctggcccacctaggactcctaggggaaaggaagtgcctggtctaccgcccttcccctgcaagtctgaatgctgtgtggacagaggaggaggacccaataaggtaggggtattggagtactcgggtgcctgggaagatccaagcccggcctatagggtcaaggtcttttccaaaacaggggaaaccctttctggttcccgaaggtcctcccttccctattcgctgaacaggtgggtgccaagaagcccctgtcttgaggacagagagactgcggtctggcctccccagacccaggcagcctctaacatcacagccacagagcagaaactggcctggcttcctcccaggcccagaaggccccagctggccacctccctttgtttgtcttgggaggggcaactgctaagcaaacagggaaggggaatccc

SEQ ID NO: 91496 - DNA, 1384 bp, Homo sapiens
atgcgtgaggcctaatgagggtaagtgtggtttcttacaacttctgtggcattatgtgtatttctaagtgcgtgctggaagcccatgtgaaaggtatttcctgctgtagatcacaggccaaaaaaacaaaaaaaaaaaaaaaagaagaagaagaaaaacaaagaaaaaaagaaagtttaaacaaaacttctgaaaagaaacactatctctggtacaaggagacaggaaatgggaggttcagggccatagggggaagaggaaagaactctaccgaccctgaatagaacaagcagccactgtggtttcttccaacaagggacactccataagcgttaaagtttaggaagcagagctttgtgcatggatgtggagaaatcgcagaaacaatgataatgggggacagcaagttgcaaatgaaacagagggagcctaatcgtgtatctttttaaaaagatactggataataggtgatagtgttggtggatgcctcctgatgtagaaaaaggacagaaaagtacacagggtccaggcgtgctggctcatgcctgtaatcccagcactttgggaggccgaggcgggcagattaacctgagatcaggagttcaagaccatcctgaccaacacagtgaaaccccatctctactaaaaatacaaaaattagccaggcatggtggcgcatgcctgtaatcccagctattcaggaagttggggcaagagaatcgcttgaaccgaggaggtggaggctgcagtgagccaagatcgagccactgcaccactccagcctgagcgacagagcaagaccttgtctcaaaaaaaaaaaaaaaaaaaagcgcaggaaggaaacacaccaactgcatggcaggcagaaggctccttggggggcacgggaagggaaaggagggatggggagccaggcctttggttgtaagtgtaatcatttatttcttttaaaaaaaggacctgaagcaaaatggcaaaatgtccacatctattctatataggtacaggggacatagaggactgttatattttcttcctttttttttttttttttttttttgagatggagtcttgctctgttgtccaggctggagcgcagtggtgcgatcctggctcactgcaacttccacctcccgggttcaagcaattctcctgcctcagcttcctgggtagctgggattacaggtgcaagccactacacctggctaatttttttgtatttttgatagagatggggtttcactctgttggccaggctggtctcgaactcctgataggtgatccaccctccttggcctcccaaagtgctgggattacaggcgtgacccaacgcgcctgacctgaaataaatattatttaattaaaaaactaaaagcattacact

SEQ ID NO: 91497 - DNA, 2882 bp, Homo sapiens
ggagacaggatcgggaccagcccaggcccacaggccgcggagccctgggcgcgccgggagtaggcagccccctcctgcctgggccccctcccaccgtccttggctgttgcgggtctcggggctgccgggggtgggggcttcctgcgtctctccaggaccgcgtgcttgaggtcatggagggcggggggtcctgtgtgctcggaattgacttcttactccccttccggtccaggtgggcgcatgtgcttccgactgtgaattgtcttgcaagtgtgtgtacgtgtgtctggggctgctagcctgcagcagctttgggcctctgatagagttcctgcgtgtaacttaaccactaattctgaccgcggctctgtgtgtcactgtaagttacctgtgtgtgtctggggctccaaatctgtggctgtgagcagctggttgtgtgcgtgttgtgtctcattccatctgtagctccctgtgcaaatataaattacccctgtgtgtctgagtgtgacgttggagtgtttgtacatgtgtctggagttaccgtgtgtagcagctctgatccttcttgggctgtgtgtgttttaccattaattctatctgtagctccaagcgttgctgtaagttaccagtgtgcgtcccattgtgacttagtggtgtgtgtacaagtgtgcctggggctctgggttctaccatgaccctctgtgcctgcatatgcctgtaatttagctctgaaacgctcttctttttttttttttcttttgaaatagagtctggctctgtcgcccaggctagagtgcagtggcacgatctcggcccactgcaacctcctcctgctgggttcaagcaattctcctgcctcagcctcctgagtagctgggattacaggcgtgtgccaccacgcctggctaagttttgtatttttagtagagatggggtttcaccatgttggccaggctgatctcgaactcctgacctcaggtgatccacccacctcggcctcccaaagtgctgggattacaggcttaagccatcgcgcctggcttgaaactctcatttagctctgtgtgccaatgtaagttacatttgtgacattgttgtgtgtctggggctctgtgagtgtggctgtaacttaatttgattccatctttgtgtgaacattcccttgtgtattcctttgtgacagtattgagtggtgcctaggcctctctgtgtacagctgagaccctctgtggttttgtgtgtgtgtgaacagtgtgagaccccttgtggctctctgtaggcttggaaccctcccttctaagaccctgggagtacccagggcactttggaggcaataatgataactgacgttgtccacctgttacagttagtatagcatgtgccacgcattattccactacctggccactgtgtcctcgagatccacgccctgctcggctgcattattcccaagtcctgcttgactgtgagcatcagggctctccaccagctacagccactgacacctccaccccttgccactttactttttcttttcctttttctctttcttttagacgcagtctcgctctgtcgcccaggctggactgcagtggcacgatctcggctcactgcaacctctgcctcctgggttcaagcgattcttctgcctcagcctccctagtagctgggattacaggtgcgtgccaccacacctggctaatttttgtatttttagtagagatggggtttcaccatgttggccaggctggtctcaaactcctaacctcaggtgatccacccgcctcggcctcccaaagtgctgggattacaggcatcagccactgcgcccagccccttgccactttagaagtagccttttctctgtcttccctgccagatggtgagcccagtgcgggcacgggaacaactcagtggggatgtgttggctgaccgtgggacctgatttacctgggactatgtatgtgtcacctggggtcttttgggactggtctttcactgtatggctgtctttggctctttgctgagacttcctcgtggctatgtgtgtgaatataatttatccgggactttctgtgggttgctgtatgtttctgtgaccctctgcagctctgtgtctgtgtgcacacatgcatgtgtctggataacttttctgggaaattgccatgtgactgtagcagactagcaatgctgcaggtgtgtgtgtgtgtgtgtgtgtgtgtgtgtgtaattactctgtggctctctgtagcatacctatgatgctgttgctctgtgcgtgtgtgtgtgtgtgtgtgtgtgtgtgtgtgtgtgcatatgagagagagagagaggaaagagactccttgcaattgtagggaaatgcagtttacccctgacacctactgtgtgacaatcattgagtttcccttttatgcacacctgtggatgcatccgcccttttctgaccagaggctgctctgggtccactggggcctaggaagttggaggtcaggtgtctgcggaagcaaaacaacatcccttccgagtctcctcgcccctataacagtcccccaggctcctcccttcactctgccttcagctatcctggttgggcagccgcagggtccgcccttgagtacttcctctttgcccagccctggagcaaaaactgggggcgtggtccctgccctgtctgtgtgccttgagcctctcttcaggattccggcccccaggccctgcccctagatctgtggctgcgggaaagtagggcaggtctgtgtttcaggctagagggctgagaaaagcaggcaggggaggatgtggtcctgctgcttaggagtctctccctgctcaccagtgctgtctgggtgaagccaaactcctgactagggtcaccaggc

SEQ ID NO: 91498 - DNA, 2027 bp, Homo sapiens
agagggaccacccaggaggaccctgatggactcagatgatcccaggctccctcccactacaggtatgggcagggatgggaacagggagaccagggaggaggctgctgggatggcccaggggaaaagcagtggcctgggccactggctgtttaattattttattcacgtattttattccacaaatttattttacaagtgttacatgagtgcctaccctgcatcctgtcccgcattgtgctggggacagagcagtgacccacagacccgtgaaggacttggacctgtcatcagacagtgacggcccagagtagtccaggatgggagctgcccaggggactgtggggtcacgcatgagccaaagtcctgaaggacaaataaggatttgctaggcaaagaagaactacgatctggacagacagaatggcatatgttaaggcttggaggtaagagagacaactttgagttgccccaggtggtggagggaatcccacctgcaccccagaatacatcaaggcccctaaatgggaatcctgccttgaaataaaccaagcccatggccaggtgcagtggctcacagctgtaatctcctagcactttgggatgctgaggcaggtggattgcctgagctcaggagttcgagaccagcaacgtggtggaaccctgtctctactaaaatacaaaaaattagctgggcatggtggtgggtgcctgtaatcccagctactgcggaggctgaggcaggagaatcacttgaacctgggaggcgcaggttgcactgagctgagatagtgccactgcactccagcctgggtgacagcgcgactctttgtctccaaaaaataaagaaaaaagaaagaaaccaggcccgtatcctatggcaagtggtttgccgctttgagctagtttcctcctctgtaaagcagggatggtgaatcatatcaaaggcaccggcttgagaaataatacggttaatcatacggagagcttgacatatttcctgataaggagtcaacaaagaatgtccttttaaagttcccaacgccatccccacagtccttattacagttcgtgtttgcacagtgaagttgggagtgtcctgtttgttcagtgtctgcctccccaccagaaggctcattccccaagggcaggggccatgtcctgcgggctctactgatgccagctccagccagcgtgcagattattcatttagcctctggtggttattgagcattcactatgtgcctagagttttgggctctagggacccggtggtaaccaagacctgaaggtcacagtctgggtagacagtaaacaaacagtaaacaagcaggacactccagatagcctggggtgtggcgacagaggtgcctgccttaggctggatgatgcggaaggagagcatttgagctgaaggggacagagctggtgatgccggggccatggaaggacattcaggcggagggactacaaatgtggaggccttggcgtgggaatgagattggagagcttagggacaaaagcaggctgggatggccaggggagaggaaggacagggagagggaggacatgaggtcagtgaggttccagggccaaatcaccacaccaaggtgaggtctttgcttttacctggagtgaggtgcacccagggcagggctcagacctgactcagatggtcacaggtctcctctggttgtaggacaccagtgaagaggctgctggggtgtccaggctggaggtgatggaggctggagcagggagaaatgggtataataaaaataacggatgctgggtgcggtggctcacgcctgtaatcccagaattttgggaggccgaggtgggcggataacctgaggtcaggaaggagttcaagaccagcctggccaacatggtgaaaccctgtctctacaaaaaatgcaaaaattagcggggcatgatggcgggtgcctatgatcccagctactggggaggctggggcggaagaatcgcttgaacctgggaggtggaggttgcagtgagtcgagatcatg

SEQ ID NO: 91499 - DNA, 1419 bp, Homo sapiens
ctttgcagaagatgcagagctggtacagtgtaagtgtctgggcaaggggcttgctggagggctgggaggaccgggtgctgggccaggagccccaggctgcaacagtcaaggagtgcgtgctgagatggagtgggtgcagacctagggtcacgttctatgctattatttatgtgctgtgtgaccttgggtgagttacttaacctctctgggcctctctctgtccttgagaaacagccccaccttacaaggctgaagggaacattgaatgagtcagtgatgctggtgggtgcttggtacggggcccggcttacataagaaatctgtaaatggcagctgtcattgtggctactggtgtgttgtgtgcgttggaatctgtcagggacttaagagactgagggggttccaggagctttgtggggcagcattgggagtgtgaacccccatccaggttctcacctctcaaacttcctcagatgctgagccccacttataagcagcgtaatgaggacttccggaaactgttcagcaaactccccgaagcagaacgcctcattgtgggtgagtcccggacccccagtcccagctcctagcccagccctgtgactctccgccagcccgcgggcgccggctgagcctcgtgacttgggtgtcctcctgtctctccccgcccctctcagattactcctgcgccctgcagcgtgagatcctgctccagggccgcctctacctctctgagaactggatctgcttctacagcaacatcttccgctgggagaccacggtgagcccgcagcggggcagggtacaggggcgggggcccccatggccaggccccaccccgctcctattgaccctcctgctgtcctcagatctccatccagctgaaggaagtgacatgtctgaagaaggaaaagacggccaagctgatccccaacgccatccagatctgcacggagagcgagaaggtgacggaggacccggtgacgggaccacgcggtcccccgctcagcaggccgcctcccccaaacatgcaaagccccatttgttctgcaccctgagttctctccgagctgtccccttctctctgttctcccggcccaggcgcccatcacccctgacctgatccccgcaccagcctctcctctctttccctgcaacctgttacctcacacagctgctcaggaacagcagaaatagtaaaactcttccatgtatgtggcacctcagccgcccctcccttcgtaagtctccccgatgttgtgtcctgtccctgtcattgtggcctcatgtccgttggttgcaagatggctttctcaccagcggtccaacaagaagggggacaggtgtgggggacacttcccagcagacttctctttgtgttttgttggttaaaagtggatctggccaggtgtagtggct

SEQ ID NO: 91500 - DNA, 1050 bp, Homo sapiens
ctgtagtcccagctactcactcaggaggctgagacaggaggatggcttgagcccaggaggttgaggctgcagtgagccgtgatcatgccactgcactccagcctgggtgacaaagccagaccctgtctcaaaaaaaaaaaaaaaaaaaggatcaactgaccattcttagtggcaaaggaggctgggcaagttccctgggctccccccatcacatcccagcccctctgggctgaccctgtctagagatgcatctgtcccctccttggactgggagctccaaggacagggccaggggtcgtctccccatcccagtgattctggaattgtccagggcagggccgggcgcaggacagacgttttgtggaactaatgcaggggtgaattagtggattcatggggccaaagatgtggcgtcagcgcagatgagggtggcgcttccccacctctgtcctggtcgctccccaacctgctcacacctctctctctctctctccctgacagcatttcttcacttcctttggggcccgtgaccgctgcttcctcctcatcttccgcctctggcagaatgcactgcttgaaaaggtgggcctgggtgaggcccgggtggggatggggggtttccagggggaccatggagccagggaccccagaacttgcggagctggaggcagccctggctcttctccatgggcaccaggcccagtgcccctgcagctcctccctgggccccacctgaccccgaagctgagtctctggcaaagggacatgaattggtgtaaaccgtcgtaattcttccctggggctgggaatgattttcaccctgaaggacatccaggttccactggcagcgggggagtgtggatagaggctgggaggtcatcacaggatgccggctatggctggtccacagcacctcagagagccccagccccatcctccggctgagcggcactcacgcgctgccttctcagaggctccgatgtccctggagcaggcaggagtgctgagggtcccattcagcatcctgagagagggacagcgcacagtcag

SEQ ID NO: 91501 - DNA, 1043 bp, Homo sapiens
cgggtgtgtggtggactccgaggtgctgacgcagggcatcccctaccaggactacttctacactgcccaccgctactgcatcctgggtctggcccggaacaaggcgcggctccggtgagtggtggctgggcccctccacccgatgccctggtggccccagggcctcctgtccactcctcaagtcagcagcagagccttggttcccaccctggtggaggaacagaagcgtggggttcctgaggcccttgtcctccgaatagtggagggtagaggaagagtggccctgggatggctcctcccatctacagagggtgtttgagcctcaagactctgaggatacagcaaagccaggcaatatcacctctctcagggagctcatattctagtggggaattggacaatagagaaatgatcaggaaaatctgcagaacattcactggcagttaggcctatggagaaaaatgaggaaaacacggcaggctaaagaagcagggtgtggaggcttttacacccgacacgctggtcagggaagggcctactgggaaagaaatgtttcaccaagaacctgaaggagctgagagcaactcatttgggacagcaggtgcaaaggccctgaggcaggggtgtgggcaatggctggagtggagtaagattgagtgagtaggagctgagattaaagtggtgaaccggggcccggcacagtggctcacacctgtaatcccagcactttgggaggctgaggcaggagtatcacttgagcccaggagttcaagagtagcctgggtaacgtacggaagccctgtctctacaaaaacaattttttttaaattagccagggtccaggtgcagtggcttacgcctgtaatcccagcaatttgggaggctgaggtgggcggatcacttgaggtcaggggttcgagaccagcctggccaacatggtgaaacccatctctactaaaaatacaaaaattagtcgggggtagtgatgcacgtctgtaatccctactacttgggaggctaaggcacaagaatcacttgaacct

SEQ ID NO: 91502 - DNA, 1558 bp, Homo sapiens
tgctcacagtagatgtagactgagcacttacctgcagctgggctgttctaggttttaagcatgactgctttatccccacagccagcctttgagaagatgctcttgttatcccagtttttttgagacagtctcgatctgtcacccaggctggcgtgcagtggtgcgacctctgccttccaggttaaagcgattctcgtgcctcagcttcccaggtagctgggattacaggcacccgccaccacgcctggctaatttttgtatttttagtagagacgggctttcaccatgttggccaggctggtcttgaactcctgaccttaagtgatccaccggtctcagcctcccaaagtgctgagattacacgcatgaggcactgtgcccggccgttatcccggttttatacataggtaggcgatatgaggcatccagaggttcgaggagctcaggagcttgcccgaggtcacagagtgggtaatggtgacagctaacatgtgctgagcacttagtgtacaccaggttctcagtgctcttcagaaccctgaaataatcctgtggagcagatgtgttatagacccgtatttcaaatgaggggattttggctcagggtggttacgggacttgcctgaggttaactgaggtaacaagcagcagagccaggatttgaacctaggccatcggggtcacaggcacacactaagccccttcctctgctgcctctgagaagttaaactgggtgcagcatggctgtgctcttttcaccaagggaccctggggtggggcagtatggcctctagaccgtcctcagtttctcaatggcaaggtgggggtgggcgacatcaccccccagcctccagcgttcacccccgaccctgctcacctcctccccgcagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtggctgtggctgtgcctgtggggccctgggagtgggtgggagcctcctgttgcactcagatcctgccatggtggggaggggacctctgtctgtgttctggggccatagtcactgaaacgatctggaattcccgcagcatcttacacaagctttacatcatctgaggtcaacgcaggaactccggggacagaccgtggtagctggagttcaaatcctgcttcctagcagtggtgtaaatgcagcaggtca

SEQ ID NO: 91503 - DNA, 1084 bp, Homo sapiens
ctttaaactatgtgtgtattttgcattatatatcggtgagggaaccataaaattctgtgacgtgctggagagttggggtctccagctgctggaatcaggctgccctgtctctgctggaggagtgtgtctggtggctgggaaagaacggcagagaatgatagcctagaggccagatggggcttgggaggatgactgaggaacgtgtgtgtgctcgtgtgcatcttggctagaggcaaaagcggggtctggttgactccaggcgtgatcctagccccccacccctgtgccctccctgcctgaggtcaaggtgtctgagcccatctgtgtgccatctgtgtttgtgggtgtcagggcaggggacagaatcagggtcaggtaagggaagagaggcccaggcagtgacaccttcccctccctggctacccctagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaaggtgagtcgggtgctgcctgcccctttaccgtcacccaccggagagccagatggagggacagatggcaggcagtggacaggacaggctggctctgtgcctggccagccaaccgcccacagcagcgggctgagggggaggggagcagcccctcctgcccactccagctctggcctctgtttctctccagcccacggagaggtcaaagcatgcctgtcccccacagacgctccgggtacagaacccagctctgtcacctgtgctgtatgacctctggcaggtgccttctgtctctgagccaaagggttgtcctgggcttgcccgggataataatccgatgtgtttctcggggtgtggtttgagccattcttccatcatggggttcatgaggattgagcagctgcaggcacacgcctg

SEQ ID NO: 91504 - DNA, 1155 bp, Homo sapiens
tgtctttaaaaaaaaaaagtccttgagtcatgattccagatgcaatcgcagatgtgggggctgcaaccctccgatgggctggggttcacgtctacaccacatggctggagcacaggccaggaggggctccggctggggaagcatgtggggagcctggctgtgggacccaggcggccccgggccctgtcgccctgcagtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtggtgaggagggcagcgggcaggtggggcaacacctcagacccccaaggcactccctctccccgttttccttccacctgtcttaactggtctctatttcctttctttctgtgtctccaatcccatctctcccagtgattgccccagaggccgtttcttggccgccatctgccaaggtgagatcctaaaactcagaaccctctcctttaggcccttggggaggccacgtcccctcaagctccccaggatggggccatgtactttcagaccccctagggcagggccaagcctgggctctggggacctgggctccagtcccctgtcgccgccccctgctgacccttgtcccacagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagtgagtgccccccaatggcgctgatgatggggaggcagaggagcggagagacagtggggaggagggcggattgtgcccaggcaggtggccaccctccacccctttccctggtaggcgg

SEQ ID NO: 91505 - DNA, 1025 bp, Homo sapiens
gccaggactttgcttagactcgctcctcccggcagggcgcacctaggcgggtccatcgccagccggggagaggggtttgggcagggagggaacaggtgcgcggcgggacccgccctatctcaacaggtgaatcgctccaagtgggtctcggttgcatggatctcggtgcgcttggtttggccggagcagatgggggccggaagggacctgtggtccgcaggcgccctcccagcgggccagtcacttggttcgggccctgggggacggagcgcacctgggtcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacaggtacggggcacggggcctctgacgctgcggaacgccggagggaactgtagagggggatggatggagttggaggcggcgggaagcgggaagcgggggtctcagaggctgggaccttccgatcccctgggtcttgggcgatctgttgcgcgcgggagtgagaggaattccccatttgtgccggggagcgctccccgcgcccttatctggaagatagcaggaagtgaaactccctggacggtgagacccggagcggcagggagaatggaactc

SEQ ID NO: 91506 - DNA, 1046 bp, Homo sapiens
atggagatattgtgggggctttagtccctccatggcaaagcagttcaggcaaacaactccatggttttccctccaaattcaaaaggccccgggtaacctggaatccttcgtagtcggttttgaagtggggccttgggcgctgggggcatcaacatggccatctgggcttgcctgcccaggccacacagaggccccttgttgtgggtgaatggcaaagggaagaggggactggtgtggttcagaggccacaggctgggaagagggatggcgggcgagtccaaggaaactggccgtgtcaccgtgcacctgccacttcagccccacgggtctataaaatgggcatgattatcgtggctacctcactggtcctggcaattaaggaacaatgtgtgccaggcactctgtaaaccacatacttgcgagtgtcaagctggtgacaggtggcgttcctgttgaagcacctccctgagctcacagcaacccttgctgtctctcctcttgccctcagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaagtatgttgggcagggcagggggatgaggctgggcttgcccgggtggtgggactggcgtccttgtgcgggacctggagtccccatctgaaagctcttgagtgccagtgtctgaaaggaccattgaagggagcaattctttttttttttttttttgaagatggagtcttgctctggactccaggctggagtgcag

SEQ ID NO: 91507 - DNA, 1013 bp, Homo sapiens
acagagaggttaccttgttcaaatgggtgcataggaagtcaaagtctggagctggggtttgaacccaggcagccctgagaaccttgttctttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccttgttcttaactgtaatgctgcctcctgataggatgtgcctgttgggactaagtaaggggcagtcattcattcattcatttggtatttatcaagcatcgactatgtgtcgttggtgctggggatagaggtgattgggatggctgaagtttctgtcgtcaaggagatgacattctggtggagtgagactggcagtaaataagcagataaagaaagagtatgagaatttcaaagtctgggcacggtggctcacgtctgtaatctcagcactttgggaggccaaggtgggtggatcacctgaggtcaggagttccagaccagcctggccaacatggtgaaaccccgtctctactaaaaatacaaagattagccaggcatggtggcacatgcctgtaatcccagctactcaggaggctgaggcatgagaatcgcttgaacccaggaggcagaggttgcagtgagctgagatcgcaccactgtactgcagtctgggcgacagagtgagactctgtctcaaaaaaaaaaaaaaaaaaaaagactccgtcaaggtataagaatgtcagagagtactaagtgttgcaaagaaaataacaccaggctgggtgcattggctcatgcctgtaaatttcagcac

SEQ ID NO: 91508 - DNA, 1146 bp, Homo sapiens
cagcctgggcaacaagagtgaaactccgattcaaacaaaaaaaaaaaaaagctgggcatggtggagtgcctgtagtcctaactactcaggtgggaggattgcttgagtccaggaggttgaagttgcagtgggctataattacaccactgcactccagccagggccacagagtgagaccctgtctctaaagaaagaaaaaaaaaaacaacctcaggctccgagggcaccattactgctctatactgaagagctgtgcagcttttccagacccgaaatgtcatccacaaaacagaagtgataatggtcctgcctcacagacttcttgcagtagtccaggtgtttagaacggggtgtaaaaggccgtgtgcccttggtaggaatctttgcatatgcatttgatcatctgcagcctgcccagcccactgcttgccccctcctgggtgtgctgggaaggggtctttggccctccaggggttaggtgccccagcctccaaggtgccctcacgccttttcatcccgactcagatgctgacctgacctttgaccagacggcgtggggggacagtggtgtgtattactgctccgtggtctcagcccaggacctccaggggaacaatgaggcctacgcagagctcatcgtccttggtgagtgggcctgggaagggggaggcatggcccttccttttgtccgcttctgttctgtctgccctcccctgtgtccgccctctgccctccagcttaccctctgggctctgtcgcctgctctgctctcccccaggctctgccagtcacttaggctcccctgtgccctgcaccccaggcagggaccactggcccacagtgcctccaatcacccaagccaaactaagagaagagtggagacaattggagactctgccttttcaaagtctcatttttaaaaaaaatccagacttggggtccgggtgcggtagttcatgcctgtaatcccagcactttgggaggccgaggcgggtggatcacttgaggccaggagttcgagactagcctggccaacgtggcaaaatcccgtctctataaaaaatataaaagccaggcgtggtggtgcacatgcctgtaatcccagttactcagaaggctgaggcatgaggattgcttgaacctggg

SEQ ID NO: 91509 - DNA, 1793 bp, Homo sapiens
tacaaaaaattttaaaattaaccaggcatggtggcatgcacctgtgagcccagcttcttgggaggctgaggcaggagtatcgcttgcacccaggaggtcaaggctgcagtgagccgtgactatgctactgcactctagcatgagtgacagagaccctggctcaagaaacacaaacacacacacacacacacacacgcatatagtccattaggcatcagggcgatgatggcatcagggagcctgggaaactctactggacattcatgggagaacaagtgaaaaaggcaaataacatcttagtgttattctaaaatttcttcttttggccttgtggacaggaccacgctttgagagctgtgactgacatgcctctgtcctgttgcgagggcctatagtgccaagtgcatgagctctggggagggcttcgtgggtgcagagctgggcctgtggaggcccctcagacacaacactggtggggctcagagctccaggggcactcgagggaagacaagaaccggctctgagatgcgtgaatgtgacagtgcatgagtagagatggagaccttgtgggtcccagaaccaggactgcatatgactttcatatgtgggtatttttgccttcatgggtcccttcctgttttaaaaaaaatgtgtgattatgttgtcacaaagagtttattcctgtatattgtgttaatttgtgttcagatttgtaaagtaaaattaaaccatttcagccaggtgtggtgacacatgcctgtagccctagctacttaccccagaggctgaggtgggaggatcgcctgagcccacgaggttgaagctgcagtgagccatgatcacacccctgcactccagactgggcgacagagctgagatcctatttcgtgggccctaggtccctgtgcctgctggaacaggacatccctatcaccgtggttggagccctttggggtgctaagacctatgaatgagggaaacttagggtgcccaagctgaggtagagccctcagaaccccctgggatttgtattggagccctcgtggcataacacaggtggattatgcaatgggagtttcttacctataagcacccacatgtgggcgggtggagggtaggagccatgcactagggcttcagcccccagccccttcccgcttcagggcacaccttgcacttggccagcctggagctgggctttcgggggtggcacagcctgggctggctctggccagcataatctgtttctcttttgtccctccagggaggacctcaggggtggctgagctcttacctggttttcaggcggggcccatagaaggtacggggggtggatcctgagttgggcttctcgggagctcccatacatcacctactgcttctgactctagttagtatccccttccccactaaaccctgctcactgtggacccctcactaacctggcctgactgtggctctgaggcatctagtggtctggcgctgggcctaggctaggctgggctgaggagagcctggggtgcaggccagggctctgtgactggcacctgcggtgctcttgagggtgtggcgtctgggcagctggctctctctttggtctgggggctgcagtctgtctccctctgtgcaggctgcctcgttttctgccttgtgttttttgcacctgggggagggccgtaactggggaatggccgggatggtagaatggggagtgtgctgtgcccagcctctggcacaaaaaatccagccagggctgcaggttccttggtgagctttgcaaatcgtccccgacc

SEQ ID NO: 91510 - DNA, 1132 bp, Homo sapiens
catgtgccaccatgctggccaatttttaaaaattttctgtagagacagggtcttgctatgttgcccaggctggtcttgaactcttgacctcaagtgatcctgcctcaggctcccaaagtgatgggattacaggcatgaactaccacacctggccttaaacttaagcaaatttttttttttttttggagacagtttcactctgtcgcccaggctggagtaaagtggcgtgatctctgctcactgcaacctccgccccccgggtttaagctattctcctgcctcagcctcccgagtagctgggatataggcgcctgccaccacgcctgactaatttttgtatttttagtagagacggggttttgccatgttggccaggctggtctcgaactcctgacctcaggcagtccgctcccccgcacccctaccttggcctcccaaagtgttaggactacaggtgtgagccaccatgcctggccaaatttaagcaaatgtttgaaaacacatacccacaggaatgctgcacattttacccagctactatgtctagggtcgtatctagcacaccagcatggctactgtggagagctgggactggatgtgagatgagagctaaaggggaagtaagcaaaccaagcaggggaaggtaagagaagacagaagacagagagagagggacctaactctatgagaggagtcagacatgtgcaattgaaaaagacttgctcctgtctctcttctgtgaatgtttgtgaatatcccaacgggacactttcacagaggagctgattgacgtggtcacagccatcagccttgggacaccagaccacagtgtgtacactaagtggcactgatggacacttcagcatccctctagctgctgtcccgtttcccctcctcggggaccacagctgttgccagtccttggtttccttcaggagggtgtctgggtagaccagcctgtgtgcacacagtccaagatacatgaacagtgaagtgccaggcaatccttgcaagcatgggcaggtggagagctgaggcctgcttgacaccttcctgctcagaagcccagtgagcagtttccctccctagggctcagtgtcatcccctataaaatggggcttatggcagagct

SEQ ID NO: 91511 - DNA, 1391 bp, Homo sapiens
tgagggcttttaaggtgggggggtgaaacatgtctccctgatacctgccgcagggactcttggtgcaaaccctggaccccgggctcctccagcagtcagtgacaccccccttccctgcagccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaaggtgagggccgccctccctggcgtccagaccgtccctgggcccccagccggtccccgcggctcatacccttctttctttctcccttgcagaacttggccctgagtcgggaaagtttagtcgtctgatctgacgttttctacgtagcttttgtatttttttttttaatttgaaggaacactgatgaagccctgccatacccctcccgagtctaataaaacgtataatcacaagctctggagagaaccatttgttcggccgcgcggggcgggggaccggggctgctcccgtatgcgtctgtaaagcgccgcgtcccgggggcaccggagtccggggccgggaggaagagacccagcctggcccggcccgcgcccgcgccgccggccggagaacgtgccccgcgcagccgccgcccgcctgcgtgcgcgccccggccccgcccaggcgtgcgcatgcgccccggccctccgccttcgcgcaccgcaggctggccgtccgggacgcgcgcgcgctcctctccccttccagcccatcccccccagccccccaccgacctactttactgtctccaaactcgggcagcccacctggcccccgacgaccccagcccctgcaccgggtaccccgacgttccatccagacccgcgt

SEQ ID NO: 91512 - DNA, 1027 bp, Homo sapiens
cgggtctggatggaacgtcggggtacccggtgcaggggctggggtcgtcgggggccaggtgggctgcccgagtttggagacagtaaagtaggtcggtggggggctgggggggatgggctggaaggggagaggagcgcgcgcgcgtcccggacggccagcctgcggtgcgcgaaggcggagggccggggcgcatgcgcacgcctgggcggggccggggcgcgcacgcaggcgggcggcggctgcgcggggcacgttctccggccggcggcgcgggcgcgggccgggccaggctgggtctcttcctcccggccccggactccggtgcccccgggacgcggcgctttacagacgcatacgggagcagccccggtcccccgccccgcgcggccgaacaaatggttctctccagagcttgtgattatacgttttattagactcgggaggggtatggcagggcttcatcagtgttccttcaaattaaaaaaaaaaatacaaaagctacgtagaaaacgtcagatcagacgactaaactttcccgactcagggccaagttctgcaagggagaaagaaagaagggtatgagccgcggggaccggctgggggcccagggacggtctggacgccagggagggcggccctcaccttcttgagcctgcgctctcgggacgcctgcgagtcggtctccgagtacgggggcggcgcgggcgggtagtaggcctcttcctcctcctccttgtggggtctcctcctctcctccgaccccttcttcctcacagcctcctccagtagccgcccatcataggggaggtccccggacctggagccgttgtcccgagggtcccgggtacggtggtggtgggacctggggtcggcaggagggcgctcccgagacctgaagtcgtcgtagtgggggtcccgggagcgtgggaagtccctcgagtcgtcttggtcatagaggtcgtcccggctgcggctccgcgggggcatgtaggcccggcttctcccaccattactcgtgggagacctg

SEQ ID NO: 91513 - DNA, 1953 bp, Homo sapiens
tccagtaccagttccgcacagagacaaatggaggacaggtgagcggcgggccgcgagggcgaacgggcgggcgggcgggcgcgccgggaaggctcggacctggccccagcgccggcctcgccgctctgccgccccctgcaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggtaggtgccctgccacccctgggtgggggggggagggagtggagaggggacactggctctgctcttggggagccccgggggtggggcaggtgtcgcccagcggatgctgccttcaggcctcaggctgcatggggccagatccctgttgtgcaccgtgaaacctggggacagtgctcttggaatttttttttcccgcaaaatgggaatgatgtgtcttaagaggaaagtttcttagagtgcgaaacggatttgctcagcaagtgatcgctgacctcccgccatgttccagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggtgaggagtagaagtcagattggcaggtgggggaggcaacgggcccagcagggagggaagcccccccagccagttctgacttcaccctgccttgccactaaccccccactctccctgcaggccagttctacgtcatgatgacgccccaggatgtgcttcagacaggaacacagaggacgatcgccccccggacacacccttactctccgtatgtgcaggggacacctggagggcctggtgttgaaatggaaggaagaggggtttctggagtagaagctgggcagttagcatgaagtgggcacatggtgtaatgttttttttctttgcctgtttctgctgctctagtgcacataaagtatcatgtcttttgtttttgcagatggatttaccttgcaaagataattttcaaatctaatacttagcagatgcttgggcaaacagctctgcgataatacatgccccctttttttttcctcctcttgtagaaaaattgatggaaccagaacaccccgagatgagaggagaagagcccagcacaacgaaggtgaggacaaggtgtggctccgggtccccctgaccaccaccctcacaggctcagccagccctggagtgtggagtgacagagagagaagccactcctgggcaggccacaagtgctccagagggctttgctggacgctgtaaaggtagaaagtgagcaacgaggggagagtacagtgtcagaagtagagggacagggagtgtgaattggaactggccatttgttgacccggctggtgatcttgaattcatggcccacatctaagatggtggacttcacactcccatacggattgcctgccccacttgaaaaatggggctgaccgggctcacgtgggctgacctttccacgtggcagctgtcatgctcacatcccgcactcccatgcctgcctggcctccagaagtaggtctgttcccccagggagcacatctgagggagaaactgcatgaagttctgcctctggctacctaaggc

SEQ ID NO: 91514 - DNA, 1067 bp, Homo sapiens
gcatctgagcttggttttgagatgcagtgagtttgaggggcccccagagcagccccagccccacgacttacctgtggtggggcgtcagggtggttcttaatctccgtacctgtcttccctctgtgaaatggtggaagcacagccgccccgggcacctggtggggatgcagtgagtcttggtggccacacagtaaggcgaagagaggactcagaaccctcccaccccactctcacccccgcctctcccttagttaatctgactccaggcagccttgaaactttctcaccctgtgaagcagtcttcatcacctgcccacttctccagctccgtcctgtctccgctttcctgacttgcagagcatctgccccaatctgctcatcctcccagtaccctcagccatctggctcatggctctaccaaaacagctccacttccggtcacccgtggtgaccccattgccacatccactggcctcctttgctgtctgggctccaagcatctgatgctgcctgtttccctctgttcctttctggaatcttcctttctcctccatcctctctgattctcctgtgatctttgcctttcctaccccactgttaacagtgaaatttccagggctgtcccagttccaagtgagtagatgggggtgccggggaatctgtgttttccatcagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctcaagcgatcctcacacctcaggcttctgagtggctgggaccacaggcaggcgtcatcacatggggtaatttttttttatctgtagagtggaggtcttgctatgctgcccaggctcgtcttgaacttctggcctcaggcagtcctccggcctcggctacaggcctgagctgccacacccagtcttgctggtgtttcataaggtccggcccctcccgtcggcctcaggtgtatgacttgtgag

SEQ ID NO: 91515 - DNA, 1037 bp, Homo sapiens
gcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtctgcagagctccacgaggcatggttctgctgttgtgcacatggctgtgcatggtccctgccagctgcaccacccattacccagtggttggttggatggatggaggaattaaggaatgaatgtcccctttgaggccctagacgtgcatgagggtgtggggagctggggtcaaggacatgtcccatgttggaggagaggcaggggtctccgtgtcaacagttcctgaaaacacaaccagcccctggccctgccctgctgggccaaagccctcccctctgcaccagccaatagtggggcctggccttgagcccctcacccccagggagggcagatggccagggcgccaagcttggcccgtcagcctgtcgccttgcaccaaggctctggcgcctgtgctgtgacccctgcccctgctgatgatgaaacctgtcctcagctgagatgcagcgatgcctggtagggctg

SEQ ID NO: 91516 - DNA, 1050 bp, Homo sapiens
ctcattctgtaacctctcgtactcctgacctcaagtgatccactcactcttcggcctcgcaaagtgctaggattacagcagtgagccaccatgcccggcctctttcagtgttttgagcaacaacctaaacacctttatcagtgcctgggaatgttcaaggccccaggcgtgggttagtgaagcttgcagtgaaaacaggcagccggcggggtcgtagtgaggtcaaggcgctctcagtcaggacagagaaaaaaggaggggaaattggagggccctacaggaagctaccgcccccatccttggccacactggccttgccttgagccaaggagtctccggggccgggcctcgcgttggctccgggccaccctcagacctgattttgcccctgcagtcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccgtgagtggcgtggacttggggtgggagccacaggagggagcgggcacgtcttagatccaagctcccaaggctgaccaacagccacagagcatgggctatgcagattgacagaaaggtcaaattctccctttccggttggagaggagaagccgccctgagtttgccccgagtttgctaggacctttgaggcatgagcccctccccagggccctctagcatgaaagggattgccctggcacgaggaggctccgtgccaatcagtcagtgcaaggatgccccggctgtgtgactacattgactgtcatcccagcatgtctccaaagttctcaggtgtcgtcaccaccacccatagccctaagggcgcctgg

SEQ ID NO: 91517 - DNA, 1124 bp, Homo sapiens
tcaggaagacaggcaggctgaccccgcctggaaggcacccagagacaagaggggtgggcgtagtgacctcgtgcccttttaggggagatgctgctggccagaggccgttagggcccccactaccaactccatgttactctctctcaccagtggccaccaccatggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttccggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctgttggcggccacgctgctcaacttccttgtctgctttgggccctacaacgtgtcccatgtcgtgggctatatctgcggtgaaagcccggcgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggac

SEQ ID NO: 91518 - DNA, 1038 bp, Homo sapiens
tttgtagagatggggtctcacttttgttgcccagggtgctttagaacccctgggctcaagtgatccttgacctcccacagtgctgggattacaggtgtgagccaccgtgcctggcctcatgggttttctttgttttgttttgttttgtttttgagacagagtctcactctgtcactcaggctggagtgcagtggcacgattttggctcactgcaacctccaccttccgggttcaagcgattctcctgcctccgcctcccgagtagttggggttacaggcatgcgctaccacacctggctagttttttattgttgttgttttttgtatttttagtggtgacggggtttgctctgttggccaggctggtctcaaactcctgacctcaggtgatccccacttcagcctcccaaagtgctgggatgacaggcatgagcctctgcacctggcctcgtgttttttttttagttagccattttatacgtgtttactgaacacctgtcctgtgcccatattctaagtgccttacctgcattaaactcatgtaaccttcacaacccgatgaggaagtgctaccgctgtcattttttgcatttttttactgctgtcagggcagaggggaggggagtgagagggagagcctgctggagtgcaggtggctggtcccacctcgggtctgcactcctgtttccactgcctgaatgaatgaatgaatgggctgccctgcaaagccatcacacatgcatggttatcctcttcctgtctcctgctctgtcagtccactttccatcatctggcccaacgagctcttctcagataccccccatttcctgccttccaaattagggacacttgcgattcctctgcaacaattgctgagttggcctgaggcaaagactgtgcccccagaagaccccaggccctccccaaggctgtcatgggccccagcctcctgcccaccaggctgttttgaggattccattcattcattcaaaggaagttctgaatggctatcagggcctgtacctgctaatgccagag

SEQ ID NO: 91519 - DNA, 1049 bp, Homo sapiens
aggaggggatgtgtgcaggccagggtccagccttgcctgagggttgcacagtgttttaagtgacttctgcactggtgggcctctcctcccgaaaccagtctctccctcttaactccatacagtaagcaaggcccgggaagaagttgggtttccctgccatccttcctgccccagcccctcatcctcaactcaccatcaacccttccacgatcccaaatcgctcgtggatgactttggcgaggggagccaaacagttggtggtgcaggacgcgttgctgaaacagccaaggtgtgcacggacactgtgaggtgagtcgcagagccacccctccacccttacccctcttggggtatgcacgcagacttggttttatgaaacgtcaggatgagggtgagagggatctgtggggacactgtcagactgaaggaggcactgaggtgcagctggggaggctccccaagcttgtcctctggaagtcatgcgtttttagcagatagtttcgggaaggagaagcagaagccaagcgaccaggaatccagtggggctgagggtggggaggacgagtctaccctcccttccacacattgcaggatgtcactgcccacattacctcacaatgttcatggagccagggttatagtcattttcattgacacccatgacgaacattggtgcatccggtgagggcgcggagatgaccacacgttgagcacctgcagagatgtggtcctggggaggaagcgcaggtgtcaggggcttctggcaccatcatccccccagctagccctgggcacctctccccagcttaccgaagctgcctgtatggagaggtacacgcctgtggactccaccacgtaggggctcccgacagccctccaggggatctgtttgggctctttgctgtggggaagtggcagggctgagtcagtctcccctgcttgagccccaccttcatagtccatggctttcaccatttgacaggctgagcaggtaccggcccacctgcaaccacctgcgtcccctaccccacacacctacttgttccaga

SEQ ID NO: 91520 - DNA, 1520 bp, Homo sapiens
ctgcccaaggagcagcaccttcagacctgactcagatgccctgtgatcacccagaactcaaacttccagccccctcggggacccggggacctatcctctatctccccgattcctgtaattttgccaccatctggtggttcctcttccagatgggcccccagaacctgtcctgccctcttcctacccacgaacttcccacaaatcccacgtggtttatcttgatcccctcaccttgaagtgacctctttctgctttctgttctcagatgctgttcttggccactttctttcccacctgggaaggcggcatctatgacttcattggggtgagaggggccagggaagggaagggagttcaggaatggggctccctgtccccctgtgcttacttaagcctcaacctgacccgcaggagttcatgaaggccagcgtggatgtggcagacctgataggtctaaaccttgtcatgtcccggaatgccggcaagggagagtacaagatcatggttgctgccctgggctgggccactgctgagcttattatgtcccggtgcgtacagcagcctggagcccagacccctgagaagggacacctgggttccacgggggtgctggagggcaggggctcaaagcctggtgctgaaggtgtctgagtactggagaatcccatcctttgccttcctcagctgcattcccctatgggtcggagcccggggcattgagtttgactggaagtacatccagatgagcatagactccaacatcagtctggtaggcagtcgtgctctcccacatacacatttctgctggcggccatactcctccccaaggcctggccccgactttctgcctccctctaggtccattacatcgtcgcgtctgctcaggtctggatgataacacgctatgatctgtaccacaccttccggccagctgtcctcctgctgatgttcctcagtgtctacaaggcctttgttatggagtgagttgggtggggtttagggctgggtccaaagtggggtgggttatctagtctcccttccttattgtgacattttcctgcaggaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaagttgttgctgcctccatttctctctcttgggaactgtctcccaataccgtgtccacctgggtctcagaggccctggttctgtctcaggagccaggtagacaagctggaagctagccagtcactgacttgtcccatgtcttgttcctcaggctcctggtttgccaggagtagacagaaggtttggatgatctttgagcagtggcagaggccagggccctcagggaacagatgatagaggggagctagaatccaagaga

SEQ ID NO: 91521 - DNA, 1029 bp, Homo sapiens
cctcacgtcggcagctctgggcctggagcccgtggtcctggtaagagtcctggtcatgggagaaggggcagggagcctggagtcaggcagatgctagggtccccctcaggtcccttcctcctcttctccctagcgtgatgtccgaacagcctgcaccctccgggcccagttcctgcagaacctcctgcttccccaggccaagaggggcagcctcccgtgagtgtccctagcccccagagaccctgtaaagaccctgggttttaagtgggggtctcttatttattaattcctcagacactgagcttctgggctacgttctgtagaaggggacttccaggctgggaatagaaggagacagtctctcatcacaaacagtgacagccaggtggtcagggctgttgcgggagtgaggaggcctgagaggctctgggcacccagaggcagtgcctttcccagctaagaaggcagggaggggagaggttctctggtgaggaggcttagctggggtgaagggtccagagagtgtcccagatgaacaacccatgtaaaggccccaaagccagcaggttggtataattggggaactcaagtctaacaggcatagggaagatgacagcccctaccttatagggtggtggtgataactagaggataattgacgtgtcttgtaacgttctctgtccgcttacccaaccccacagaacccctcatgatgaccactttggcacttcgtaccagcagtggctgagctcagtggaggtgagagggcagggctctcaggaaagccacaccctcccgctccttgatcaaaacttagggtgccaggacctaactcttgatgacagccctattcccatggggtctcagctcacagccctgccccgatcctgccctgacttcaccctccctccccctagacgctgctgacaaaccaccccccaggccacgtcctggctgccttggagcacctggctgcagagcgggaggcagagattcggtccctgtgcagtggggatgggcttggcgaca

SEQ ID NO: 91522 - DNA, 1071 bp, Homo sapiens
atggaggcggagatggccctgtaaggcccgcgacagagagtgataaaagtcgtcccagagccagagccaccgaatctcggagcctccaggcctcgataggccggagatacggctctaacatggggaagtgggaccttcgggattgtgggggcggggataggggagaggttggcaggggtgagggtcccctcgcgatatacccacagttccaaaattggtacgaggtcctgagcgctgatgtctgttctactcctccaggtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtacggctgagctaaggcatgtaagtcagggaacacaatgcctcgaacagagtaggtgtttgtgtacagagagctgttgacgttttggcttgttgactaattagcatgacaaatattttatatgccaggcactgagaacacagtaatgactgagagagacatttctgccctgtgggagcttatattctagaacatgttgtccagtagagctttctgcaatgacgagactgttctgatatatttaaaatttatatttaatagttcgttattctcattagtcacatttcaagtgctcagtagccaactatatatgactagtagagaaagagagagaaattattaagatgaaaataggctgggcgctgggcgtggtggctcacacctgtaatcccagcactttgggagaccaaggcgggcagatcacgaggtcaagagatcgagtccatcctggccaacatggtgaaaccccatctctactaaaattacaaaaattagctgggtgtggtggcacgtgcctgtagtcccagctacttgggaggctgaggcaggagaatcgcttgaacccaggaagcggaggttgcagtgagctgagattgcgccactgcactggagcctggtgacagagcgagactccgtctcaaaaaaaaaaaaaaagccct

SEQ ID NO: 91523 - DNA, 1091 bp, Homo sapiens
actgctgaggagtttgtggcaccaaaaagattaagaatctttgcagtgtagattatgccaacaacggaggcagcccaccagttatttttatgccgtttaaccgtaggaagtcacttagacaccctgttccttcctcgtctgggcaatggtgatagtaatagttcctaccttttagagtggctataggagtaaagtgtgtagaacagcgcctggcatgtagtaagcactcagtgagtgttagctcatgttatttggggaccaggcttgattttgctgaggagttgtaccccaaccctgccgcgacctcgacactcagatgtgtggattcgccctgcccctcatctctgtgtatgttgagaggcaggaacttgttcacacccagcccattgttccgtgcctgccctcttccattgatcctgggtagtctggcttgctcagggcccctggggcccctgctgacacccactcctttcgcctccaggattcagcaccatggcggaagacatggagaccaaaatcaagaactacaagaccgccccttttgacagccgcttccccaaccagaaccagactagaaactgctggcagaactacctgggtaagcaggacctttccctggccacatacctcgagtcactcaccgcttgcctcttcctaggggacccatccaccccagcctcctcccttttattctgaacatccttactctggaaggcccatgcctctcatcacctgctgttcaggtccaggctagggttacaaactttagttcctgcaatgattttttttttaatttaaattttttattattattatggtttggttttgtttttttccagagatggggtctcactttgtcacctaggctggagtgcagtggtgcaatcatagctcactgcagcctcaacctcctgggctcaagaggtccccctacctcagcctctcgagtagctgggaccacaggcccacactactgtacttggctaatttttttgtagagaagaggtctcagtttgttgcccaggctggtctcaaactcttggcttcatgcgctcttcctgcctcagcttctcaaagtgttgggattatag

SEQ ID NO: 91524 - DNA, 1060 bp, Homo sapiens
ccttctcagatccatacatgctgtggcatatagcttgctcattttcattgctgtccagttttctacaatttattctatgcctgtacacttgtgtgatttccattttggagttcttacaaatggtgtggctgtaaacatctttataaatgtaattttgctgggtgcagtggctcacgcctgtaatcctagcactttgggaggccgaggtgggcagatcaagaccagcctggccaacatggcgaaaccctgtctctactaaaaatacaaaaattagctgggcatggtggcaggtgcctgtaatcccagctacttgagaggctgaggcaggagaatcacttgaacccaggaggaggtagaggttgcagtgagctgagatcgcaccactgcactccagcctgagtgacagattgagaccctacctcaaaaaaaaaaaaaaatgtgttccaactcttgatctgggctgacttgaacccctttcttcacagacttccaccgctgtcagaaggcaatgaccgctaaaggaggcgatatctctgtgtgcgaatggtaccagcgtgtgtaccagtccctctgccccacatcctgggtatgtgcctcctgccagggcccttgggatgctggggtggggtcttagcagaggggagtgtggtggcttggtgggagctcatctgtgaggggcagagggaggacagggcaccacactgtcccaggactcagtgcctttcctcccgcctagaattacctccctgtctccttctgctgatgcctctcaaccagtcagggctctcagctgaggcgaccagggtgctttgctagatgtagctcactcatgcactctccaaatacacactcagcactgggctcccatccctgtgtagctcacaattctgtgcagtcctgtccttttttattaggaacatttttttttctttttttttttctttttttttttttagacaagggtcttgctgtgttgccaggctggaaaggctggagtgcagtggcgcgatcttgcctcactgcaacctccgcctcctgggttcaagcgattcccctgcct

SEQ ID NO: 91525 - DNA, 1112 bp, Homo sapiens
gtgtattgtttggcaccttttttgcacttgactatgtatcttgaagatccatccattcatgccagaacataaatcagcctcgttttttttcacagctgcctgctattccatctcccctgtttggacaaacagcatagtgttgacttgaggttttcaaagcagggcccacccttggagctctgtacagtgacacatctccccatcgacagctctgcagtgggcctggggttttcctgcccattactctcctcccagcatgtcagcttgttcagaacagtgatttctgtcttttggggtcactgctgattccccggcctctagaatagaggttggcacacagcaggtacctgtggatattggttgaacaaacaggtgggcaaagtgaggaagataagaagtccatccgttcagtttccccactgcggagggaataacactgtctttccacaggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgagactatgcgtgtgaacgggccaggcagtggcaagaagctgggctggaatcagtgccctgaccagggaggggcttgaatgagtattttctctgttttgtttttatttatttaatttaatttaattttttttttttttatgatggagtctcgttcttcacgcaggctggagtgcaatggcacgatctctgctcactgcaacctccacctccagtgttcaagcgattctcctgcctcagcctcccgactagctgggactacaggcacaccccaccacacctggctaatttttgtatttttagtagagatggggttttaccatgtcggccaggctggtctcaaactcctgacctcagatgatccacctgcctcggcctcccaaagtgctgggattacaggcatgagccaccatgcctagcgttttttaacttaattttattgaaccttggccaccctctctgtgccagtcaatgagt

SEQ ID NO: 91526 - DNA, 1050 bp, Homo sapiens
taaaaatacaaaaattagccgggcgtagtggtgcacacctgtaatcccagctactcaggaggctgaggcaggagaattgcttgaacgcgggaggtaaaggtttcagtgagccgagatcatgccactgcactgtagcctgggtgacagagggagactgcgagactgtctccaaaaaaaaaaaaaagccagctgtaagatcaaaatcaccctcagattgtcatagccatcagcagggcggcacctacttgtgcagggcctgggttcaacatcagctccctggggccccgaaaccacccgaggaggtggacagtgccatggtccccattgcacaagtgagaaaaccaatgctcagggaaggtggtgactttcccaagggcgcacagtgactctcgctttcagcggctaccctcatgggcgtcttctcaaacttcccccatccccctgcccagggctgcttcgaacacatcggccacgccatcgacagctacacgtggggtatctcgtggtttgggtttgccatcctgatgtggacggtgagaggcggggagcccacaggctgggtgggctgggggtggggggcggagtgccctcatctcgctgcctcctcgccagctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgt

SEQ ID NO: 91527 - DNA, 1058 bp, Homo sapiens
atgtcaggtgatccacccacctcggcttcacaaagtgctgggattacaggcgtgagcctacatgcccggcctaatactcgtattactgaataaaatttgaaatctgatttttttttttttgagacagagtcttgctctattgcccaggctggagtgcagtggcgcaatctcggctcactgtaacctccgcctcctgggttcaagtgattctcctgcctcagcctcccgagtagctgggatcacaggtgtgcatcaccaaacccggctaattttttgtatttttagtagagacagggtttcaccatgttggccaggctggtctcgaactcctgacctcatgatctgcccgccttggcatcccaaaatgctgtgatacaggcatgaggcaccacgcctggcctgaaatctgatagttcttattcttactggtagacttgaccaatgggacactaagggaaaaatgtgcaaggggctcggggcacaccctggctgcaaagtcaaagcttcccagaaatccttgtatcatgaacttcttgaggcacaacccagcttgatgtaacaatgtcaacacagcaacacaaataccaattctccttaaatattataattaaaatcaaaccatcagaatagaccaatgggagggatgatcatttgttttgtgaaaaagttctccctctatttcacttattttaaatatcaagccctcttcccaagccaagttgaacaagattcaatttagaaaaattctgtgaactcgccactcttcccgtgaacccatctctttccacaaatgaaggtggttaaattccccacagcattttatatagattaagagcgattatccaaatcttacatgaactttaagtatgtttactctttcgccaggcgcagtggctcacacctgtaatcccagcactctgggaggtggaggcaagcggatcatctgaggtcgggagttcaagaccagcctgaccaacatggagaaaccctgtctctacaaaaaataaaaaaaattagctgggcgtggcggcacatgcctgtaattccagctactcgag

SEQ ID NO: 91528 - DNA, 1986 bp, Homo sapiens
tcaaaatttgttggataaatgaaaattttgctataggatcagggataagagaataataagaaacagaaaaagaaagttgagcctctaagaccccatcccttccccagattaaagagttctgaagtgtgaaaagaggggaaacctccggggaccttgaccccttgggcaggaagtgaaagaaacccaagtcctgatttcagagaaatgtcatttgtcatcagcccaagaaaaggagatttttctcttcgaagaccaccacacgtccttcctggggttgcccctttcagagcttgatgggaggatctgagtcactcacacacccacccccaggtcattcccaggcagcaaatgaggcttcccagtaccaagtcagggagagggaggaggccagcttctggctcctccaccctattcttgggatccaaatgtttcaatcctttttacttctgcagctgtgtgctctgccgtcatctctaagaaacaaccataccactgaatgctactgtgtacttacaaaccacactcatattcgtcacgtcatttcatcttcacccccacctccaaatgaggtaagcagatattatgcctatttcatgaatgaggttactgaggcccagagaagtgacttgcccaaggtgactcaaatagtaaatggcagagatgaaactcaaaggcagggctgattattccaaggtccttgctgccacagatacacttctttgactctaggagttcacaaacgaagtgaggagacaggaggctaggggcagaatgtgtgcattctggaggtagagggggtggtctctcctgcaggcagaaggcagaggcagggttagaaaaccacaccccttcggggggactgtggcagactgatacttgggacatccaatggaggcctgtgaggtcaggggcggggctagctccagggggggccccaggagccccaacagtagttcagagcatgcggtgtcctggaagaagctacaagcggtgagtgatagcctctctccagctgaggccttcttcccatcacaactctttctgtctcctccctgccaacctagagccctctccctgaggtgtccaagtgcagccctccctgccccaagggcccttgctcacagggaacctgcacctaggactctgcctgctgggtgctaagacactgaggttctggttctcttcgtatctgggttcccagctctcttcttaaaagccaatgtggtggttttgatgtgtgagaaactcctgcctggttgggtgctgtctttctattcttcactttttgtcttatgaaaaacaaattaaaccatctccttacccaaatcttgagaggaaacagcctccctgtctccagtccccacgtcctttcctcccatctcctcaggagtccattctccaaaaggtctctccatcattgggtcaggagcctcctctcctgtggcttctgcacctgctctcctctttctctggatgggaatgtctggttccttccctgaggatgtgttctagaagcttcagcttcacagtgatgactgccggatgccttagcgcctgcgctcctgcagccaggatccctatcatgctgccctctctgcctttcaggagcgatgggcttttgggggaggacccactagctttctaagctctcccgtgaaactgtgtcatgctccatcccttagtgccggcgttgactgggttttgtggtgatccttgtctggaatgaagaaagcctggcttgcgcagaggtgtttccctgcagaggggcttggagaagcagaagtggcagtatctgctatcttttacgtcagagactgccaactggcagacttcccgcacgcctgtcttaaacccactactagatatttctgttaactgactggcccttgctctttaagtcctgaatttggtctgatttccattctctcgccaccatgcctacctgctatgattctggataagctccaatcctctcttgggttactt

SEQ ID NO: 91529 - DNA, 1760 bp, Homo sapiens
ggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggtgagtggcggggtctagtgctctgcctccaggctgggagggcatggcccaggaggggcagccctgctgggtggaagggcactgcatctctactgcacagttcctgagctggggaagagacaagaagctgctgccacagggcacgccaaagcccagcccccgggggaggacttgggataccccctcttcacgaaggggccaggctcccaggtttagccaaggctgtaactcttccccaccccatcccaggatcccactgtccctaaatgcccccaaagggctctggagccagaaccagttggcctcctccagccctaccccaggtaagcccctcgctgtcctgcatacacctgtaacatggtgtcttctctgggctggggctcgaggagtccagcctgagcagggcccctacctcccactgttccttccaggttccctcccccagggccccgcacagctcagccctggggagatggaagagtctgatcaggggcacacaggtgagtcgggcgggggcactcgtgcctcagccccactgtagcccttgatttcctgcctgaatggtacagtgagttggcgctgggattcctggccctgccctcctttgccttctctgtccccacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcac

SEQ ID NO: 91530 - DNA, 1050 bp, Homo sapiens
agaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatc

SEQ ID NO: 91531 - DNA, 3564 bp, Homo sapiens
gccacagagggtaggtggggagactggacagccatgtcaggtttggggatgaccccacacttgggtgacatgcaccaagagcctaggagagagggagccaagtcaggtgctcaggggttaggtggcaagtgggctggagtgctaggtcctagagcaacttcatttgggggcaccaggaacctggcgctgtgagaaagcgagagccaggttgtgggaaagcagggaagtgaggtagaagcctggtggctttgtggctccatcccctcctccctgcctgctgcaatagatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtgtgagtagctggggcgtgacctcattcccgtggttgttggtcccctaggcttcctacctcactcctcttctgcctggccagagcagtggggttggcattcttgtggagagcttcctctcttcccccagaccaccagtcccctaccctggtgacgtgctgctcccctccccagataccggaagtgtgacaaaatagaggctcggaagatggaacgactggctaaaaaaggtgacgagctttaaggagcatttcttctcaaaaccgtgttagagtttgtgctgtggagggagctgtttttctttgctctcctcccttgcagctcaccctctccatcttctccgttgtgtgctttcatagctcctgcgttcattccctgccccgcttctttctggcttctctcccagtgtcccatgtccctggctgagctcaaatcctactaagtcccctgttcccgcagccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatggtgcgaactgcttaatgctttctctgttgatcatttatttggtcttgtgtcttttgtgtaggagggacaaggcacccagacccagggctctgtcagtctgatagagaaggtggctgagggcggaggaggagacagtttttaggtggatgtacagaactggcctatgaggttctcagtgagcctaatgagtgagacttaagggtcatcctaggcctggtgcagtggctcacacttgtaatcccagcacttttgggaggccaaggtgggaggatcacttgagcccaggagttcaagaccagcctgggcaacatagtgggaccccatccctataaaagcaaaagttagttgtatgtggtggcacgcatctgtggtctcagctgctcaggaggctgaggcaggaggatcgtctgagcctgggagttcaaggctgcggtgggctatgggtcacgccactgcattccagtctgggcaacagagcgagaccctgcctcaaaaaacaagaaaaagaatcgtcctggcgggtcttggttagttaaagaaggccctgggaatccaggtaacatttggggttgtagaagaagaggggcgtggaaggggagtgacctcactgctcattgtgtcctgcctagagctgccactgccagaacctgaggagcagagccggccccgcaaacctaccctgcagcctgtgttgcagctcaaggcccgaaggcgcctggacaaggtcagcacggcccgctccgagagccccttccctccaggagctacctggcaagtcagagtgacagacacacctgagtgtcgtggtgtgtccacatgagaggacaggccctgagggatgaggcgggccttgcctgtctggaaagcaaaggggtctggatcagggtctgggtccagtaggctgggggaaaggcggtgaggagaggagtctgcatcacggccaggctggcagctctgaattcccccacctttcctccccaggatgctttggcccctggcccctttgcttcttttcccaatggctggactggaaagcagaagtctcccgatggtgtgcaccgcgtccgtgtggattttaaggtatggcattgagtggggcgagtcacagagcctctggttggaagaacctcgatgactgtgtcatcgagaagccaggtgggtctgccttgtatgcctggcggccctctgatcctgcatcctctcttcccccaggaggattgtgatttagagaacgtgtggctgatggggggcctgagtgtgctcacctctgtgccagggggccccccgatggtgtgcttgctgtgtgccagcaaaggactccacgaggttagatctctgcctttcttcacagacccccagctctctgtcggtcctcacggcctgattccttgggccctctcagctgggtctcatcccttggccctctggcctcatgctatgcccatcattcactcctttaccctgtccccagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaaggtttgggcccaagggctggccagggtgggtggaggcctgaaggtgagggcatccctgtgccagcaggtttcgccatctctgtctccacatccaacagcacctcctggagtgcgagcgctgccgccatgcataccacccggcctgtctggggcccagctatccaacccgggccacgcgcaaacggcgccactgggtgagagatgaggttcacccacttgctttgtctctaatgaatatcaccaccacccccaaacttgctctaggctggggctctcaggaggagcagaggttggggatcctcttaagaattgattagtaatgtttcctcttcaaaaatttcacataggtcagatttatattcagaatttgcatggagtggttttaggggcttatgaatctcacattccgtgggctcagaatcccctgctatagcctgatgtcctctcctgccctcatgttcctcctccgtgtctgtcctgcgtgttttctcctcttacctgtccctccttgcctgcttcctgcatatccccaattcctcctcgcccgtctcccgctcatgttgctccagtccagtgcctggttttcccctaacatcgccctgctcccccagatctgttcagcctgtgtgcgctgtaagagctgtggggc

SEQ ID NO: 91532 - DNA, 1273 bp, Homo sapiens
gtggctcacgcctgtaatcctaacactttggaaggctgaggcaggtggatcacctgaggtgaggagtttgagatcagcctggccaacatggtgaaaccccatctgtactacaaatacaaaaattagccgggcatgatggcgggcacctgtaatctcagctactcgggaggctgaggcaggagaatcgcttgaacccgggaggcggaggttgcagtgagcggagatcttgccactgcactctagcctgggtgacagagcaagacactgtctcaaaaaaaaaaaaaaaaaaaaagcctcatcctcaaggagcttttagggactagtaggggcccaaaacaggggcatagtggaggcagctaaggtactgctaatccttgaacagagacactcagggctgagtgggaactccagcacctctgactccttctcttccctttctctaggaaactactgcccgatctgtacacgctgctatgaagacaacgactatgagagcaagatgatgcagtgcgcacagtgcgatcactgggtgcatgccaagtgcgaggggctctcaggtgagtcagtggagcacctgggctgcagcctcaaccctgtggggacccctgcccccaccacaggccccaagaggactggtgggctaagggtccttgctggcctaggggctgctgggagccctcacatcctctgaaaccacttttccctttcccacttggctatcctagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccaggtctggagggccctggaggcaggatgggccggggctaggcccacccccagccctgctaacttccccgctttgcagtgtgggccagatgggaagcaactgcacccaggaccctgcggcctgcaagctgtgagtcagcgcttcgaggatggccactacaagtctgtggtgagtggtacaccaggaggagcaggtgggtggcaggaggagagggctggaattgtgcagaggggactcagtctctgacaaacccccttacagcacagcttcatggaggacatggtgggcatcctcatgcggcactcggaggagggagagaccccggaccgccgggctggaggccagatgaaggggctcctgctgaag

SEQ ID NO: 91533 - DNA, 1016 bp, Homo sapiens
ccagatggtcagggcagtgatggagaataccagggggcggtgggggcccggaggggtacctgctggagccgaggtgtcagggaaggcttcctgaaagagatggcattggagcagagctggggaggaagagtattgcaggcatgaggagcagcatttcgtatgtccaagctggcacaagagggcctggcttatttggtggactgagagaaattccacatagagagggagtagcgggtgtcatggcgagttcaggctggtttgtggatgggcccccgttcagctgcccttgttgggcacatcagctgctaaccctgcctgtccacagcggagtccttcccaatgcggtgttgcccccatccctggatcatgtctatgcgcagtggagacagcaggaaccagagaccccagaatcagggcagcctccaggggatccctcagcaggtactgggaagtgggggtccagaagccagggccctgtgttggtggcctggctccgggtcctgattcttagacctcccttcacatttcctcttcagcattccagggcaaggatccggctgccttctcacacctggaggacccccgtcagtgtgcactctgcctcaaatacggggatgcagactccaaggtgagggctgctctgtgacgcaccaggttgtggggcctgttccctggcctccccacatcatgccactcctcttctgccccaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatggtgagggcgcgggcgcagagaggtggacagctctctggctcttggggaggcctcctccggtgcaaacagctcttacttcacattccctacctggcatcctttcactgccaggctgaggtctcttggttgccctgggacgttggtgctgatggcagctttttcctatgt

SEQ ID NO: 91534 - DNA, 1261 bp, Homo sapiens
ggagagcctttgccgtgccaggctagacagggacccatgcagactcagtgacagtggtgcctggcgcccagccccagccctggcttctcccctgagctgccctcccctacgcagcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggtgggccagaactgtggggtacacggttccttccccacctctcttcctgttcacttagggacccccgtggcccccaggcctggccctactgcctctcagtgtctcctcatctgttttcccagaggcctttaggccaagcccctgactgttcagacttccctggcatccacctcccccaccaatgcagccacctcactttgccaccccctcttccaggaaattgtgaaccccgatggttttgatgttctccgccgagtctatgtggacttcgagggcatcaacttcaagcggaagttcttgacggggcttgaacccgatgccatcaacgtgctcattggtaagctgcctgctctccgccctgtcctcctaccctgtcctgcctgcctctcctgacctccgctttgcaccacaggttccatccgcattgactccctgggtactctgtctgatctctcggactgcgagggacggctcttccccattggctaccagtgagcggtcggggtgatccatggggccaggggactccatagctggatcccatttcccaagcatcctaaccgtcttatcccacatgccaggtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcaggtgtggctttggctctgtcttcttcctgaataccgctctccctaaacaaacctacagatctctgttccccgctcccttttggaaagtccaggaggcttgcttttgcttcagttgctgtaatgtaacggcagctcgcttactgccatgccttgtgtgccaggggctgtgcccggcttttcatgggaagtgaggtggggagagcggcacgctgcctacttgaggtggggtactggcttttggacgact

SEQ ID NO: 91535 - DNA, 1023 bp, Homo sapiens
tgtgggcaggctttgacacagagcccctaccaccccaatgccatttctcgcctcttcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggtgagcaccgggcatgtgggggttgggggtggagccgcggaggtgggagctgctggtaacaccaaccctccccccacaggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgagg

SEQ ID NO: 91536 - DNA, 1019 bp, Homo sapiens
cttggcagtggcgggtgagtgcgggtgctgaggctggcagagcaggcaagggggcagatgggcgggagatgcggctcatccttctcgggctcgccctcccaggtttagccgtgtgaggatgaaaacccccacagtgcgtggggtccttgacctggatcggcctggggagcccgctggggaagaaagtcctgggtgagtggccaggcccctctccctggagggtctgggacctctgtccttccccttcctgacaggtctcttctcgcaggcccctccaggaacggtcccctttgctgccacttccggaagatggtcctccccaggtccccgatggtcccccagacctgctgcttgagtcccagtggcaccactattcaggtagggaccggccttgccctctccctccttgcctgtgcctggctcagctgggtgactcacagatgcaaaatcagccctctttcaaaaccagtatctactcccaggggccaagcctgaggctcggtgctagagttagagatgaccttggggagcctctggccttgtgggagaaacagacatggaaatgacatttcgcctctacgtgggatccttttaagggtctttgtccagcatgcccaagagcctaggggagggcctcagagcctagcctgccaggagctgagagagagcttcctagagtagccaaaggtgaagttctaggatcatctagagggaatgcagcccagctagcaccgagatgagggtcagggacagtgggaagatcagaagagtggtgtcccagaggcccagggaagggagtcgtcacatctcagctgccacagagactgccaggcctgtggagtctagcgttggtgtccagtgagagcaggtggcacagggtggggccttgtgtccaagtccagaattgagaccatggttgaagaaggcaaaacagcccaagcacttggccagagttcagctaaggatcgggagcgggaggtgggcgagcagcgtggaggtgcttggtgtgagggccaaga

SEQ ID NO: 91537 - DNA, 1176 bp, Homo sapiens
catgcctgtaatcccgccactttgggaggccgaggcaggaggatcgcatgagcccaggagttggagaccagcgtaggcaacatggcaaaaccccatctctaaaataaaaatttaaaaaagttatttctagagctgacatcagaaaaatgaaccccacccatttccctgttagctctgtcttcaacagtatattcctccttcccctgctgccacctgcaggaagtgcacctttgacatgttcaacttcctggcctcccagcaccgggtgctccctgagggggccacctgtgatgaggaagaggatgaggtgcagctcaggtcaaccaggtatggagtgtgagctggggggcgggtggtggtctggaagggtcttagagagtgagcaggggtgagagaggtcattctgagcaccagcctgggtgacactgctgtccctcaccagacgtgccaccagcctggagctgcccatggccatgcgttttcgtcaccttaagaagacgtccaaagaagctgtgggtgtctacaggtgagtggggttgggggggaggatgccccttgggtggacggacaggtgcactgggtagggggtactgtctggtttctgtccccctcccccctgagttccctgttcatcctgccctgcagatcagccatccacgggcgaggcctgttctgtaagcgcaacatcgacgcgggggagatggtcatcgagtactctggcattgtcatccgctcggtgttgactgacaagcgggagaagttctacgatgggaaggtgggctcccagtggctgtgggaagacagtgggtgaagcgagcctgtccgcggggacagagcacctgatctccccacctcatccctgcagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcc

SEQ ID NO: 91538 - DNA, 1041 bp, Homo sapiens
cagctgcctgcaacgcttcgggccgcccccctgcccgggtgagaatccgagaccgagccttgcttgggcggagcttgcaggtgatagggagcggggaaggggcgaggtctgtgggctacgggccagagaggcttgcttaggggtctaagcggtgggccttatgcagatcagacagggatggcaggcagagcctgtgcagatagtgcgggctaccgtagggcaacagcgaatggatatggctggagaggcgggataggggccgcgtggaaagggtgggctttatgtagagaagccgggagtgggcggagcttcgtgcggagcaggctggaggggggtgaaaaggcgagcccggagaaaagtgacaagaccggggcgcacgctaataggctggaagcgtcctggaggggcggggcacgctgggatagggcgaagggagagggcgttgcccgcgcaggggcgggctaggcggccgcactggagcgcagctttcccgctagactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagaggtgcagatgggactcccggcagggcaagggcgtgctggaggtggggggcctagatgtagggagccggcgtagccccacgtaaggggtggggccgtggtttcaggaggtggctggcctgcaggggtcgggaggtcctaggttaaggtagttgggccttgcggggcccaactaccttatcagataccgtatcagatgggatgtggccccattaaaggatataaagttgggaggtttgggagcgggcaggagtggagtgtggcctccagctttactccaaccccttatccccagaggccggtccctgccaaggggcactgccccctcacacctggaaacccaggcgcccctagctcccagga

SEQ ID NO: 91539 - DNA, 1150 bp, Homo sapiens
ttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacggtgagctgtctcctgtcactgacttccgggagtcatgctgtcgccagtatgagatggggtatggtagttcaagggtgggatgggcacttggaatcccagactttgaatgcgtggtaggggctgtcagtgacaatggcttcctccatctctctaccctctatgcagggaatgtacccgaggtggcttctgcaacttcatgcatctgcggccca

SEQ ID NO: 91540 - DNA, 1128 bp, Homo sapiens
tgcggtggagccctagcgactccagaccgtatccagcccgtcctaggctgtgctgctctcgccgttggtcctccccagcctcctgtagtccctggaagagcgatcggcctcacctgcggtccatcccgcggctccctccgcgcttccggccgctctgctccttcacccaacaggccccgcgcgcatctccgtcgcttagcaacgccctatcagccccgcccctctctgtgcccgcgccggaggcgagcggcctccaaggcgaccaatgaaagagaggaaacagaagtacccggagggaggtgtttcaggattggctgggacgactgcctgcccgacagggcgtgtttgattggagaacctgccgagtgtagcagtaattggcaagaccgtgcaccaatgggaaggatctgaggctgggcttgcggttaggaggtgatctaaagtaccctcgcttaaaagtcccgctttttaagcgccttcttgctgcagaagtcctgtcccgaccccggtctaactaccattctttctgttgcaggggcagtggggcgggttggggggggggcgcgctctgccctctctctaaccgctattcctccatcagttgggccaatcagtccgtcccaacggtcatctaacttctttcttgctgcaggagcagctggttgcatcagttgccaggtctgggctcctggccgaggtagcgggatcaaaatgagctatttccagccccagcgcgcggcccccggggggccagcctgaactgttcatgctcgcgccccctggcctctgcgcaccagaggctgagtcagaggcacagaattaggcccggcctgccgggggactgggcccaaggtctggctgaggataagggtagggagggcctgttctatgtcctcctgacatcctggcggggctaccgcattctccaggaatctgctcctaaagacctccatctgcgtcatcctcagagctgccaggggggaggcagtggattaaagggactggaaactcttccgtgggcctcttgggtcctgggccccaatcaccacgctgtgctccccacacccgcaaggctccccctcctcagccttagtttcctcttctggaaattggggaatcttcatgtca

SEQ ID NO: 91541 - DNA, 1033 bp, Homo sapiens
tgctaatccaccgggcgcggtggctcacgcctgtaatcccagcactttaggagactgaggtgggcggatcacctgaggtcgcgagtttgagaccagcctgaccaacatggagaagccctgtctctactaaaaatacaaaattagccgagcgtggtggcgcatgcctgtaatcccaggtacttgggaggctgaggcaggagaattgcttgaacccaggagatggaggttgctgtgagccgagatcgtgccattgcactccagcctgggcaacaagtgaaattcaatctcaaaaaaaaaaagaaaaaaaaaaaggtgctaatccaaaggggaaaactgggtctctcctccctgaggaggaggagcagatcctaagctggcatgtgaggttaccaagggcagtacaacctgcattccaggccctctgtttagaacccccttcccagcagcctttgggttggggctggcgtctgaccctgtcaccctgcagaacctccacacatggaactcatccctgctggacctggagacgctgagcctacagagcagagctgccaggctgctcaaacgcaggtgcccgcacccctgcccccatcacccttcctactgcggctccacgtggcccaggtctcgagacctccattgcctcactcctgccttctccctgcagcaaagcctccatctcctcctcctcctccctcagccccagcgatgccagcacttcctcattccccaccagctctgatggcctctctcccttctcggagaccttcatccctgactccagcaagggccttggccccagggcacccggtaagggctgagaggcaaagactgagggcagcctgggtgcaaatcccaactctgccactgaccagctatgggactttgggcctctctgggccttgtttctccagctgtaaaacagggataaggccagatgaggtgggtcaggcatggaggccgaggcgggcagattgcctgagctcaggagtttgagaccagcctggccaatgtggcgaaacccggtatctac

SEQ ID NO: 91542 - DNA, 1427 bp, Homo sapiens
tatgttgggattttagtaaaagctaaaacacttttttctgggaagttaagcaggggcatgtatcccccagatcttcaatgaagacctacagggcatctctccatggttctaactccactttttgcctgtcagggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctcaaaaaataaaaataaaataaaaataaaaaataaaatgctattctgagggtccctaagtgcttcatgaagtaaagttttcagaagtggggaaagacatatgaaaaactctgttcattttgcattccatgacgtctgaaatagctaataataagtggaatttatgaatccatgttgcatcctacctattattttattatttccgacagttatctaacacaggaggcataaactatgacacatgtaaacataagtatgctccataagcattaaaataaacagacaatcaaaagaagctagaggaaaagaatatgtactgtgtgtgtgctttcgtttatagaaattctaaaataggcaaaactaatctacggtggcagagagcacagcagaggtttcctggggccatgagaggagggttgactgcaaaaaggcatgggagaactttctgaggtgttggaaatattctatataacgattgtggtggtggttgcacgggtgcacagatttgtcaaaactcattgaactttacacttaagatgggtgcatttttattgtacataaatgatatctcaataaaagtgattttaaaaacaggcttcataataacagcccagta

SEQ ID NO: 91543 - DNA, 1006 bp, Homo sapiens
gggcacagagacctctgcccatctgtttctctgaccctgggggagggacttggtcagggctacactttctcggggagacccacccctggcctacagcctgttgtctgggattcactgaggggtatcttccacccctaggaccctcggggctgcccctgctgcctgtgctgttcgctcttggggggcttctgctcctctccaatgcctcctgtgtcgggggggtcctctggcagcggagactcaggcgtcttgctgagggtgaggagagacccttccctgccagggtggagacccgagggtgatagggaaccctgtggttgctgcatactgaaggtcttcctggggccggggtggggggcttgcatagggtcactgagccctttattcctgtttccttcaggcatctcagagaagacagaggcagggtaagtggggatatttttctgtaaagaaggctctgagggaggtttgggggagactggtggcggggggcagcactcaacttccccccacaccttcatcctggaaggtcggaagaggaccgagtcaggaacgaatatgaggagagccagtggacaggagagcgggacactcagagctccacggtaagtgggggtggccctggtgaccccacaatcagggcaccgacggcgactgaagccctgccgttagcatcaggttgatcattgcccttccgggcacagtggggtcagaggatggaaagggctttgtttgttttgcgtgtggggaacaggtcagcacaacagaggcagagccgtattaccgctccctgagggacttcagcccccagctgcccccgacgcaggaggaggtgtcttattcccgaggtgagttaggaccatgtcaggattccctcactcagaggtacccccgacgcctggactgggtgccttgatcgtgtctcccttccactccaactccaggtttcacaggtgaagatgaggatatggccttccctgggcacttgtatgatgaggtagaaaga

SEQ ID NO: 91544 - DNA, 1024 bp, Homo sapiens
caataagagtgaaactccatctaaaaaaaaagaaaaaaaaaaaaagaaagaaacttaacccttcattttccatagaagtaaccatttggtcttgaatttttttgctgtttcttttggttttgttttcacttacttctttttaaaattattttttattttaatgtttaatttgagacagggtcttgctatgttgcccaggctggtctcgaactcctgggctcaagcatctttcagacttggtctcacaaagtactgggattacagggacagtttggtgtttgccagagcagtgttcaccatgaccttacagaacatgagtatgctatgaacaatgagaagcgattgtatatttaaaatcattcctagggaaaacctggacagaatcttctggaattcttttgtatcctctgactgctttcccatctttctccccataggccgccctgaccctccatcaggattaaaggttgtgagtctgaccccacactccgtggggctggagtggaagcctggctttgatgggggcctgccacagaggttctgcatcaggtgggtccttgtcgaggcaggagggaagggaatgggctagggcacttccctgaatttactatccccctgtcctgcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtgggaagggaggcttgggcaggttggagtattcctcagaggatgtgtagggtagtatggtgaagtcaatactattccccttttatgatgagttactgaggcctatagctgttaagcaaattgtccaaggtcacacaactagtaaaagataaagatgagattgaaactcaggcagatgaacttgagaccaaccgttaaccacaacccatactatct

SEQ ID NO: 91545 - DNA, 2103 bp, Homo sapiens
ctgatctccaatctgtccttgaccctaaccttaacaacaatcttgactccctgcggcgccccctctgaagaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccaggtgagggaagtggtcatggggaggggtcccggggatgggaggtcctgccaggtcccttattctggccttccccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactgtgagccccgcccaccatggaaaccacacccacccaaggaaccttgcccattgtggagtctcctcattgtgggagctccgcccacccagggatagccacccatcctggaaccctcccgttctggaagtcccagccgcggtgtaaccacgcccactgcggaacccctcccactagagagacccagtgtggaatctctgcccagagagggtgcccgcctagacacggaagctgctcccgtcaggaatgagagcccactgtataagccctgctacacacacaattctggaagcccactcaactcactctaattatcacagaggcatagtggagggtggagacaacctcaccaaccttgagaactctcctccaaccctttggtattaagggcagattgtgtccacacccataaccttcctggaacccctaagacatccctcccacctggggccctctcacacccagacctgtctgggcccaagtgtcttccccaagcctctgccttccaccagatgctcccaccatccgtgccctccaggaccccactgaggtgaacgtcgggggttctgtggacatagtctgcactgtcgatgccaatcccatcctcccgggcatgttcaactgggagagactggtgaggatccagcctttggtgaatagaggtggggtcaaggggttgtggtttcttgactgtgagttccttgggagtggggaccacatacatctgtatgacccttataactatatactcgccagggcatgctcccagaatgaataactgttggtggcaaaatgaatgcatggataaatggctagacagccaggcgagtgggtaggtagatggatagataggtcaaaaggtaggtaagtggatgaacaggtggatgaatgagtgagtggatggaggaacagatggacaagtgaaaggatggataaatgggtgagtggatgggtgggaagatgattgaaggagaaaaatcagtggatagagggtagatgatggacggatacaccatcagaggaaagatatctatggaaggatgatggatgaattgatgaatggatgggtgggtagatcaatggaaagatgaataaataggtagctgggtaaatgtctgaacagatgcatgtatttatgggtgtgcaagcgtgagtgaatagttgagtgaatgggtggagagctacaggggtggatacatgggtgcagagaaggaagacaaatgggtggaggaatgagtgagtgaaccgatgagtggatggaaagataaatggatgaatggagagataagcagatggataaatgaatggatggacggatagatggttccaagcataagtggttgggtgaatggatgggtaggtggttgcctggattggtggatgaaaagatggattgagtaaatggatagatggatgacaggagaatttttttttcttcaatacctctgtggagggtgattgtggctaggagaatgaggctacagaagggacaatttgggcagtgatggatctggggctagactgggaggccaattctggactcttgggcctccagggagaagatgaggaggaccagagcctggatgacatggagaagatatccaggggaccaacggggcgcctgcggattcaccatgccaaactggcccaggctggcgcttaccagtgcattgtggaca

SEQ ID NO: 91546 - DNA, 1078 bp, Homo sapiens
gggctgcatggagccgtcaggacaagctgcgcggttcccagcctccctgcctgccccggcccggcaccgccgcctcccagccgtcgccgggcaaccaggccgaggggcccggccggccgagtggggagaggggttgggctgggactgcggggtcctgggaaaggaggggccgagggcctggattcctgggtcttaggacgtgctgtagtttgcagcaataacaagggaacagagggatattttgaggaggggttttgaggctgggggagtcgaggtaggggtcccaactgtcccccaggtatcggtgtgccctcttcccgacacgcaggcccgggggagccccggaccccgcatcccccagggcgcggaaactggcgaggccccaggagctcccatttatagctcagtttccactgagcgcagtccctctaggacctgggctgagcaagtttcttccactctctcccttccctcctcctcaccccttgcctgcccctcaaccccggcagggcgcaggtgtccaacccagccgggaccccctccctcctcgaacccaggtgttccggctcccagaccccaattgagctgggggcgcccacccgccgggggatcccgccctgcgtcccccattcatccgcgtctcagccgcgggagtttctcaacgggaagagggcggagctcccggggggcggacccgggcggggcgagcgggatcgggccctcttggggtctcccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggtaccgcacgaggggagcggaggaatatggggtgggggtggggagttgcttgcgggctgcctcttcactagcg

SEQ ID NO: 91547 - DNA, 1041 bp, Homo sapiens
cggacagagggggcaagggctaatgcagtgggagtggcctggaaggagctttacacccagcgggggctggagaccggacctattgaaggcgaggcttttaggagaatcggagtttggaggcggcgtggcctgattgattgaggttagcggagagtgcgctggacagacccggctttgttacagcctttggggagggcaagacctctcctctgagtgacctacagtctccatcccagctcccccagtagtgaccgccctgcactctgcgcctgccttcctgaggggccctgctcgcctccagtgtctggttttcgcctctcccgccccagatgccgtggtaaggaaatgtcactcctcccgtgacccatccagccgtgatccctgacctcccacctggccccccgaaactactgtgaccatttctgacttcccagacatccctcctgcttcttcctcccctcctcagtctcctccgtgtcctccctcttttgtgcccccaggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagaggtgagaccccagcccgaagaccccaaatctggagagtctaaaccccacaaacgcagggatcccccagccgagggctgcaaaacctcataccctcaaatgcagaggagacctccaaacctcgggagtctcaaaactgtgggctcattgattcccaagacacccctcaaccacaaatgccttcacattctgaatcctaaactgagagactcctcacacctaggggccccaaaaagggaaactccaatgattgcaaagcaaattgcaaagtaaaggacccctcaaattctaagactccctaaagccagggagtttaaactcact

SEQ ID NO: 91548 - DNA, 1090 bp, Homo sapiens
tccactccagcctgggcgacaagagcaaatctccgtctcaaagaaagaaagaaagagggagaaagaaagagaaaagggacctgactactggagaggggtggctggcaggggcggggcagtgggctgattgcccccatctgatccccccagatgtacccggagctgcagattgcacgtgtggagcaggctacgcaggccatccccatggagcgctggtgcgggggttcccggagcggcagctgcgcccacccccaccaccaggttgtgcccttccgctgcctgcgtgagtcccaggcggggagaggggaactgaggtgggagtttctgaggggcaaggttctgagcccctctctcaggcctacattaaggggctgggtgcttgtgtcctaagtggggcagagaagcctctgaggataaaatatctggattctgaggagggtggggttggtggctataggaggatctcaccctggtgtcccgtgcttccccagctggtgaatttgtgagtgaggccctgctggtgcctgaaggctgccggttcttgcaccaggagcgcatggaccaatgtgagagttcaacccggaggcatcaggaggcacaggaggtcaggacgttggcccacccgtccccagcccccacaacccaggaactgggacctctaacaccctccgccaccagaaccgaggagtctgggccaccagcatcctcttcgcacttgggatctaagaatttcatcccccaaccccttcctctagaagcaggaatccaggctcccagcctcatcaacccccaaccctggcagcccagttccccatctaccccctcccatcccacaatcctggcatctgggcccactcttcctacaggcctgcagctcccagggcctcatcctgcacggctcgggcatgctcttaccctgtggctcggatcggttccgtggtgtggagtatgtgtgctgtccccctccagggacccccgacccatctgggacagcagttgggtgagtgggagggaaccctccatgcccatctcaaggttcctgaggcaggggatggaagcctgggagcccaggcctgggttcttactgcct

SEQ ID NO: 91549 - DNA, 1336 bp, Homo sapiens
ctctctttgatgcatttatgtctctatcaggccccgccccctgattctggctctgctgggccaatctcacctttattaacctgacctaccccatggagaccccactcatgttagcccccattccagctctttgtcccacccctatcgtgtcatttatacacagcctgtctccagtttgaccctgcccaggccaggagccctgcaaggctttgtccctttcaccttaacattggtcagttctgctcccagattgctcccactcaatcttacagtttacatcctcacattggctcccagtgggcctagtcccacctccactctgcctggccctgtagcccaccccttccagtccataacctttggttctgcccaggcctggacccctggaacgccccccaaccccatgtagccctgcctttccaggctctctttgaccaggctttgacccatcttctcctctcctgaccctgtgcccacccgctccccagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggtgcggggaccgtgggggcagagagcagagggtgagaagggtcagggcgggcttgggcatcctgtgtcccttccacaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgctcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacaga

SEQ ID NO: 91550 - DNA, 1050 bp, Homo sapiens
ctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaat

SEQ ID NO: 91551 - DNA, 1848 bp, Homo sapiens
ctcagacactggtgggaaaattgtcatgagaaatgtacagttctggaaggtgtatggtgtgaatggtacaccctgagacgtggtgttgtgcggtgcacaagacatacaactgaataaggcactcttggtggggctcgcagaagagggccagcatcttatttatttatttattaattttgagatagagtgtcactctgtcacccatgctggagtgcagtggtgtggtcatggcccactgcagccgtgaactcctaggctcaaatgaacctcctgcctcagcctcccaagcagctgggactacaggtgcgcaccaccacgcctggctaatttttctattttttgtagagatgaggtcttgctgtgttgtccaggctggtctgcagctcctggcctcaagtgatcctccttcttcagcttcccaaagtgctaggattacaggcgtgaaccaccgcactccgccaagggtcagggtctttaaagactcctggattctgtgggagggcacctaggtgtgaggctggccctgacctctgccattcccttcccctcaggagatcaagagcaacaagacagttctgcacttggccgtgcaggctgccaaccccactctggttcagctgctgctggagctgccccggggagacctgcggacctttgtcaacatgaaggtgggagctggggctgggaagtgcagattgtgtggggtacggtagggggggcagtgggatgttaggggtcctgggggctgtggacgtggaggggacgatgtgtgggatctgcaggggaaagtataggaagcagacacagattgccccagaacatgtagtccgtggacacagggatgcatgcagcgtggctgtggccgggggaggtctgggatgtgaaaggacaagtgtaggacgtagacaaggcagaaattgaagtgcagtttagaggcctgggccagctgagcccagatccccaccagccctccccttacttttccaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgagggggtaagtaagcactgagcctgcctgtagagtggcctctgagctcgcgggcgcgggatgacctccctgccccacccaatgctcgctttcagagaatgacttctaatctcggaaggtgacttcagccctcaggcaaccctgactctataatgtgacctctgacctcagtgtttcatcctttaccccagaatggtgacttctctgatctctaccccaaccctgacctcacagtgtgacctgtacttccaaccctgaatcttgcttgacctcaaggtgtgacctttgatccccccaagtgtgacctcctaccccctgcccctaaccttgggtcctgacctcagatgtgacctttgacctcttacctgttcccttcaattccctctcattcctcacccccaggtgggaacccccagccagcagcccctttcccttcactgaagttctgcttcctgaccctttctcagtgtacgaacccaggccttgaccttcttcccacatctttatttttatttgtttgtttgtttatttatttattttgaggcagcgtcttgctctgttgcctaggctggagtgcagtggcatgatcatagctcactgcagcctcgagctcctgggctcaagggatcctcccacctcagcctctccagtagctggtactacaggcagtcaccaccacacccagctaattttgtttttttt

SEQ ID NO: 91552 - DNA, 1059 bp, Homo sapiens
gccaggctggtctctaactcctgatctcaaatgatccacctaccttggcctcctaaagtactgggattacaaacgcgagccattgtgcccggcctcatagtagttttgatttacacttccctaatgattgtgtccagcagcttttcatgtgcgaactggccatttgttagtgggttttgcttcttttaaaaactgctgagccatccataaacattttcaaaatgcagggtatgtttttcagtgttaaggcaactgttttgatgtgttttcctttgctctctatcaccaaatactgtacatacaaatagtaagactgggctttgtgttgtccattgttaatcctaaatgcaacaaaacacatggagactttgaaaatccttcagaataatgctatagttaagattttgctaaagcaagtgttttttctaactccttgagctgcatattgccttgagtaatcatcatccgaattgtatcctcttcggtggcacttttgtttcttttgaattcttcccttgcccaatccttcaggtatttgcgatcagaatcatttggaacttgctgaattgtttggaaaatccttctgtagaggagaagaacttgttgccttctgatgaactgctttaacattagtgttgctggggtaagcgggaagtggccatgtctgccagcagtccgccggagcctcagctggtctttttccttctctctttctccattccttaccctatctgtccctctcccctcgtccatctcttcatctcaccataacccttttttttttttttgaaacggagttttgctcaggctggagtgcaaaatctcagctcactgcaacctccacctccccggttcaagcaattctcctgcctcactctccagagtagctggagtagctgggattacaggtgcacgccaccacgcctggctaatttttgtgtccttagtagagatggggttttaccatgttggccaggctagtctcaaactcctgacctcagatgatccacttgcctcggccttcctaaatgctgggattacaggcgtgagccactgtgc

SEQ ID NO: 91553 - DNA, 1059 bp, Homo sapiens
tgtagtcccagctactcgggaggctgaggctggagaatcgcttgaacccaggaggtggaggttgcagcgagccgagattgcgtcactgcactccagcctgggtgacagagcaagaatgtctcaaaaaaaaaaaaaaaaaaaaaggtatgtgcaggactctatcctgttggtgctctatctccagcctatgcccagcacttagtaggtcctcaatccgtacctgtggagtcactacagaccagacccaggtctcttgcaggccctgcctcatgctggctctgtccgctcttgggtggagactcacagcagaggcccaggccctccaggacagcacactggtaccagccatcagctcacaggcaggcatggggcactttgtggttccagggatgtggtccacttcggccacgcaggcctggaagaaggactgtctggtgacaggtgtgtgtgacagggtgccagtgggtccctggctaggcaagaggctacaggcactggaccacatcgtgtctgtgccagggtcctcggtggctgccggacagactgaccttgggcaagtatgcggcggggcgcagggctcgggcctcggcagctgccaagtcatccacctgctgtcttacctttgcagttgccatggaggccacggggaatcagaggtcggaggcggtgtgccaggactggtgcgggaagagtggagggggatcagatgcatgtgagaaggaacatgggggtgaggtatgaagaaacacgggactgtgggggaggggagagccgaggcgagggggttgtaggcaacactcaggatgggcattgtggagtacgaccagcaccacggcaggaagtcaggggaggggcgtggagaccaagggaggaggagagagagtagtagggtgggcagggcggtgtggggagaaacagggattagcattagggacaagggagggatctagagccagggaggagtctggagagactaagaggacgaggggctattctgagaggaagggttggtggtgagggaggggcaggcagggaaggggtttggggaggagccaatgg

SEQ ID NO: 91554 - DNA, 1027 bp, Homo sapiens
gtcgtcaggctggcaacccacgccgccaggctccccggtcggggcccgcgggcgtacgaaggcgcccatggcggtggcgtggcccgagcgtagcagctgcagctggcgccgcccgcggcggtacaggtactcgatgcgcagcacgtcggaccgcggcaggcccgcatgctgccggaactctgcccgcactcgcgcctcggcgcccggcttcccacgcccggcgcgcagcagatcgcggtacaggctcagaacctgcctctgcagccggctgtgccggctcatgaccgcggctaagcagagacgctcagcgaacgacctgcgaaccgcggagccgccacacagccagcaaaggccaaagggcaaagccacagccacttccgcccagcgcttcccttggcctccaactcccgcctcccgccatccggcgctgccgcgtctgactggctgtcgttgcagttacgtaacagccggctgggagaagtgggcggagtcgctggtcgcggcctcccacgtaggggacgtgtgttcttgaggggacagcagttctggggatcctggcaccgcctggagggcgttatgtgttcggactcctaggtcttgggttggagggaacagagggtcctcacctaactcctgcattctgggagaagaggaagctaggggtttttttgtgtgtgacggggtctcgctgtcgcccaggctggagtgcagtggcgcgatcttggctcactgcagcctcgaactcctgggcccaagcgatcctcccacctcaactcccctagtagctggaaccacagacgcgcgcaaccgcgcccgctatttatttatttatttatttatttatttatttatttattattattattatttgcagagatgggtctccctatgttgcccagaatggctcgaactcctgggctcaaacgattctcagcctcccaaagtgttgggattccaggcgtgagccaccgcgcccggctaccggttcggactttgggtcccaagggcacggggcactgggagagac

SEQ ID NO: 91555 - DNA, 1036 bp, Homo sapiens
ggttcatctcccctctcctgccccagggccttgtcgttcactgtagctgaggctggacccttcagccaggtttgagaaatttccaggtctgagaccctcactactgcctcaggggctccgagccagttctcagctccaccatttcctcttccacacaaagatgttaaatcacttgccctccattagggagccaactggggtatctttgggggttaagccaggatgagccccctccacagatctgcccaggggagaaaactatgccgcttcaatcaatgtgccagtctacagggctccggaaggagtcagatccccacacctatcacctcccagatggtcccttccaggtgtctgtgtgcgtgtgtgtgtggtggcaggggggctgggggtgtttcaaaaatcctgaaatatataaaagctttaagaccaccaacagggaagtagacatatccccaattttattccctttgtccaacattccgagagggaaggggcaaatgagtcaatgttgcccctcaaaaccatcaagtaggggcctttgggggtcttcagttgatcaaccagggtgatagacccctaccccttcctcatggtcctggcttgtcacaattaatgggggaaagttttccagaaggggattccgggcttctcaccgctcatcagggcaccttcccaaaacgttctcagcaaaaagtctgcacttctcagagttaaatacaggagaggggagactccttgaggagccagaagtgggtatgttctcaggggtcaagagaagggcgtctcaggctctccctgtccaccgggggtcgtcctggctccccgtaccttcgggcaagtagctcttggcttgacactgtccagcccgccagcgtcccaggccgccccaagccctcatgggggaggagcaccgacctgtctccaagcatcggaaaaggcgggcctcccttgccgtccatcacggggctctctaggccccctgcgtcgccaaggaggagtctctgacatccccaattcgtcaagctagtctcttaag

SEQ ID NO: 91556 - DNA, 1156 bp, Homo sapiens
gctggtctcgagctcctgacctcaagtgatctgcccgcctcggcctcccaaagtgctgggattacaggcatgagcaaccaggtttggcacggaatcaggaaattagaatgcagactatttgctgggctgaaagagccctgtccagccccagaactctgagtagattgtgagacccacaactctcagaccacggttgtgcagccctgattcctaaatcctggtagacacaggtgggctttggggccaaaggcgttcccaggaaaaaaggcaaaccacaaaatcctaggaacccaccgccccagggaatggtcccacagacacagatgacccatttccatcccggaggtaaaggcccctatgttggtctaggtgggaggatcatagaggggtgatcctgagaaaggagtgacccccttcccacctcttaggtttttaatgccccaaagccaaagtggacccagctctctgggagaaagttacagaactggggtaagtatccctggctgggggcaggagtgattctgggatgtaggctggggcaggggactcaggtccaatagacttaagacatcagagggtccctgacagctcaaggggccccaagagccaggaggattctgaaggggtcagtggaggtcctgagggattagggatttcctgatgagttgggagtatctgaaagggacctgtggtctggagaagtgaggaaacctctgaaggacccagtggctatctccaaacggtcaggggtccctgagaggatcagggtgcttccagccactgtggaatccctaatgggggatctattgctataggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggtaaccacacaccctcggcccgtgtccccccactcagacttctgagctgtgctggggcaggggactctgtacccaccctcactcattaggcagccacatctcccaaacaggcattcacctccctgtccctggcttgggaagcccccctttgacccag

SEQ ID NO: 91557 - DNA, 1025 bp, Homo sapiens
cttgaacctgggaggcagaggttgcagtgagccgagatcgtgccatggcactccagcctgggtgacagagtgagactccatctcagaaaacaaacaaacaaacaaaccacagccagagaggtagaggcagaatccagaaaggcctgatagcaaacactgggggaaaggctgggggtgatgggtgcagatgtccccgctgcctgcctaagggcgtgaccctgtcatcctcctttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacat

SEQ ID NO: 91558 - DNA, 1026 bp, Homo sapiens
tccagcccaaacccagggcaccacctggagccctgatcccccctcagatggcctcctcctcccagaccagcaggacagtgtggacacccccgagcccccagccctttcctcatagatccctggggcccagctctcagtcagaccctggccttttgtggctctgacttctccccctccccgtgtctcctcaggattggcggatccactgattcccccggggacagcgttggagccaaaaaagtgcatcaagtgacaagtgagttaggggatgatatgttgggaggagtgtacgtttggggatgggaggaagggtcatgggttctcaggtatatactggtgacagtctctggtatttaattggggacacagggtccaggaaaatgatgagacaaggtccacaaaaagataggtgctagaggatatgaggaaattagcaacaaggctcttcggggacatgaggttgagcagatactggggacagggatagtcactgggggacatggtgggaattatggacaagaggcccagatgggtattgggaatgtaggatccaggtggggactggagacatggggaggtattaatgagaaggggtctggatgggtattgaggacacaggtggtctgtcatcccctcacttgacatcctgccctcctcttcagtgacgcagcccaaacgcaccttcaccacagtccggaccccaaaggacattgcatcagagaactccatttccaggtgtgtggccaacccctgtcccctctcctatgtgacattcagggagagggatccataaggcagttggacccagaggtctggagctctggtcagggctggaaagagaggttaggaaaacttgtgacttgtaagcatacccagaaacagtctttagggtgtagggccccgcactgaattctagtgaattccactttcgggtgggccggtaaaggaagcagaacacccttcactccatacgagcctcagaacaacagctagagaccgggcggggtggctcatgcctttaatccc

SEQ ID NO: 91559 - DNA, 1363 bp, Homo sapiens
aattcgggggttcctcgctggttcccacccgtggaaatgcattttgcttctgtaaatcacagcctagtcctgctatattttaacccccgttctatcgcctttagacgtcacgatcatagctcactgcagcctcactgccctggcccccgctgagtcattaaggtcccttcgagggttcggtccagagtgttacctgccccaactcttcctcgcttctaccccgccttctctcaccttctgcgatctctatcctttttcctcaccaaggtgggattcttaatccatattgtcactcaaaactatgagaaagacgtgagaagttatttataaaatctctgcagtgctgcctggggaggagggcgtacagaacagttccctaaatcctgagacagaaaaatggaaagaaatgatttcacagtaggtagaaggaattccattagcacagcggcaattaaaaaaattgttttccagctgtgtaggcacaaaatctgtttttataaaatggagatgataagaaccatactactggtagggcgcggtagctcacgtctgtaatcccagcactttgggaggccaaggtgggctgttcacctgagatcagttcaagaccagcctggccaacatggtgaaacccgtctctacaaaaagtagaaaaattagcccggcatgctagcgcgcgcctgtaatcccagctactcaggaggctgaggcgggagaaatcgcttgaacctgggaggcggaggttgcagtgagctgaggtcatgccactgcactccagcctgggcgacagagtgagactctgtctcaaaataaataaataaataaattatactattgcattggagggaaatgaaattttaattgtgatcttcttggcacggagtccagataaagggaggatacctggtagctgctggtggagcttgttcctgccccatgactttctcctgcactgtgattataccgcccactcctggctacagggctctggctgtacctcccatgtgctctctgtcaccaaggttcagtcacactggcctgcttttggttttcctgaggctccatattcttttctgcctcctggcctttgtgattggtgagtcctcagcctgggctttttgctgcaatctgcctgtctggctccttcccatccttcaagtctcagcctgaatgtcgctatcttgaaaggccttctcgaaccccattctaaagcaaacagccaccttcatctgtcacccagcaccctatacttcatagcctttatcttatatgttcctgaaagtgccctttgagctattaaactacatataacaatagcaaattcagagaggcgttatagcaaagtggctaagagcacagactg

SEQ ID NO: 91560 - DNA, 1103 bp, Homo sapiens
gggcccagtaatgctgatcgacagataagacaacatgagtgccatggcttggttgtttgtgttggaatcctggcactaccccttcctggatgggtaacccctcttggcctctgtttcctcaactgttttgttcctttttttttttgagacagagtctcactctgtcgcccaggatggagtgcaatggtgccatctcagctcactgcaacctccgcctcctgggttcaagcgattttactgcctcagcctcctgagtgcctgggattataggcatgggccaccacacctgactaatttttttgtatttttagtagagacagggtttcgccatcttggccaggatggtctcaaactcttgactgagccaccacacccagccttgtttaaattttaaatattactgttcatgtggttttttactcgttgaaaccgctcaaatttctggactgtgaatctgatgtggggaaactgtctacctttggtcactactgtgtctctcctgtacagcccaaagtgctagctttggagccagactgcctgggtttgtatatcaacattgccacttgcagatgtaggatcttgggcctcagacttcttacctgtaaaacaggggtgataatagagccttcttcgtggcttgttgggaggattcaagtcttttatacatataaaagtactaagaggccgggcacagtggctcatgcctgtaatcctagcactttgggaggccgaggcgggtgtatcacctgaggtcaggagttcgaggccagcctggccaacatggtgaaaccccatctctactaaaaatacaaaaattagccggacatggtggcatgtgcctgtaatcctagctactcaggaggctgaggcaggagaattgcttgaacctggaaggcggaggttgcaatgagccaagatctcaccactgactccagcctgggtgacagagcaagactccatctcaaaaacaaacaaaaaaaagtacttagaaacttattcacaggtcaccttctcaccgcggcattcgcccccttcccctgtgctcctaacctccttatctgctttcttctctcttgcacccatcattacttggcatctatttc

SEQ ID NO: 91561 - DNA, 1966 bp, Homo sapiens
aaagtgctgggattacaggcgtgaggcaccgcacccggcccccattccttctctcctgttccaccccatttattgtgaggcttctggtcttgaagtcacttcatggcccaagatggagttctggctgtcgtgtgcgtatttcaggaggggaactggtaggaagcagggcaaagggttccctttgacgagtatttcaggaagtcccacacagcatgtcagtttacttctccttggccagactaagtcatgtagctgtacctgcatagttgcaagcataaaactggggttatgtcagtaaggaaagagaggcgagtggatatccaggaggcagcttgccctgtttgttgcagtaaggagccacgggaagcctgggaagcaggttgacttgatgatgaatattccatgaagttgccaaagtctcacttagcgacatttacttagttatctacacaccaatttaccatctcacgtagggagacaattattagattgttaaggaacaaaggtaaaaataagattaaaagagagaagggagtagaaggaaaccatacaatctgggaacagtgaatcttgctgccagaaacctacgagctagcctgttcattcagtgcttgtgcaggctagctaggagtatcagaaacattttggctctttatggattttccagaacaccttgagtatttagcagtggagcacaggctgcaggctaccttgatgtgatgcctgccaggatcctcccatcagcaccacccgtttagttaggccaggcctgtaccatttcctgcatctctatttctcagtgttacagggtggatagggtcttaggatacccactgcggcagagggagaagaaagcagggtccgcatacagtgtctactccatttgggtttggtgtctcagggcggaaggggcctttgcatttacccccatttctctgtgtgctttgctgggcacaccagcggcactggctctgtgggagctgcttgagctcacctctgctggcctcttccgaggcttgggaggcagaagagggcagagtcctatcagagtcgccaggatggggtctggctggccaccctcagcggaaccagtgatcagctcttttctttatccccaggaagtctctcagtgctctggccttctcccctgatgggaagtacatagtgacaggggaggtgagtcgtgatcgtgactgagtgggagtcgggggctggggggtcttggaagccattccttctgctcccggcaggcctgggagtccctggaatagctccttcctgggccagaacagccctgtagcagatgggggaggtggcttttgggcacatcctgtggcaatgccatcttcggccttgacaaccctctagccctgcccagtacagagcccagcagcagtaacgaccccaccttccctagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaaggtaagagccgaccagcaggcctgtggcaggcagccagctgccacagcatcctatgtcttgggcacagggagagctacatgagaggacgcagtaaagtgctcactcacccaacagataacagctattgagcacctgtgacatgctgatcccttattgtagggcacaaggcaggctcccagctagaagcattatacatatttttatattgaccagctgtgaccttaggcaagtgacttaacatctctgtgagtctgtttcctcctctgttagatggatatagtagtacttatcttgttgagttgtgagactttaatgagttgataagcactggaaggctgggctttggaacagctgtggagctggcagaagtgggtacca

SEQ ID NO: 91562 - DNA, 1056 bp, Homo sapiens
gccattgcactccagcctgggcgcaacaaaaaactctatctcaaaaaaaaaaaaaaatttaagcctaaaattcaaccctgttactacaagtgacttacctgaagttgcagtctgctgaacaggtattttccatacacagctacgtttctctgtagacagcagtgacaattctgtttccgttcatgcctctgcctacctgctggcacatgtctttcaatagcagcagtatgctatatcctgatttcacaaatcttaaaatatgctaaaatgggtgtcttagacccaaggaactgtaagtcttctctggaggcctaaggctgctctgtcagtccccatatccccgggccaggccacgtgaagcaccaaatccactggggtcccttttgcccctacaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggtactgccctgtggggagagggaatgggaggggcccacccagagtctgtccactggcattcatccatgcttccagatccatctatctgtctgtccatcccacaaatacccatcatgactctcagccctgggcattacaaagcagaaaagtccttgccttccgaggcaagcctcacagtgagaagtgaggctgggtagggggaagaaacagtgagaaaacaaaggaataatatcatttcagatagcggtcagcatggtgaagaacagtgcagagcaggtgtgaatgtggcggagtgtttccatccacatggctgacccctactaagtggctgctaagtgccagccctgggctggaagcaggacatgcctattataatgaagcagcaaaatctctgcctctctgcagtatagcaagggggctcgatgataagcaagtacacgaaaaagataatttcaataggcatgagtgctttggggaacacagcagggactcgggaagga

SEQ ID NO: 91563 - DNA, 1620 bp, Homo sapiens
cctggtgagaaggagctgctgtgtggagagctgggtcccagcagttgaggtgacagcacactgggcttgttacgttgcaggaatagtaagggactgtgtggccagagcccagtgtgtccggggaggatggtgggagatgaggccagtgtggggcgcctgtagtctatcctcaggtcagtgggcagttgctggggtttcgggcgttggggtaaatgaccaggccttacatgttaggtccctcagctgctgtgtcgagagtggatagaagcactaggctgtggctttcttctcctttgttgcaagtctgttttatggaattgggggctacctaaccagggggtgccaggtgcctagggctgcctctttgtggatttctggatgctagctcctgggtgccttttccacgacagggcctgaacaggggaactgggtgtcatgaaggaaaggagggggcgagcaacccacaggcagtgttgtgttgtagtagtcgggctcacagctctgctgtcttctgttgtgctctgtgaccttgggaaggtgactatacctccctgtgcttccgttttctcatgtgtaaaatacagtacctagctcttattgtggttgtgagaatttattgcaggtaaaactctcggcctggcacagtgtaaatgctcagtaaactgtagccttcatagggagaccccaggccaagggacagctccccagcctccttaggacacagaggctttttgatcatgcgttggtgaggccaagaagaggtgggacctgagatacatgcctattatctttctatgctcagagagagagcaggagcttgggttgggtgaaatgatgggcgataaatgttcataggaatcaaaaactcaattgctctcggggccaggcaaaaatttccggtttgtagcctctatatgaaaagcaaagcagaggaagagggaagagggaaaagtagaattggagcaggagagatggatggccacaaataccatgagggatggcattgccggggaggcatctccactgtcactagaggtggctgtcactactcagtgacattgatggtgattgattacccatgtggccttgttagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgagccccccccccacccccttgcccctgcttggcctctgcacagttccccacagtttgggaacccattcagtaattccttcagaagatactcattgactccctcctatgcatcaggccctgtcctaggtgctgaggacacagacacaaaatccctgcccttaacaagctcacatttggatgggaaaggaaacctggaaacatcatcagtgaataacacgccaagcagcagtaaccctctgaagaaaaatgaggcggggaaggggaaggggaatgcaggtggtattctagagaggagaggggtcagggaaggcctccctgaggacatatgagcaga

SEQ ID NO: 91564 - DNA, 1056 bp, Homo sapiens
atctcttctgccccagagggcttttacaggaatccatgcttaagtatagggcctgggctcttagaggtgcccgtgcaactttagctctttctctactattttccaaacaaaattcatttttatcctatcctataatttgtcatcttcattgtggtataatatacatccagtaacatgcacagattttaggtatacagcttgatgaactatctgtgtaattcacgtgtgtccactaccctgggcaaaatctggagtgttttctacctcatagaaacccccttctgcccttcccagtcaggtccccgcaccaggataaccagtgttctgacctctcaccaaggactgggtttcctattcttgaacttgatataaatagacacgtagagggttgggcctcctatttttggtgccacacctcttcctcatctgtaaagggactgataatgcaggggcagaccaggacaagctggttgcgagtggagggcatggcacaggccctggttcacagcctccagcagtggggctgctggcatggttcctggcgcactgttggtggccccagccatgcctgcctcagaatggctgtgctgtcttccccatagtcagagagtccccaggaagctggccgcgggcacccctccttcctgccccagcagaaggaatcatctgaggccagtgagctcatcctctactctctggaggcagaagtgacagtcacagggacagacaggtgggtgtcctttccaccaagggagccttagttggaggaacccccagctgatagctgcatcctggaagaagtgctctctgccttcccagtgggcttgtgggagtggggacagttgaggcctggatggggcaggagcccagccttagttccctggttccaggtggggtacaggagggcctgacctgggggaaggagggggcatttggaggaggcggggaggctgtcgcagtgctcctgcaggagcagcgggtacaggtgcctaggggctccgggtggggctagctgttgagtctccagctgaagtccttgttccctctctgccccca

SEQ ID NO: 91565 - DNA, 1661 bp, Homo sapiens
caggctgtgggctcctgaccccgactctgtccttcagactcgggggagtcagaggccgacctggagtgcagcttcgcagccatccactccccagctccgcctcctgaccctgcccctcggtttgccacgtcgctgccccatttcccaggtaagcaggggccagacacgcaggggactcgctgctcgggcctggcttagggccagtcacaatgtctaagcacaggccctgcacttggagcccactgagcctggaagacggggatccctgcttctcagcctgcgggcaacagggcagggatgggtggggcccgctttctccatttcaggtggcgtctgctgtgactcatggtgttggctcctcttgtccctcccctccttccctgtcaggatgcgcaggtcccacagaagatgagctgtccctgcccgagggacccagcgtccccagcagctccctaccccagactccggagcaggagaagttcctccgccaccactttgagacactgactgagtccccctgcagaggtagggccctgcctcacccacacctgccgaggccgtctgtgcagcctgggcacagcattggcgtccctggagttggctccccagcagggccaggagggtgagtggagagcaactgcttcgttttttttgagacggagtctcgctctgttgccaggctggagtgcggtggcccaatcttggctcactgcaacctccgactccctggttcaagcaattctcctgcctcagcctcctgagtagctgggattataggcatccacaaccacgccctgctaattttttgtatttttagtagagatgaggtttcaccatgttggccagactggtctcaaactcctgcctcagatgatctgcccgccttggcctcccaaagtgctgggattacaggcgtgagccaccgtgcccggcccactgcttcactcttgacctgagcctcacgatgcctcctcacccactgcccctgctcgtaccctgtgtctgtacataagggtttctggggagtgccccgctgggctgtgggctggcctagggccagggctgctcggcgggaagggttatgagggtcccctcgggatcttcccctagagctcttccccgcagctctgggagacgtggaggcctctgaagctgaagaccacttcttcaacccacgcctgagtatctccacgcagttcctctcaagcctccagaaggcatccaggtagaagctggccaagcactgcccaccctctggctcctcaacagtgccccagggcaggctgaatgagaatcatcccccctgctctcctccccacaggttcacccataccttccctccccgggcaacccagtgccttgtgaagtctccagaggtcaagctcatggaccgaggcggaagccagcccagagcaggtactggctacgcctccccagacaggacccacgtgagtattgggcccacctccgtcagggcacggggctgggaaccctgaggccttgtcctcacctcagagctgtgcctgcaggtcctcgctgcagggaaggctgaagagaccctggaggcctggcgcccaccacgtgagtgccccagtcccagacggacagtcctgggtttctcggcgagtggccggatgtccagcctagctgtggggcgtggg

SEQ ID NO: 91566 - DNA, 1092 bp, Homo sapiens
tagttggctcagctccaaagatggatacttgacctggccacagggactgtgccattcattcattcgtgcattaacttaaatatttaatgagcattacatgttgggctttgtgctaaaccctgggacatgggacatggtggtaaacaacacagagaactgacagcttcaatggggacaatgcccagactaaacctttaaggaacccgtcatatgtatcacgaagtgacacatgcttaggagggacagaggagggcgagggagtgcagggtggggacaggggttgggattacaaaccagaagataagaagaggcttcagggaggaggctgcattggagcagagacctgtaggagtgaaggggagggagccttggggacccagagaagtgttccagacagaagtacagcatggagtccacccagtcgctctggccgctcacaccaatggaatgcagctcatcttgctcattcccttctctctaccccaggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtggtgagctaagccccagagttgggaaagggttgaggggtctcttgagaccgcccggccttggtggcccctgacaaggctggcatcccttgcagttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctggtgtct

SEQ ID NO: 91567 - DNA, 1106 bp, Homo sapiens
cccccttaggtttttacaaagccctcactggctggtgtcttcacccagtgaatgggggacaggggtggaagcagggacaccagtgaagtggctaccatattagtcccggcaggagctggaggtggtcctagtggtagcaatagaggtagcaagaaatggttttcaccaagacaggcttctactcaatgggtaggcatggatccagggtgatcctgaaatttcatggggatttcttctatgtccagaagcttcacagggatttctcttctgttggcaggtctcacagatttcaagcctggctactggattggtgtccgctatgatgagccactggggaaaaatgatggcaggtaacaagaattcccactcaggtgtctgtgtgtgcatttgtgtgtaagtccatgcgtgctgcttgctgagctgcccatgccagcttctagagtggagccatgtgagggtcctctgaccacacccacccctatcctttcctgcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtatttagaggacttcatgatttggggacccactgggtaaatagtggcccttcggtatcaggggccagcctctgtctcctcatatcttgctgttcccccatcttctcatcattcccacctcatctgctgtagctaccaggaagaaagggaagggaagggaggggatatcctttgcctttaaaaatgatgtacagccagctgggcacggtggctcacgcctgtaatcccacactttgggaggccagggcgggtggatcacgaggtcaggagatcgagaccatcctggctaacacggtgaaaccctttctctactaaaaatacaaaaaaattagcc

SEQ ID NO: 91568 - DNA, 1165 bp, Homo sapiens
ggaggcctgatcagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaaggtgcggagccaatgcgtctgagtgacattttacggaaggggcttgacttatgagtgtggtcagaggttttaggtgggttaatgaggaggtgagcccaggaggaagcaagacctaatggggtagggtaaatggcccagaatgggctgggcttgctgggaactggctggattaatggagaaaaatgccctggtagggatagggcaggttggcttaattagccacggccacttagcagtgatcccttgaaggggcggggaccaatggctggggtaggatgttgggaagacgggcatttaggaagcgggccatggagtagggtcttgggcagatggcacctgaggaggataaggccttgggaagctggggcagagcctctatgaagtgagccctccaaggggcggggtcttttgattctacgtgggattttttaggtttagggtggccaagatgactgaaatctgccactgggtaggtgtgcctggcaggaggggagcctcccaggggaccggtctctgggtttcctcgagggtggggttggcctgaggaagggagaagaggggcacgaccagggcagtgtggattgggacagatgaggacaagaacaaatgaaaggcacagcaaccaagtaaggaagataacggctggggtctggagcgttggggctgatggttctgtagtgctgcccgttggaggccccgc

SEQ ID NO: 91569 - DNA, 1037 bp, Homo sapiens
accagagcgacaccacaggcaagctgggctttgaggaattcaagtacttgtggaacaacatcaaaaggtggcaggtgtgtagaaacctctgaaatccctggcacccagacccccaagccatggagacactatgccccacaatgctcacttggacccaatgtctctgtcctcacaggccatatacaaacagttcgacactgaccgatcagggaccatttgcagtagtgaactcccaggtgcctttgaggcagcaggtatggctggcagggacatgctggggctgggagtgggatgggtgagaaaacctctactcagctggtctgggcctgactcctgggcatgggagtgggttgggccatgtggcccccgcacctgaaggactacatccatcttagggttccacctgaatgagcatctctataacatgatcatccgacgctactcagatgaaagtgggaacatggattttgacaacttcatcagctgcttggtcaggctggacgccatgttccgtgagtgacaacccagctgtcttcctgggtggggattcctatgacctctatggaccaaggtctcctctaagcctgactttgaggtgggcgatgctaggggcacagtggtgattgaatcagttccagtttctgccctcatggagctcacagtctggtggaggagacacaagtccccagacagtgacagttcagactggtgatggctgggagaggggaagctcagggcagagtgatgggttgtgatgggggcagcacaggccgagggtctagggctctggtgaggggaagagtgagcagagcgtgctcagattgtgcttggggaagcctagagggcaaatccaatccaggaggaacctgatgcagcccaaggggtcagggagggctcactggagagggaacattgagacctgaggggatgaggagagaacttagtgagaaggtagggaatactgttgcaggctgagggaacagcctgtgcaaaggcctagaagggaaagaagatggggcttctgatgctttttgtta

SEQ ID NO: 91570 - DNA, 1807 bp, Homo sapiens
ctctgcatctcctcctccaggtgccttcaaatctcttgacaaagatggcactggacaaatccaggtgaacatccaggaggtaaggacccccatattggggtatgggtgcctgggaggaccccacccctcagcccttcataccagctctgagctgcagtccccttcctcctattttgccagccgtccctgggtgagggcaaaggggctggtgctcttggggttccctgtcctcactctccaccctcctctccccagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctatgggatctgcctcctgatctgacccgagagaggaggggtggctcgggctctgggtcctggggagcaggggaggtagtagattcgtccccagggctggatccgtggatttcctcgtctttttctcgtcggcattttttgtctcatcctgagctgtggaggctgagacaggacccagaagccccagtgatctctgcttctgcttccagagtctgggctggagggaggtctcaatgccactcctggccctgtcccccaaggccatgtttgcccctcttgcagcttctccatccacacttggcctctgcctctgttgtgtcatggaccatgctcagtgtcttccttcccacttgaggacaccaccccacgtccccgggtcccgagggggagcctatgggtgctgtttggggtactcagcagagggctgagaggtagcaacatcctaggagtatccctggtccagcatgaggcaccgagggctgggggcagtgggcagtccacagggcagagatccctggctggtgggaggatgggcttggtggggaggggtggacacaaacacagacacacacagaggccagcgtttattgacacttgttcaagtctctcaggccccccaggcttcttggtcttaattcctggggaaggaggcccagccaagggagtacaagctgtagacagtgcctagaaaggggaagcgttggagacagaatgagacctaatcccctccctggacatcccaggcttttaaggccttcaggctccctggttcccagcctggaccccagctctagttcggactccagctcccttcccagattggactcctattgtaaagccccctggctttgatctagaccgggctgggagctttctccccgactcctccctgggcctcagccccaccactaacccagcccccgtcctgggacaagagcccaaaccctagttactcccctccctgcaggcctgactccagctcagtactcgacccccttcctaaacgccaacccc

SEQ ID NO: 91571 - DNA, 1019 bp, Homo sapiens
caatccactcttcggagacaactggggacccccaccccggcccaaagccccgggtttgaacttgacatctcgggaacccttaacactggcctcacccgggccttctcaggcagcctggacgctcccggggacctccattccggtccccacgttcccgggacctggtttcctccctttaatccaggaaaccctcccccaacaaaaatctcaggacttaggccccccagaacaaagtccttctgggtcctctcccttccaggaccctctaggcagcccggtcacccccaggccagactccagggcgagtcccctcccaacccagctggcagttcgcgggtaacagaatccaagctattaccctcctcgcctttgggacgctcgctagggatggggctgtccccacgtccaggcctcagagagcggggtcccacttcaggacacccctccaggtgcctccaatacccgcccacctcccaccccgcaggtgtcccaggcgctgatccgctccttcagctccaccgcccggaaccgctttcagaaccgagtgcgcgagaaacagaagctcttccaggtggggggtcggggggggtggggatccgacgcgccagccgggagcgcgccgagccggggcaggcggggcgcgctctaaggagcagccagcacccctttctcatcagacacccccacatccaggaggacaatgacatcccgttgtacctgaagggcggcatcgttgacaacatcctgtaccgagtgacaatgacgctgtgtctgggcggtgagcgcagggcccgtctgggctgcgggggaggcggggctggacccagagtaagaggtggctggtttctgggcaggactgaccaggatctgggttgggggttggcgtttaggaagggggtcgagtactgagctggagtcaggcctgcagggaggggagtaactagggtttgggctcttgtcccaggacgggggctgggttagtggtggggctgaggcccagggaggagtcggggagaaag

SEQ ID NO: 91572 - DNA, 1549 bp, Homo sapiens
tgagtcggggcctggctcgttttgacatttttgcgcccacgagtcttcggagagggcgtcgccactccagaccttccagcaagcttgaagtcatctgacgctaaaggactacttacctcaagagctccatcgtcacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggaggtgggatctgggcgtctcgggtcggtcggaccggggaggttaaaggggaggattcctgatctttaggggcgcggcgcgagggcagggagtgggtgtaagagcttctggcctacgtgcggggcggagatgggggcctctgaggcgggtttgagcgagtgtgaccgagtttgtcctcaaagtttgacctgatgtttgggattgttgagtgaatgtgaaactgggtgcgggattgtgtgtgattgtgcctaagagggagatgtaggagaccagcattgaggtataacgtttgagctgcacttcccttgtcgaaagtgctgataattataacggtgccatcttcctggagcgtcttttttacttgaaaattgaaggggtggaaaagctaagtggtgaataattttaaaacgagtttttatataaaagcatttctttttaattggagtggcatgcaaatcaccgtgacttttttttttaattaaacgagagtgtttcgaaggaactttagtttcggggtgcctacttcagactattcaaatccccatctttggggtacttaaatagggctgttaagcaaagccctagactaaacagcattgtacgctttgagaagcaatcccatataacggcgcccaggatgagggagtcaacggttttaggttaggcacagttatcctcattttttgaagaaagcttaattgttgcagtgtttatctatgagtctggactaaatcctaggtgtcttaattccttaatgagtcgaggcgttctcaggttgtatggattttgtgaagtaatggagaatgctactgacgtctccaaagatgcgttttctaaggaaatcaccccgcccccgctgtcgtcattgacatagttttaaattacaaaaagttaaataaagtaattgggtaccaagttaatatctataaataaatagccttctaatttacaaatatcagttagaatacatagttgaagaaaactaatatttacaatagcagtaaaaagataaagtattgtggaagaaacttaaaggttcagaactattaggaaagaactttaaaatactactaaggggcataacaaatgtgaacaaataaatataccatgtgacattaagaagtgtg

SEQ ID NO: 91573 - DNA, 1029 bp, Homo sapiens
tataaaggtaaaatgaagggcttaccatatggcagccatggttctgggcactttatgaatttaactcctttgtgctatggttctttgtactccattttagaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagagaatttacagtggggaaaacccctttgcctgtaaggtatgtggaaaagtcttcagccacaaatcaaacctcactgagcatgagcattttcacacgagagagaaaccttttgaatgtaacgagtgt

SEQ ID NO: 91574 - DNA, 1015 bp, Homo sapiens
acattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgttttaattattttaacatggcatacacactatatcggggtccccagctccccccagctgcatggcaggaggtgagtggcgggtgagcgagcattgccacctgagctccacctcctgccagatcagcggtggcattagttctcataggagcgcgaaccctattgggaactgtgcatgtgaggaatccaggttgtgcgcttctta

SEQ ID NO: 91575 - DNA, 1137 bp, Homo sapiens
tttatatccagaatctccagcatcattgccacaggccaatcaatacgttttccctctggtcagacacatcagttccttttgatatagagacttgattccccatttcctgtttccttgttcccatctggtctggtttactctctcagtcacagctttcctgaaactttacctacttcctgaatcctatgttgtcttctttttttgtttactccctcgtttttgtggaccacatcctctagaagtttctgaagaaactcttcttgagtccttggatgtctacaaatgtcttttctcaacactcaaaacagaatgatagtttgtttatgaaagtctaggtcagagtttattttctccatcagaatattgaagaatcgttcttattgtttcttgcttttagaggtgttcttgagaattccattgcccctctaatttttgatgccttttatatgacctgctcttctctctggtggcttttaatgtctttatcccttattctgaaatttgactctcagctatttgggaaaagagagggagaaagatcacatgtatcgttgatttattatatgacaggtatagtgtgaggcattgcatatacaatttcatttaattggaaaagccctcttagctgaatttttgtaccttcccaaccttgtttggataatggaggtatcctagcatactcaggcagtttcatttggaggaaacagaatgacctggaaacccagtgattcagttgtgcttatttgtttacagtcctccactgcttcccagacattcatatgctcactatattttacttcctctaccttaatctttttcttctctctttccttcacaaaagtactttttaaaaaattaatgaagtcatatacgtggttattgttccaggagtcagtgatgttcagtgatgtgtccgtagacttctctcaggaggagtgggaatgcctgaatgatgatcagagagatttatacagagatgtgatgttggagaattacagcaacctggtttcaatgggtaaggacatctgtccatagtaatttagattctgcccttggaaggcctacttcctccaatgtgaaatgctcacctggctttcaaaaaccagtcgaattttgatatcctgttccacaggaatg

SEQ ID NO: 91576 - DNA, 1688 bp, Homo sapiens
taatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattc

SEQ ID NO: 91577 - DNA, 1553 bp, Homo sapiens
ttatgcctgtaatcccagcactttgggaggctgaggtgggcggatcacccaaagtcgggagtttgagaccatcctggcccacatggagaaaccttgcctctactaaaaatacaaaaattagccaggcatggtggcgggctcctgtagtcccagctactcgggaggctgaggcaggagaattgcttgaacctggaaggcagaggttgcggtgagccaaaatcgcgccattgccctccagcctgggcaacaagagcgaaattccatctcaaaaaaaaaaaagaatctattttacagtaatacatttctgaaattatattaataatgggaaacttcaaaggtgttagtgatattatgttgatgataatgataacctaatttattggacgcttattacatgccaggcactatatattatattaactttttcaattatgatttttttgtacttccttttagaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagaga

SEQ ID NO: 91578 - DNA, 1144 bp, Homo sapiens
ctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaacatacttgtcttggtgtacatacatgtatttctcttg

SEQ ID NO: 91579 - DNA, 1033 bp, Homo sapiens
cgcgccttctccacatccgggcgtttccggccttggactacatttcccacaggcgcccgggcggttttcgaactttgatctctggttccccttccaaattctcatagtgcgtggctgggatgagggcggcgctcacggtgaggaagccccgagctcccgggacgcagacagggtgtgcagggccgtagctcgggcctgtgtatgcacctgtgcgtgtgtgtttgatgccaggacaaggcggcggtgtgcgcggcgaggaggctgcgacaggtgcgtgattgtgttcctgtccctgctcggatgcgggacctttgggtggccgtggtcggctgtcgggtgtgtgacactgtagggtttgagaccttccatcatgacagtgctgctgtggccgtgtgatggaagagccttttaggtctgtggtgttgtgtgtgtaacgggtaaagcttcatttctgcagtgctgtgtttaatgttgggactgaggggtctgtcgaagatctccccaatgtgcctgtgaggactatgatccatgcctatgttaagcagagtcatcttgcaatgaagcatggcccgcgttgtcttctcagggcacacctgtccccagttctcagcctggtgtttgacacaggggatcctggcggagtgcccacctaagcggcagttttagactcgattgtttcttgggctctgcatctctgagttcccagcttccttttttctcccgctttatagctgtatagaccccagctgcagtgaaatggccatcaaaaagggaagggataatcgagtggtggaataaaatctgcaaacagaaaaaggacagacctgttttcggaacgaggcttttcgagttgtaagtgtcccttaagcagagttctgggaagacgtcgtggggagaacctaggagtaggattccttcctcagaggctctcccttgggaactctcagaggtcaggttccatgtgatccacatcattcccagagctgtctccgcaggagacttaacgtgaattttgagaaagtccccagtcctg

SEQ ID NO: 91580 - DNA, 1038 bp, Homo sapiens
taagatgaggttgagcacagtggctcatgcctgtaatccaaacactctgggaggttgagacaggagtatcacttgaaccaggagttccagacttgcctggacaacatagggagacccccatctctgcaaaaaataaattagccaggtgtggtggcacatgcctctggtcccagctactcaggaggctgaggtgagaggactgcttgggcccaggagtttgaggctgcagtaagctgtgatcaccccactgcactgcagtcggtgatggagcaagaccctgtctaaaacaaaacaaaacaaacatgtaagactagaaaactgtacaggctacaccctgaagaatagaaaatcctatggaaaatttgccagggcatgctaaaagactaacatttttataataaaagtagatgggatagctcttgaacatcaaattccagaaaaatttcactcatgaagatacatgaaaaaaacttacatagatgaacccaatatttaatcaaagaataatatagtagatatttgcttataatgtttaagctctgagcaggatggataatttttatttttgaggtggagtctcactctagttgcccaggctggagtgcagtggggtgatcttggctcattacaatctctgcctgccaggttcaaatgattctcctgcatcagcctcccgagtacctgggattacaggcaccctccaccatgcctggctaatttttgtattttcaatagagatggggtttcaccatgttggccaggctggtctcgagctcccgacctcaggtgatccgcccacctcagcctcccaaagtgccaggattacaggtgtgagccaccgtgaccagcctggatgggtaattctgaatgatgaaaagttactttatcaatttcttctaagtgaagttcttggtatcttttagtgttacatgagttaagaaatggtgactatatgtacacatatttagcacattttgtaagtcacacctttaacaggtagttccctcctaaattattgtcatctatggaatttcacaa

SEQ ID NO: 91581 - DNA, 2510 bp, Homo sapiens
gctggtctcaaacttctgggctcaagcaatccatctgcctcagcctttccaagtgctgggattaaaggtgtgaatcactgtacctggccttcaaactatttttctgtctgaactatcacccataattatctcctttaacctaaatgcagcataccctgctattgagatcctagtactttggtaactctggatcagattacttccctcatattagactgatattctgctatttcccagcattcctatttttaagctctgaattatataagacattcatcatagtacttggaaacttgtaggtattttatgacttattattctgttattgaggtgatacctggataatcattttttattgagctcctcagatgaatatgatcaaaataaaacatatttctcatcacttgactcaacttttatttcttttaaatttctacttatttcttgccctttttttcatattgctcatatttgagaattttctaagccattcacttctcatatgctttacttcaagattttctatatctattttagaagttgtattgctttttgtacatacaaccgtatgatgtttttaccttcttatttttcagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcattttaacagagcacacatccagcagcagcagcagcagcagcagcagagaattcatcatgcaatcaatataggaaagaaattactgatcagttatcaattgcagaatatcagggtaaaattttatg

SEQ ID NO: 91582 - DNA, 1203 bp, Homo sapiens
agctgtgaaccccagataaaagatttcccacattctttacatacgtaaggttcctcaccagtatgcattctctgatgtcgagtaagttgtgaaccccagagaaaggcttttccacattcttcacattcatatggcctctttccagtatgaattttctggtgtcgattaagttctgaaccacgaaaaaaggtctttccacattccttacattcatagtttctctcaccagtatgaattttctgatgtcgattaaactctgagccatgaagaaaggtctttccacattccttacattcataggatttcctctcattgtgaattttctcatgttgagcaagatacgaagcccaagtaaaagtcttcccgcattgcttacattcataaggtttcctgccagtatgaattcgctgatgtcgagcaaggtgtgagctccaaatataggctttcccacatttctcacatttataaggtttcctaccaacatgaacattctgatgttgagcaagatttgaaccacgaataaaggcttttccacattccttacactcatgagatttctcaccagtatgaattctctgatgctgagttaggtgtgatccacgagtaaaagctttcccacactccttacattcataaggtttttcaccagtgtgaattctctgatgtttaataagatgtgatcgctgactaaaggcctttctacattcattacattcatagggtttttcaccagtatgaattctctgatgtcgagtaagatctgagccacaactaaaggccttcccacattccttacattcataagatttctcaccagtatgaattcgcttatggacactaagttgtgaatgaaatctaaaggctttcccacaatccttacatttaaaaggtttctcaccggtatgaattctcttatgaccagtaagactcgaacgtaaactaaaagacttcccacattctttacattcatatgttttcttaacagtgtgaactgtctgatattgaataacttctgaatcaggaagaaaggtattcccacattctttatctccacagaatttctcacttgtgtgaattaactgatgttgagtatgatctgaaccagaaataaaggctttccccagttctttaaattcattcagtttgtctcctgtattaagtctctggtgtagattaaacactgtatgctggttaaaagtgggc

SEQ ID NO: 91583 - DNA, 1018 bp, Homo sapiens
acttggtactttgttatcgtatcgtttaaaaacgaatacataggagaacctttgataatatgtatcctaatttgttctccttacctgttttaaaaaaattattataaaggttaacaaaatggtcttactttactgtcattcaaccagtatgaattccctcatggcgaatgaggtcagagcgactaccaaaagcctttccacattccttacagtcatagggtttctcaccagtgtgaattctctgatgtcgagtaagatttgagcctttattaaaggccttcccacattcattacattcatatggtttttcatctgtatggattctctgatgttgaataagttctgagctctgaataaaggcctttctacattcttcacattcatagagcttctcaccagcatgaattctgtgatggttagtaagtgttgaggcactattaaaggccttcccacactgcttacattcataaggtttctcaccagtatgcattctctgatgctgaataagccttgagtgttgagtaaaggctttcccacattctttacattcataaggtttctcaccagtatgaattctcagatgtagaaaaagttgtgaacttttagtaaaggcttttccacatactttacattcatagggtttctcaccagtgtgaattctctgatgatcattaaggtttgagcaatacttaaaggcttttccacattccttacattcatagggtttctcaccagtgtgaatcctctgatgttgagaaaaatatgaactacaactaaaagccttgccacattccttacattcatagggttttttaccagtgtgaatcctctgatgtcgagtaacgagtgagccacgactaaaggacttcccatactccttagattcatagtgtttttcaccaaaatgaattctctgatgttggataaattgtgagttttgattaaaggtctttccacatatcttacattcccatggtttctcttcactcatagttttttgaggtggaataagaaatgt

SEQ ID NO: 91584 - DNA, 1049 bp, Homo sapiens
ccctcccacctcagtctccctagtagctgggactacaggtgcacggcaccatgaccggctaatttttgtattttttgtagagatgggattttgccatgttacccaggctggtctcgaactcctaagctaaagtaatccgcctgcctttgcctcccaaagtgctgggattacaggcgtgagccacagcacccggcctagtttttataatcttaaaatttacattttgcactgataaaatcaggaggaagatgtatagctatttttaaaccagaattattaagccagtctttttaaaaatttctgtttttgagctagcagttcttgtgaggttgtggggttatttttgcggggtgcgggggggtacttgtttttttttttcttttttttttgcaattttataactatttgatgtatttgacaatcagtgattagttctcatccacattgactgtctgtagatttttgaaagtggtaacagatacatagataaccaaagtatagagtttatttggtgaatcttcatccccattacgtattctggacaaccgcacatggattcgttatgggacattccttattcctttggcccagacagctttgttgagcctggtatcagtgcgcacatctggagttcccatctccttcatggcaaatttctgaatctctttgagtgtccgaggggcacgcttcttgaagcccactccatggatgcgcttgtgcatactgatggtgtattctcaggtcaccaccttgtggatggcagaacggccctttttcttctcaccacccttctttgtgggagccattctgccggatccaagttggaaagacttgtttattttttaaggctagcacattcaaactactagaagttttctgtgactgtctttgcactacaatcacacacttggatagcccacaaagctgaaaatatttgctatcttattctttatttaaaaagttgcccaacccctgctcgctatgaaccagagtagcactcctttaattttgttgttttattttcagctttattaaggtataattcacat

SEQ ID NO: 91585 - DNA, 1066 bp, Homo sapiens
tggtgaaaccccatctctactaaaaatacaaaaattagctaggcatggtggcgcgcgcctgtaatcccagctactcgcaggctgaggcaggagaatcacttgaacccgggaggcggaggttgcagtgagccgagatcgcaccactgcactccagcctggcgacagggcaagactctgtccccaccccaccccacccccccaaaaaaagaggggaggttgtgaaattgtctgggagataataacactgcggcttatgtgcggatatgggatacctgtcactgtgggggttgtggctgtgtgttcccgtggtgatgtgtgattgtgactctgcgacagtgtggggtgcctacgattgtgcagctgtaattgtgtgtttcctatggtgtgtatgtgattgtaactgtgttgccgtgtgtggctccttgtgggcaggtgagacgtgcatgtcgccttaagtgtgactgtccctaaatgtatgtggcattctgtgtatgagtatggggtcctgtcaactatgcgattgtgactccagaactctgtctctaggaaacctctctgaggtctggtcagattccaaccctggacagcagtgaacacaacctttcccctgagccactggaattggacagaatgccccattctcctctgatctccattcctcatgtgtggtgggtaatggggctggggaagaactcttacttgactaatctgggtaccaagaaaaacctggtgtctcacagttactcttccctctcccaattttacctttctccaggtgtcacccagaagaggaggaaagaatgcatgatgaacttctacaagcagtatccaaggtgtgttggggtttcctctttttcttctgaaaattcttgcttaaaggaatgtcatttaattataggtccctataattttcccatcacagaaaaggatggttgctccacttatgcttgctgaattttcttctcaaatatttattctgatttaaaaataaaaggatgattaatttagagatctcaaaaacacagcattaccaagaaaaaataaaatttagccactcagataacta

SEQ ID NO: 91586 - DNA, 1008 bp, Homo sapiens
ccacgccgattcctgtcagctcctcgcctgggcccacccgaaacggctgctccctcaactctcaacatccagccgagcctcggagttgcgggtcgccgtagcgctgcgcaatggagatgagcctcccggggaacccggcccaagcctcaccctcacacaggaaagcagatgtgttctggccggaagttgagtggggccgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatggggtgattgtgatatttggttgcgcgggattatgatgaaatgtgtgatatgtgtgtgattatgattaaggctgtagcgagtgtgaacgtggcgaagtgtgcgtgattgtaatatgtctagtagttcttgtcttgagctggcttttctgtagcatttggcacagttggtaacggcttgaaaaacacttatttgttttctactgatcctccctccttgttggccactcctctgtagtcttctttgctgtcttttttaccctagtagcccttggccctttgtaattttccactattccttggcgaacttttcaggttcattattatcttatgacttgctgcttttatgtatgttagttagctattgccatgataataattatgtctaaaaaccacccctgaactcaatgccatacaacagcaagtccttactctcctg

SEQ ID NO: 91587 - DNA, 1793 bp, Homo sapiens
atacaaaaaagttagccaggcatggtggtggatgcctataatcccagctacgtgggaggctgaggcaggagaatcgcttgaacctgggaggcagaggttgcagtaagcagagatcaggccactgcactccagcctggacggcagagtgagactccatctcaaaaaaaaaaagaaaaaaaaattttaaagatcatcccaatctttaaatttttggggtaactattattatgtacttaagataaacttcctgttagaaataaaacagcaagattctagggagataaaatattgccaatagattcattgggcactgcatacttagccctccataaatccccatcagaccccatatgattaaattagccatctgtgtccatttcagtgtctatagctagatggcagttaacatttcttattgcttcaaggatcattcatctgtagagggtcttctagccacctggtactgaagatttctatattcctttgtctgaaactttgaagcaaatctgtttcatttctcttccctcagcttggtgttctcaagagtctgccctttccgaggaagaagaggatacaaccaggcctcttgtacgtcttaagcatttatttgtttcctgcattattttgcagtgcagttacggtgggttcttgtaacctaccaatgtgttggaaaaaataaattgatgaaaataaaagtgagaaaaaatacagatagaaaatcagaacctggggaaatttgagatatggctatgcagaagcaggtacatacagaattattaaagttgagttcaaatttaaatatgatctggacagtcaaagcaaactgggacacttaagtttattccgtaagtccataagttgcaccatttatgaggaaaaacttacaattatttaagtaaaaggcttttaactggcaccttgttcaaaaagaaactctaaaatatagttggacttctgtatctgtagattctgcatccatagattgaaccaactgcaaatcaaaaatacttgaaaaaaaaatgggtggttgtatctgtactgaacatgtacagacttttttcttgtcgttttctaaacaacatagtgtaacaactatttacatagaaatcacattatattaggttttataagtaatctagggacgatttaaagtatacgggaggacgtacattggttacgtacaaatcctacaccattttatataagggacttgagcatcagtggattttggtatccgtggggggtcctggaaccaattctacatggtttcctagggacgactgtaattccttaattcttacaatttttagcttagcttttagaagttggtcttggccaaacttcaaaaattcaaattacctggaagagtaagtggaacacatatctttcaaatgatcctacgtatatattttcttcaattgagtttttaatccaagttgagctaaattatactaatattctatggcagaatcttatagttctgatatccatagcttttcacatcttttttatggtctcagaagatatagtcttcatcctcatcttacaaaattacgtattctctgctcttgattctttttgtttccacctctgaagtcactcacacacctatattttgaatgttttctgcttaactgcctctttttcttcagcttatgtctttcacatcatgaaatatacacacatacttcttttgaccatatgatcatatggctcatccagttacttctgttggcgcggtggccctagcaaacctctctggccctcgacaggcttgagtttaaatcttggct

SEQ ID NO: 91588 - DNA, 1774 bp, Homo sapiens
ttatctatttctgaaacattcatcagttgattattgtgtcaagctctgttctgagtcacatttactgtgttatttagtcttcacatcaaccctttaaggagaattccactttatagatgaggaaactgagactcaagtttggctatttgtcaaggtaacacaattagtaaattttgaagccagagtttgaacccatgacattggataccacagcctattaactggtaaaaaatatctaaacccagctccgttttgaaagtttagtatttcagcattttttttcagtcagaaatgtgtcagtcacatgtctgttcagcctttctgctgcttttgtgaatagaaaacaggcgttcattcttatccttggggtctgcaggttaactatgtgggcatctctgctttgggctgcagatcagctggccttggcttaggctccacagtgggcttgtgtctgctctgcatatattcattctgagtttcagctgaaatggcacagcttcctgggccaaggtcttcatttgctgtctcactggagcacatgagccaaggtaaagggtgtaagcaaatttcaggcctttgctcacatcatgtttactgacattccttttgccccaacaaagggctcagacaaggcccacattagtagatgggacattagtacaggcaggaagtgaagactcgctgaataatcaatttatcacagtaatattttctaatggaattattttttgttgagtttgtttttgagaccaggacttgctgtgttgcccaggctggagtacagtggcatgaacttggctcaggtgatcctcccgcctcagcctcccgagtagctagatgataggcatgtgccatcatgcctggctaatttttttattttttatttttcgtagagatggagtctcactatgttaccaaggctgttctcgaactcctggcctcaagcagtcctcctgcctcagcctcccaaagtgctacgattataggtgtgagctactattcccagcttcactgagattttttaaactttaaacatattgaaatatagtcttataacttaaaaaaactttattaacatataagtcacatactataaaattagcccatttaaagtatacaagtgagtggtttttagtgtattcacagagttgtgcaaccatcaccataatcaatgttagaacattttcatcaccctgaaaagaaaccctttacctgttagctttcacttcctgttttcccttaaggctctgatgtaggcaagaataaatgatttctagctctatggatttgcctattttggacatttaatgtaaattgagtcatatgataaactgttatcctttgtgttgcctttcgcttagcattatgttttcaagtttcatgcattttgtagcttgtacgagtactttttatttctgaataatattctcttgtagggatataccacattttctttattcattgattaatggaaatttgattcatttccccttttaggctattatgaataatgctgataagaacattgatgtacaagtttttatgtggtcatatgttttcacttctctgaagtttgtacatagaaatgaaattgctagatcatatggcaactctatgcttaaccttttaaagaattgccccactgttagccgagtgcaatggctcatgcctgtaatcccacactttgggaggctgagatgggcagatcacctgaagtcaggagttcaagacccacctgaccaacatggtgaaaccctgtctgtactaaaaataa

SEQ ID NO: 91589 - DNA, 3826 bp, Homo sapiens
ccaaccattatttctttgaatgttttttctgcacctttctctcttcttcttctagtactcctacctctgacccctgagtaccagctaaacaagttcttgtatgttgtgatcacaatgcctaattttgatgacttcaaattaattagcattatgtttttacaggaaacagtgacatttaaggatgtggctgttgaccttacccaggaggagtgggagcaaatgaaacctgctcaaagaaacttgtatcgagatgtgatgctggagaactacagcaacctagtcacagtgggtaaggtggcttggtagccttgcaatttaacagagaattcttttccatttctgaaatgtgtgaagactgtaacttgccagatgaatctagcctttcctttctccatgtgactatatgtgctccactcttcagtgttaaaggctgattactttgtgtcattgtgtaagttcattcatcctcatcttttataagccctcaagcttggacttagcctaagatctgaatggttgtctccagcattgacatccacatcctttgctatttcttgtaataggctgtcaagtcaccaaaccggatgtgatattcaagttggagcaagaagaggagccctgggtgatggaggaagaaatgtttgggaggcactgtccaggtgaataagtgaaaagcagctctgaatgagaaagccacatgagagttgttcagtgaagggttgatatcatttcacaatttccaagattttcttaaaggccttattcttctagagtgacaaatgggatggagtgctttagattactgtgacatttctaggtattattcttcctattttgcagatattttcctcttttaaattgtagagggccagtagccctatccaatttcataataccaaccttccctaattcattcacagcttcactttcaggattattgttcctctctctatgatcctcgggcactctctttcctttatgtttatggtttcattttcttatgcattcagtatttcatggttgtgtagtaattttaaaacatgtttcacacttaggtttcttttcatttctttccttctttcttttttaaaaagccttagatttgtgtttggttaacaatagtttcacttcccattgtgcttcacaaccctcacaatcccatggcttagaaatgtaaaagtttctggcttagaaatcccatggcatctcctttctgcttattcctgccttccattcctttaatttttttgaaactacatgaggtccatccttggttgaaaagatataaccaatgtaaccaatattatacctataataccaatattataccttttgtgcaaaagtaaatcttcctcttatcctggacatggtcccttcctttccacagttgcatacacttcttttttggagttatcctggctatttttgattatttattttaccatatgaattttagactaaactgtctatttccagagaaaaacctgttggaatttttattgggattgtgctaaatatataaattaactttcagaaatttaacatccttttaatgccaatgttttctgtctaagaacacacactgtctttgttcagattttcatatctacttctgtgtcctttagaaatggagctttccaagttttcccattgttgcttttatacatttcactataataatgggtaagaaagctataaaaccatccttatttacagataatgagattgtatccctagaaaacacaagcaaaccaattgagaaagtacaacaaatagtaacagaactcagtgaggtggtaggatatcaaattaacaaagaaaaatcaatagctttcatatatacttcaacaaccaagtagaagatactaaggaaagaaaactacatttatagtagtaagaacaaagatgaaatactcttctgggcatggatatataacagtataccaaacaaaatcctgtctttatgagcttataatttaatggaaactagagtccctgaggttttgcatatgggaaaatatctttttaacctttacatttggttgatagttggctgtgtgtaaaattcttgaaccatactttcttttccaaagagttttacagacagttacctgagggatttagacaattctctgttgtttcctagattcaaatgttgcttggagaagtctgaagcctgattatttcccctcataggtgacttattttccaggatgcctataggtttctttttctttaaagcttaagtggctttatgaggctatgccttggaattgatcaatcagtatcagtttttcctttcagcttgtggattcatgatttttgttccttgaaatgtcgtcatatagatttcatgctcgtttcttttgtggttatcattgtcatctttcgatgaaggtatttcctgctgtagccactgtttacagaaggatagtgttgaagactgtccagaaaaatactctgagttggtaagaagtctctatacctcacactgacctcctttatcatacaaggttttgtgttgagagttggtttaccctttcattctcccaagttaaagagagattattatttgcatacttcctctagaactcagtgtctcttccatcttcctatgctaacaaactgcttatataagaatactggctgtttgcatctctttgttcagccctgcctttgtaccatttgtcagggccagatgaagtccattctgtacctgccacaatttcaagacatctggcaaaaaaatgactcattcattctgcccacaagggggtgcctctgttttagagaactctgttccctgtactttttgttggagataagaaacaggaactgctatctctgggtttcttccctgcctaatccagtctattttctgttctttcctcctattctggggatggagtttagctatctttaaggttcattgaagatgtattttctttctttttttttttttttttttttttttgagacggagtctcactctgtcatccaggctggagtgcagtggtgcagtctcagctcactgcaacctccgcctcctgggtttaagcgattcttctgcctcagcctcccaagtagctgggactacaggcacgcgtgaccatgcctggctaatttttgtatcttttagtagagacggggtttcaccatgttggccaggctggtctcgaattcctgacctcgtgatccgcccacctcggcctcccaaagtgctgggattacaggcaagagccactgcatctggccagaagatatattttctttttctgtttcttcttcatgtttgcagagtgaagaggagacagagatgtttaattctaccatattgaaacaggaagtcctctatgctgtatttgatccatttcacccttcttggaaatgtctttcttctttgtgcttctctaaaggattcaaattcttccttggttctggtttattgtttatttcttcttcccttgtgaaatatcttttacatgacttctttctcatctctcactggacatcacccaaagtagttctgaattacaatagacttctttttcctcagagtaccttcatgctatatctgtgttcatgctattaaataggtatttaactctagaaatgacagcattggaatatgtatctttaatgcctccagaattttgaaactcttcatatctctgccattaattatgagtgctcttacctaagttctagcagttatttaactttaatatcattttctaataaatggtcctcaatatttccagcctacattggtcttgcccatctctcaactaacattctattacacgtctaccagagtggttggaat

SEQ ID NO: 91590 - DNA, 1497 bp, Homo sapiens
gtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaagccctttggtggtggctcagaacttagttgacaccagaaaattcatactggtgagaaaccatatgaatgtcagcagtgtggaaaggccttcattcgggcctcacaccttagtcaacatcaaagaattcattcaggacagaggagtgaatgaagaaatgagggatggctcagaatttgattgacatgagaaagttcatactgatttggaaaaaaaaacttatgattctaagtgtgagacaccttataaatgttaggaattagcagggatttatttatgtttcagaatttattacacatcatgatacaactggtgaaaaattgaagacctccatgaatgtaaagaaagtagggaggcctttttggtggctcagaacgaagtcaacctcagggaattcaaatgggggagaggagggcagtgaatatgctgagaggagttaatcattcaga

SEQ ID NO: 91591 - DNA, 1035 bp, Homo sapiens
ggtggcgcacagctgtaataccagcaacttgggaggctgaggcatgagaatctcttgaacccgggaggcggaggttgcagtgagctgagatcgtgccattgcactccagcttgggcaacaagagtgaaactccatctccaaaaaaaaaaaaaaaagaaagaaaatgtaaatgccatatatatgggacaccaatttgctttagctaacaaagtattcatctgacaatacttgaggaaggctagagtagtatttaaaatgcagcagattctttcatcccacataaatcttgttaaatattcacgagctaattctctaaaattaactggagctgaatcaatgtggggaagaatttaaccaatgtttagtttttactcacccttatcattattactcatttcttttagggtgaatttattaactacatctacattttctcatttataaaatagtactgttagcaccatatttcttagctgcattgtgggggttaaatacatttatattatttaaagcagtgtctgtctagtattgaaagtgtgctaaatgaaggcgtttattgtttttctttgttattttcttaatcatgcattattagacatgagaggaaggacttatatttgcagtgactataggaacatattgcatcatctctttttctttattgaaggttaggtaattccttctggagaaaaatttaatactgtgaagcctttatttatagctcacccttttgccttactaggcaaataatgtgaagaaacccagtagaataaaagtgggttgctgtgaagtcaggcggaagatttagatatttatcaaaacttttcaaaaggctgggcacagtagctcaagcctgtaatcccaggaatttaggaggccgaggcgggcagatcacttgaggccaggagttcgagaccagcctggccaatgtggcgaaaccccatctctactaaaaatacaaaaaataagccaggcacgatggcgtgcatctgtagtcccagctacttgggaggctgaggcaggagaatcacttga

SEQ ID NO: 91592 - DNA, 1015 bp, Homo sapiens
atgatgaaacaatgaagaactgccctttccctggacttggtgcgaaataagaaactgcaggagtatgttgtaagtttatttttatttttatttatttatttatttgagacagagtcttgccctgtcgcccagactggagtgcagtggcacaatctcgactcactgcaacctccacctcccaggttcaagcgattcttgttcctcagcctcctgagtagctgagactacaggcgcctaccatcacgcccagctaatttttttctatttttggtagagacagggtttcaccacgttgcccaggcagatcttgagctcctggcctcaagtcatcagcccgcctcagactcccaaagtgctaggattataggcgtgagccaccgtgcccacctgcatatgttgtaagtttatactccactttttacaatatatctgaggcctggaaagttatttttaaagacatttttatatatacacacattcaactttcgtaaagtttatattcagctttttatagtacatctgacattgtagaaaagcattttcttatatatagttgaaatatatattcaactttgatttagtaaagtatatgaaaaacataatttacattcagcattttatagtgtatgtttatattcagctttttatagtatatgtgaaatcctagaaaagtattattttcctgaataagaaccaggaagaaactgattaaagagctataccacataatttctctagtactagattatcttacagtcttctacctcttcaagatacaaaagtcatggctgtgaggctatcattacccttttaccaaagttggaaaaggacagcatccaaaataagtcagctataaaaaaaagtaaagtcggccgggtgcggtggctcatgcctgtaatcccagcactttgggaggctgaggcaggcggatcacttgaggtcgggagttcgagaccagcttggtcaacatgatgaaaccccttctctactaaaaatacaaaaactagccaggcga

SEQ ID NO: 91593 - DNA, 1414 bp, Homo sapiens
cgtctgacgcctgcgcactgagcgcgggcgggcgggcactcccagaaacctccggggcgctgcaggcgggacaagcaggttccacaggccgagcccacgagcccctcgaggggtgagcggcccgggcctcctggcgttctggccggctagccaagcgctggactacatttcccagaggcacggcgtccggagcgctggactacatttcccagaggcaccgctcccggagcgtagcttcatttccgttagtttgcgagatttggaggcctcgcgtggggagagggccgcgtctgtggaggagcttggctccgcacctgctgggctggcgaacccgaaattgggcttggaacccgggagccagatcttggaccctgaactgcacctctgtcaaggtaggagtgtccgggatgccggagcggacacgcgcggagaaagcgtcgctggggttactcgtgtggccgtgtctccggttttgtgtgcaggctacagcctgcctggtattggcgactgcctgtgcatacacgactggacgtgtgtggctgtggttttgtgtatgagcatttgtatgagtgtgagttgtgactctgagggtgtttgtgactgtttgcttacctggctgggatatacttatgtgactgtgattttatgtgtgccgcgtgtataattggggtttgcctgtgactatgaagtgtgtgacagttgtgacaagagtgtttggatgttcttgtgtcactttgaggttgtgtgtaaacctgatatcgtgggatggatttgccagtaaatttaaggtgtgtgacagtgttgctgtgacacggtgtttattaccgcgtgtttccctgatttcgtactgggttgggtgactgtctgattgtgtgtgactgtggggttgtgtgtgctgttttcatgactgtgtaaagagactaaaattgcagctttgaaagggtgtttttggcggtatgtgtctctgacaaggtgcttggatgtaattatatgccttgtacttaatgggattttgtttgagacaaggtggtctaacaatgtagcataattgggtgattgtgcctctagctgtgtaactgtggaaatgtgattatgtgtgactttatgtggccatttgtatattctgtgaccttatgggggtttagtccagtacagaagtaaatttctttttggtatttctggggttcatttggggctgaggtctgcctatggattgtgagtcccatgtggctctgtgctcctcccatgtggctctgaggacttaaggactttttgatttgaccacagtggctgccctttcatccatggcctgtattgcttcatttctgtatccatcctcggttcaccttgggaaatgtagttacttacgagttcacgacttcttccctgcgtcctcttgccttatagccttaag

SEQ ID NO: 91594 - DNA, 1039 bp, Homo sapiens
gccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgta

SEQ ID NO: 91595 - DNA, 1050 bp, Homo sapiens
atgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatct

SEQ ID NO: 91596 - DNA, 1037 bp, Homo sapiens
cacccttctcatgaaattactcacccttacccttttctctgtgttcaagctggataagccatttttaccttcccctctagcctctgctagctgctctataagcaaaaagtgacttattatcccttgaaaaagtgtttggatttcaaaccttattacagggaatctctggaaaaaaaaaagacttctttccacaatgaaagggaagatgatgatagagatgatgtgagattgtatttcattctagaataacagtgacagactgataaccagatagaatattatcagaaaagaaaataagtatctaagtgatgttgctttaatcaagaaaatattgactacaaataggcattatgaatataaggctatcagaaggataattcatgtgaacccaaacattttacatccccctaaaaaccctatcagtgtgacttatttggaaatggcttgaagcataatttagatctacacattcatgatagaaacgatgcttcaaagaatgttaagaagagtactaactatggtaaaatgtctttctatacttactgtgaatgtactccaacaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccac

SEQ ID NO: 91597 - DNA, 1049 bp, Homo sapiens
actccaggaggcggactcctccactgtacggaatcgatacgcatcaaagatggcgacccacacaaataaacaccataagggcgcggttatattctctgcccgtgagcgccgattacggaaactgcacgatgtctctaaatatgtgtgtgctccctgttgactgtgggctgaaattggcttccaagttaatttagagcatgcgcaatatcaacagtccataaggggaggtgctagaagtcggaccggaagtggaagtggtccccgaaggctatttcgccgctggcgtcaggactattttcacgttttaatgccgagaggtctctgtgacgattttggttggttgcaattagggattctgtgaagtcagtaatagaggagttgtctgtggaattagtgatggtggtttcggggcatggtgatgggggtctgtgacgtccgttgatggttgtctgtgacagggatttctcgggtcattgatggggctctttgggatgagtgattggggtttgggggtcagtgacgggagtctgtggtcagtgactgagggcctgtagggtcagctatggtggtcggtgaggactgtgatcagcttgctttctgacctgagttgaaagttcagttctttccatttcagcctgtaatataaagattaacaagttttgatgtgtagcagtttcgtattgttcaaatctaagtgtttaaaaatttttttcagtaattgtttttctttgacccatgagctgtttagaagtgcactttatggccgggcgcggtggctcaaacctgtaatcccagcactttgggagacccaggcgggcggatcatgaggtcaggagatcgagaccatccttgctaacacggtgaaaccccgtctctactaaaaatacaaaaaattagccgggcgtggtggcgggcgcctgtagtcccagctactctggaggctgaggcaggagaatggcgtgaacccgggaggcggagcttgcggtgagcccagatcttgccactgcactccagcctgggccacagagcaccaaaaaaaaaaaaaaaaa

SEQ ID NO: 91598 - DNA, 1083 bp, Homo sapiens
caatcactcatcccaaagagccccatcaatgacccgagaaatccctgtcacagacaaccatcaacggacgtcacagacccccatcaccatgccccgaaaccaccatcactaattccacagacaactcctctattactgacttcacagaatccctaattgcaaccaaccaaaatcgtcacagagacctctcggcattaaaacgtgaaaatagtcctgacgccagcggcgaaatagccttcggggaccacttccacttccggtccgacttctagcacctccccttatggactgttgatattgcgcatgctctaaattaacttggaagccaatttcagcccacagtcaacagggagcacacacatatttagagacatcgtgcagtttccgtaatcggcgctcacgggcagagaatataaccgcgcccttatggtgtttatttgtgtgggtcgccatctttgatgcgtatcgattccgtacagtggaggagtccgcctcctggagtgttgactagagtaaggcaaggattttcacatagaatgcaagactgtaaccagtgtgaccacgcttgtacccaagaagaagttcctgaagataggatctggagctttatgtttttttttgtttgtttgtttgttttgagacagagtcttgttctgtcgcccaggctggagtgcagtggcgccatctcggctcactgcaacctctgcctcccaggttcaagcgattctcctgcctctgcctcccgagtagctgggattacaggcaagcgccaccacacccagctaatttttttgtatttttagtagagacgcagtttcacgtctctactggtcacgctggtctcgaactcctgacctcaaatgatccacccaccacggcctcccaaaatgctggggttataggcgtgagccaccgcctccggctgttatatttacaatacctaagttaccccttggttacggcacactgcagaaaacaacgatttactaggagaaaccatgggggaactaggaagccagggatcctgagagaaataagggagataagaggaggcatcaggatggtacaatctattttttggag

SEQ ID NO: 91599 - DNA, 1060 bp, Homo sapiens
tacctcagagccaaagaatcttccccatatgcatttatttctctcaggagacctttaatggaggctagaaaatgatccacttcatgttacacatattgtatgatatacttatctcttatgtacacacgcatacttatatagatatatgtatatcatatatatctatataagtatatatatactatatagtatgtctatatatactatataaatatatatacttatctatatatactataaagatactatatatagtatagatactatatatactatatagatactatatatagtatagatactatactatatatagtatagtatctatatatactataaaagtatacttatgtacatatatatggccagtcatgttttaatatggaaaatagcccaaccattgtatatttaccagcctttccagttgattctgatccacatccatatttgagtatcattgtagtaacttatttgcgtagttaccttcctctgcttcctgcattatcttactaatttctttgtctttcttgtccattttttcagataacacagatatccttgtgaaccctgtgtcatttacctagtagatactattcttactttaatttttccatttctattataaaagtttaatttttcacaaataggaaaaaagaacatttaccattttattttctttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtg

SEQ ID NO: 91600 - DNA, 1082 bp, Homo sapiens
ttctatttttagtagagacagggtttctccatgttggtcaggatagtcttgaactcctgacctcaggtgatccacctgcctcagcctcccaaagtgctgggattacaggcatgagcgattgcacctggctttattttttgttgagacggagtttcgctcttgttgcctaggctggagtgcaatggtgcaatctcggctcgtcacaaccttcgcctcccaggttcaagtggttcttctgcctcagccttttgagtagttgggattacaggcatgtgccacaacacccggctaattttttgtatttttagtagagacggggtttcaccatgttagccaggatggtctcaatctcccgacttcaggtgatccacccgcctcggcctccgaaagtgctgggattacaggcgtgagccactgcggccggtctttttattttacaaatgtacatttttaattgttaagccaaaatcacaaagcaaaaaattacaaactaaaaagccaaaattaattgtaatcatacttatagatggctgctctcaatttggtagagaaaatcgtgctatactttgcttttttaagaaagtgtaattatgatatgcatgctgtacccttaactgcttttatcatgccaaagatttcatgagtgccatttcagtaaatatagatttttattattttcatgacatatttaatgactttaaaatgactattcccattatggttgccactaaatttttgcagctataaaagctgacctcggctgggcacagtggctcatgcctgtaatcccagcactttgggaggccgaggtgggcggatcacaaggtctgaagattaaggccatcctggctaacagtgaaaccccgtctctacttagctgggcgtggtggcatgtacctgtaatcccagctactcgggaggctgagacaggagaattgcttgaacctgggaggcggaggttgcagtgagctgagatggtgccactgcactccagcctgggggacagagtgagattccgtctcaaaaaaacacaaaaactgctgacctcattggatgcttatttttacttttaaaacatttat

SEQ ID NO: 91601 - DNA, 1055 bp, Homo sapiens
cctccaaggacagactcattgctattcctggaatacaccaaacatgttcccaccataataactttgtactccttcttttaaagctcttccccagatctccacaaaacttacttgctactttcactgaagttttgttttgctaaatgtcacttcctcagagaggccatccttgacctccctatttaatagatcactcagtaatcaaactctatcccttatttcacttgcactcattgccgactcaacaaatcatcatccatctaaagaggatagctctgctccatcacacatttgagcataacactgactaaaaaagatattaaatgttttgtagaaggattatatgaacaaaaggtggagagagaagtggaaggggtgctcattgggctatttgtgattttccctgtggtcccaaagtcctgaaaaatgaggtcaaatgtctgaaaacaaagtgaaagagcatgcttacctgggacatggctttacaaagccccacagccattcctccttcttcagttttctcttctgaagaagaacaaagtcctgagaagggagagttaatgaagaaatgatgatgtgccagccctgtgtttttggtccaagacccacaaaaatactactgcccctttcttctccctacatgggccagcctcaccttttccaagatctggccagggtggcggggtggaatccaatgctgaacttaactcccaaagtcttgacttatatattaaggacgcatagcctgaactcaacaaaatccaaagtctgtcctacggccaacaaggtggttcatgatctggcccctggctgcacctctgacctaatttcctacccttccgccccttactcgccacactccaggcacatgtcttcctactgttactcaaacactgtacaccccttcttcagggttgtggacttttccttccgtctggaaccttctcccagacaccagcatgggccactcctctttattcctatctgcattcaggtgtcccttcatcagagggacttccctgaaaattctacctcaagggaacccctgttccagg

SEQ ID NO: 91602 - DNA, 1788 bp, Homo sapiens
atttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgttaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagcaaaattttaaaactatgatgaaagtagaatccgttactttagggtaacaagatttctttaaaaaacatgtaaacatggaatagtctgttgaattttggtgtattggcctcacaggcacccacaaatgtacacaaagagatatatatcactgtgttcctgaatcatggtttgtattgcccaaaattggatataacaaatttttatcaattgtggaatagatgaataagtgtgatcatttctgtgataaaatacagaatttagaaacaaaatctacctatagttatatggatagattacaatatataatattgagagaaaaaattaaaatgcacaaaggaacacagtataacatttgtataatttaataagatcttgcaaagaacagtactgtgtattggtcatggatcca

SEQ ID NO: 91603 - DNA, 1027 bp, Homo sapiens
ctcttgtctgattgctctggctagggaaaagtacggatttaactctcttaccatcagtacctccgatacacattactcacacataaaaactttttatttgttcctcaagatatatcaccttttaaattcttttaaattgctacttcttttttaattgctaattatgactgtcttaaatgtctcaatactttaaaatactttaggtgttttgtcagtttcataattttcctgcatatatgctttcatgatgctacatgtattctctgatacagagctcccacatacgcacccctgtttctatccaccctgtgcccaagctctgcatgattattccaatcatcctcacacctattaagaacctttgtggtatgaatattcttggcatttctgatagatttaattatcattccactacagggtgacctttaatccaccctgtgtgtgcatgtttctgaaactaaagacaggcctattttaatgacttttattctcttccccagctctacttctgcaggccccatcccttcccagaaagaagaggaaatgactgagtcccaggtaaatgttaaatagtgtatttgtttcttgccttactctccaatgcaatttaaggggattgcagtaattcatacagtaaattataaaggtctgtatacataaaacatattttcaggggaaatagagttgaacgattaaaactagggaagagttaaaatgtgggtattttatgaaattcattcagagagattaaagctgggcttcaaatttaaatttcctttttacaggtaaagaaaaccagagcaaaaatttgttacataattttcattgtaacaataaaaaatcaacattttctaacagaaataagcttttcattgatacctaggtcaatgaaaacattgtagtgttacttcttgtagttgataaacctagctcttttgatgttctctttcgatcaaggataaaacaaagtgtaactatcaaaatagcccagcattagaaacaatgcaaatgaaaattaacaggaaaa

SEQ ID NO: 91604 - DNA, 1101 bp, Homo sapiens
tatataaacctaggttacgtgtgtaatgcattgtgttacgatgttatgatggctatgatgtcactaggtgataggaattttttagcttcattaaagtcttataggaccactgttgtatatgtgatctgttgttggctgaaacattgttacgcagcacatgactgtattgtagtactttagggaaaagatattggtgatctggaccagagtagtaaaaatgctaagaagtagtcatgtactagatataatttaaaggtagagctgctgtgatttgctgacaaactgaggtagagtgtgaatgagacaaggtgacacaatactgtttttatgagtaacttgaatgggtgtgtcattaactgagaaggggaacaatgtaggaaaaactgacttggaatgtagtgagatttcagtttggaatatagtatgtgaaatgtgagaatgcccattagacattcaagtggagatatcaagttggcagttggatatacaagtatgaaattcaaaaagagagacaaaagggagatctaagatctaggatggagacatatatttgggaattatcagcatataaatggtatttaacacgagactgaatgaggtcacttagagggtaggatagatagagaaaggtagaggcaaatgactgatctctgagtcactccaacataacaaactctgggaagtaaggaggaattagcaaaagagactgatggggactagcttgaaacgttgaaggaaaactaggtgagtgtgatattctggaaaccaagggaagaatgtgttttaacaagaactgtgtcgggtgccacataaaatgaggagtgagaaagaagcatggaatttggcaacatgaaattcatttattagggaccctgaaagcagtgtccgtggaattttaggccaaagagagaactggaaaagaaaacgttggagatatcaagtctagacaactcttgaagactttttttttttttttctaaatggaagaagtgaaatggaatggtagctggagttaagaggtacacattctgtttatatactgattgaaatgatccggtagagagagaaactacaatacaggagagaaagcagataatataa

SEQ ID NO: 91605 - DNA, 1046 bp, Homo sapiens
ttggtcaccgatttctattataaagttttcgtttgtttattttgtgtagaacaggaaaatatgttttggtcttgttttctttcagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttc

SEQ ID NO: 91606 - DNA, 1105 bp, Homo sapiens
agggaggaggatctgttcaggacaggtctgcacaacccattctttggtccaaaccagcccgccttggggtcagagctggggaccaactggcagccctcctgctgaagtgtctagacatatgctttgatgccgcagagtctctgctcttcaattccttgtgcagctgagctgatttcgctgtggttttggggaggacatctttgtctaaactacctcttacctatcaaaacttgtctgtgtgttgggggtgggagttgcatataggaatggagaagtagtaccagtttttaaaatttggaaactctgaggcagttctcttctcatgattttacatgttctttctgcagctctggtgtctgtggaccctgcttctgaagtacatgaaccttgaggaaaattgaccagttctagcagttctaaaatcatggctcgtgtaagttggaatttctctctactttggaattctgtcatttttttcaggttatgtgaacattctcatttgttattctgcaactttctaacagagccccattcaacagcttctccccagtcttccccattccagcacgggatggagccagccagattcctaagtgcccctgtcttctccatctgtatctgtattagtccattttcacgctgctgataaagacattcctgagactgggtaatttataaggaaaaagaggtttaatggactcacagttccacatagctggggagaccttacaatcatggtggaaggtgaaaggcatgtcttacatggtggcaggcaaagagtgaatgaatgccaagagaaagaggaaaccccttataaaatcattagatcccgtgagacttactcactgccatgaaaacagtataggggcaactgcccccatgattgaattatctcccaccggctccctcccacaacacatgggaattatgggagctacaattcaagatgagatttgggtggggacacagccaaattgtaccagtatccatgtgtgcattgaccaaatcattcagcatctcttgtgtgctccttatctgtctagagcagagatggggcagaaatgaagttcctagaagtgggcattttatctgaaattctcaggat

SEQ ID NO: 91607 - DNA, 1027 bp, Homo sapiens
ctatgttgcctagactggtctcgaagtcctggcctcaaatgatcctcccgcctcagcctacatgtgttctttcaaacccagagaaattcacaggaagagccaactcaatcacttgaaacaccaggtagaaataagaaaaagttatattgcagggatcccgcttggagatgttgggggcctaaggtgagggatccagctgccgctgaaagaagggaggagatttgcccaggaagacaggagccagtaaagtgccctgaccacagtgggtggtgggggtgaggggctggtggtggagcatcagtgggaaatatcactcctcatatttgcgagaagtgtgccatggttggaaggtggcttaggtggcgggcagaccaagttcaaatcacagtatagccactaacttgtaagatgtgcactgagcttttttcttcattggcaaaatgggtatgatagtagtctttacctcgggggtcgctggagactgaatgaaatgtctgcaagactttcagcacattaggctgtcattagccctgtgcagttagctactattcttattttattgagttgacagatgtgttgagaccctgctgtgagccagggtcctatcctaggcactgaggattcagcagtcaacaagacagacaagatccttgctgtcctagggtttacattctagccattctagcccgggaagacacacaataaacaggatcatttcactttgtgtttttgagatggagtctcgctgtcacccaggctggcacaatctcagctcactgcaaccactgcctcccaagttcaagcccatctcctgcctcaggctcctgagtaactgggattacaggcatgcgccactatgccctgctgatttttgtatttttagtagaggaggggttttgccatgttagccaggctggtcttgaactcctgacctcaggtgatctgcctaccttggccttgtacagtgctgggattacaggcgtgagccactgtgcccagccttttctttcttttttttttttttaat

SEQ ID NO: 91608 - DNA, 1118 bp, Homo sapiens
aatcccatctctactaaaaatagaaaaaattagccaggcatggtggtgggcacctgtaatcccagctacttgggaggctgaggcaggagaatcaaacgaacccaggaggcagaggttgcagtgagccaagatcacaccactgcactccagcctgggcggcagagcgagactcggtctcaaaataaataaataaataaataaataaataaataaataaataaataaacaaactgctgctttggacatgaaacctgttgtgtcgctgactctggccctcattgctgtgtattctggtgggtgctgtgggctctggtggaagcaacagcagagcttagcttgtgaatgtgtcttacccttgctgtgctccaaagacattgccagtggatggggtgtggggaagggacatcacagtggtttcctctgtcaactctatgagagtcgtggttctagactttttggaggtgtcaggtgcaggttgaatcctggccttctacctaaacagggcaggtgctggagattctcagcttgttcctgtccccagatggtgctcaccacacttatctccaactgctggacagtgcctggcatgtgagagatgctcagtaagtatctgttgaattaatgatacgagccagcattcactgagctcttactatgtaggaggcactgttctgactgcttctcagctaatatcttattgaatccttagaaccactccttggggtaggtactgttgttattaccatgtctcgtaagaggaaactgagttacagagaagttcaagtcacagagctggtgagtctcaaattcaggattcctatgcaagtcactggctccagagtctaggctcttaaacactcactgtgtggtctttcgatgaacagacagacgaacagatggggcagacaagcaggaccattctcacttgttccggcctcctcactccacacgtggtctccccctgttttgggggagccccacaacagatcccaggcccctttgggccctgaggcttttttttttttttttttttttgagacagagtttcactcttgttgcccaggctggagtgcagtggcgcgatctcagctcaccgcaacctctgcctcccgggttca

SEQ ID NO: 91609 - DNA, 1187 bp, Homo sapiens
tcacatctgtaatcccagcactctgggaggccgaggcaggtggatcatttgaggccaggagttcgaggccagcctgggcaacatggtaaaaccccatctctactaaaaatgcaaaaattagccgggtgtggtggcacatacctgtggtcccagctattcgagaggctgaggcaggagaattgcttgaacctgggaggctctgagaggttgcagtgagccaagatcatgccactgcactccagcctgcgcaacagaatgagtgagactccgtctcaaaaaaaacaaaaaaccctagcaaggatcagaatccccagagggctaggtaaaacacagattgctgggccccatctgattctgtaagttcctgattctgtaagtctagcttgagaatttgcattttgtggtgacactggtgcccctggtccaggaagcacgttttgagaaccatgagctactgtaataggaagcccaaatgaaattggcctgaaataacgagatttatgatctcatataacaaagaagcctgtaggtaggcagcacagcagcacaggagttgactaagcagttccacaatgcctgcagggaccccatccctctccttcaagccactctgccatccatggtgtgtctcctgtgtccctaggctccctgcatggccacaagatgactgccaaggctccagttggcacacactgacagtgccacatccagcagcagaaagagggcatctctcacttgctgtgtatctctttaagagtgaggaaacctttcattgattccctgcctcccagatttccctcatatctcattggccagcatggtgatatgtgaccctgcccagagaaaccagccaagggccaattaggattgaccctctggggctggggctggggctggggctggagccggggccagccttacctgaagtaggtagcacagggaggagagtggctacaggaatgaaatcagagtaccatttaggaaaggactgggaaagggggagggatattgggtaggcagacaattggttttgctgcagaaataagtggaacacagggaaagcataatgcccatgcatttttgtcatcgtgcttaccagctttgttttgtaattacctgaatcaggacttagctttttgttctctaatcatgcccacctttgaaactgtgcacaaagtcccagtacc

SEQ ID NO: 91610 - DNA, 1077 bp, Homo sapiens
ccccaccccagcactttcttcctgtgtgacctccagcctatgacttattcgttgaacttctcatctgtaaaataagaatgctgatagttcctccttagagggtcgctgtgagggttaggagagagaattcatatgtagcacttagaacagcgccttgtgcagtgagcattccggttgtggttgttattattagccagccaaagccgttcagttgtgcttccaaagctggctggaagagtccagcgaccgtgtttaatcattaagctgcattgcctctgtgagctagtgcctcctctgcacgggccaaggagcccgcctttagattgtacggttctgaatgaagcatccaggcgcaagctcagggcaggggacggtgtgggcacaagtccagccctggctctgtcagtgaacaggtggcctgtgcctgaatccgaggtaataggcgagccgcctttgttacctttgagctttctttcaagcccattcagactcctcagaccacgtgtctgatgagtaaggaggccttttctttccctcccccaaagggaatgttggcaaaacagctttctttgggaacgcgcctgttcacgacgaccagccatctcctggggaactccggtggctggctggcgtgttcctgcggctgttgaataagtcgctgttaggagctggcacggcaggttcccgtttccgcattccaggcacccacagcgggctgggggcgggcaccactgaggtcggcctggagagccaaggcaggtggcctcgccctgggaggaccagggacaggaggagtccacctggggctcccctgacagccacctgcccactttgtgatcagagccgtgttcggggagtctttcaggtgagcgatattcattaaatttggcagtgacttgcagagaaagttcatcatgtttcttcctctccggagttagacagttagctttttttgttttctctttttttcccccctcttctccctgaaatgtttacctgtctgctcctaactgtgaagaaagagtgggccgggtgttgacggactgagaaaaatggaggacatttctcccaagagaa

SEQ ID NO: 91611 - DNA, 1053 bp, Homo sapiens
gatgatgccctccccacttttggttctttgattaattacacagatatttatggagcacctgttttgtacaggcactattctgggaactgggaagagagtaatggaaaagcaaacggggtctccacccttgcagagctcgtattttaaaagagcagctagatagtaagcaagtcagttacttagtgcgtcagagataaggggtgtgaagaaaaataaaggaggctgggcatagaggctctcaactgtactcccagcactttgggaggctgaggcaggaggattgcttgagcccaggaggtcaaggctgcagtgagccgagattgcaccgctgcgttccagcctgggtgacaggctaaaaaaaaaccctgcctaaaaacaaacaaacaaaaaaaaaaacaaaaaaaaagctttacctcttactaactcatgaccactctgttttcttctatatccaccaccacccaccctctactgtattattttaacgctaaatagttgagtatctgcaagataaggattctttaaagacataatgagaagaccattttaatcatgacaataattaacattaattgcttacatcatctggtatccgcacagtgttaacatctcagatcatctcataaatatctttctagaattggtttgttccaatcaggacccaacagggctcaccattggagttggttcatctgcgtgtgaagcctcatttaatctatggcttctccctccctccagctcactgcaacctccgtctcccgagttcaggcgattctccacctcagcctccttagtagctgggattataggcatgtaccaccacgcccagctaatttttttgtatttttagtagagacagggtttcaccatgttggccaggctggtctcaaacccctgacctcaaaggatcctcccacttcagcttcctaaagtgctgggattgcaggagtgagccaccacacctggcttgatttttctttgtttttctcttgcagtttatatgttcagaaaggccatgtcatttgtcctgtatatgatcaggcctggatctga

SEQ ID NO: 91612 - DNA, 1038 bp, Homo sapiens
attattggaactctgaacatctcacacacaaaaatcatttgtttgcttcttaagtttttcttgggacaaagtcctagagttgcaattcctgaaacagagtgtctatttttaaagacttgtggctgggcgtggtggctcacgcctgtaataccagcactttgggaggccaaggcgggaggatcacctgaggtcaggagttcaagaccagcctggccaacatggtgaaaccccgtctctactaaagatacaaaaattagcctggcgtggtggcaagcgcctgtaatcccagctactcaggaggctgaggcaggagaattgcttgaacgcgggaggcagaggttgcaatgaaccaagaatgcaccattgcactccaacctgggggacaacagcgagactttgtctcaaaaaaaaaaaataataataataataaagacttgtgatatttattgttgacttgtattccggaagggtccagtacaggagttctggtttcctggatcctcaccaacgctgggctcacactgcttctttccctccccacacttttttttgtgtgtgtgtgtggagatggggtcttgctctgttgcccaggctggtcttgaactcctggcctcaagcgatcctcccccatcggcctcccaaagtgttcggattacaggcatcagccaccatccatggcccagaatgctttttaatctttgctatttgggtaaccaaaagttaccaaagtaactaataatttacatttatttgatttctggtgaagtttattgtatatgtatctgtttattaatcatgtatttcctagttaattacctatttctctggggggtatttttatttcttgttaatttgtggaagatttctttacatgttgaagatatgaatcattttgttatgttgcaaatttatattcctaaattgtttatcttttagtttttttttgttaaacattcagaggcttcttaatttttgtgttgttagagctatttttcctttgtgttttttgttttgcttgttttatgtatgctttggctt

SEQ ID NO: 91613 - DNA, 1371 bp, Homo sapiens
aaaatacagaaattagctgggcatggtggcgggtgcctgtaatcccagctacttgggaggctgaggcatgagaattgcttcaacccgggaggtggaggttgcagtgagctgagattgtgccactgcactccagcctgggtgacagagttatactgtgtctaaaaaaaaaaataacacaaataaataaaaaacaaaaacaaaaatccttatcatggcttataaggtcccccgtgatgcagccgtgctggccttgcttactgcacaccagccagtctttcatattcatttctcaaatatgccacactttcctccggcctttgtgtgtgcccttccctatgcctgaaatgcttttcctgactgcttgtcttctagccttctcgttcttatccctcagatcttagcctaaatgtcaagtcctcaaagaggcccttctggactgtcctgaatgtaaactaggccgcttgttattcctgcttggcaaagcttcatagcagttatcataatatttaattacacgttatgtttgtctttacatgtttaatgcccgtcttcctcactgggctggctgtgagtcccaggaggtcaagcccagacctgttatttatttatttatttttgctttgcattgcatccccagtacatactaggtgtgcaaaacaaaacaaaaaacctttattaaatgaatgtggttgaaatagaattgttactcatttaaaattttggttagtttgtcattggactagagcagggaacaaagtctggccggaagtttttaaaaccctggcggtgaaatttcaaagtgaaaatgttactcgtaagttaaatgaattcatactgcagccatattttttcaggctggctggtattagtgatgcccaaagtgactttccttttggagtcttggggccagtggagatggtatatctcccaacaataaaaatttcaccacgttaagtggagtactacgattaacacacatttttaattagcctcttagtcatctcctatctgaagaggccaggacaggcattttaatacttggttattggactacctctaaggagctctcccatgctgcagataccgttctgaatctctgcagtttgtcaaggttcctgcagccggaagctgttttccaggccgctctcttctcactaaagccacagttctttcttcgcactaaagccatccgttcagcttctgtgcagagggaagaggtccctgaactggcatgactgcaaaggcggttgaaccctcctctcctgcaggatgtggagggcatggaggctgtgccgtggatgggtggtgcatctcagaagagttagcttcagcagtcattgggtaaagcaaacatgctagagagtcacaact

SEQ ID NO: 91614 - DNA, 1052 bp, Homo sapiens
gtgggctgggtgtggtggctcatgcctgtaatccctgtgctttgagaggctaaggtgggaggatcacttgaggccaggaatttgagaccagcttgggcagcatactgaagccccatctctacaaaaaatttaaaaacttagccgggcatggtggtgtgcacctgtagtcccagctacttgggagactgaggtgagaggatcccttgagcccaggattttgaggctgcagtgagctgtgattgtgccactgcattccagcctgagcaacatggggagaccctgcctcaacaaaataaaccaacaaaactgcaatgtgataatatacctgtggtttctgttggtgacaaatttgtaagcatgaaaactatagtttgcctatattcctaattgaagaaaatgctgaatttctgttagagattagtgaaaataaagaggtaattctgcccccttccccccaaattagtggagctcctgaattctatcctgcttcaaagagcatgacccagaagttgcacacatttccttcactccttccctgtgatcctgattagttacatggcgacagctagctgcaagggaggctgggaaatgtagtcctcattcaagtcaatcaggtgcctggctaaaatataggggttccgttattaaaggaaaggggggaggataggtattgggggacaagaagtcaatactgtactgcagtacacactgtgcagccactttctcacccaggtcagaacacgtgttcttctcataagcacctgccagaggagttagtttggctttggggaccatggtgtatgaaaaaaaagcgcatctttttttttttttttttttgagatagagtattgctctgtcacccaggctggagtgcagtggcgcaatcttggctcactgcaacctccgcttcctgggttcaggtgattctcctgcctcagtctcccaagtagcttgggttacaggcatctgccaccatgcccagctgattttttatattagtagagacggggtttcaccatattggccaggctggtctcgaactcccgacctca

SEQ ID NO: 91615 - DNA, 1355 bp, Homo sapiens
gccatgttagccaggctggtcttgaactcctgacctcaggtgatcctgaggtcctgccttggcctcccaaagtgctgggattacaggcatgggccacttcacccggcctcattattatttttattggcagcttgaaattgaaatccctgagcaagaggaagccattggcccagtttggatcaggtgggtgggcaggtcccatgattggcagtcccctccacgcccccccccacagaagtaggaggaacgagggagaaacagttgtccccaggaaaagtgggctgctgtcaccagaagttggggcagagactccaggctccaggcaggtccagagcgcccgtgtcctccatgctcagtaactggactcaacaaatgttggttacttccctgctttgtgccatggcctctgctgagcacagaagacacagaagggacagtgatttgcacggtctcctcctcacaggtcctgtagtccagaaattgagggtcctggttaaaactaaatgcctagaacagtgcctggcctttaggaggtccttcgtaaatgtttcctcaatgaataaacacacagggaagtgcaagagttttatggaacacacaacaaaagcatcccactagttattttaaagaaatccatgtttgtacctttagtctccaggatgaggttcagaggggtgtccatgcacacagtaggtgtttaataaatggggactaaattatctaataggtgcatggtcctgcagcctgtccggtgtgacagttgagggcagacccagagttggggagctggctgccttctctgttgaacaggatgtgcagacgtggctccaggatgcatctctgtggaatgcagtcgctaatacaaatgagcttcctcacgtcacaaggcatctattatgtggacagttgggcgatgggccgtgggactgggcgggctctctaggggagtttcagagccacagttatgtttagggccttcctttggagagggacttttccccatgaatgactcttaataacaaagataataatagccaccactttccaggtgcctgagctgtgcaaagggattaacccatggactcctcacaatggcccatgaagccagtatatgatccccattgtgctgaggctcagagagggaaaataacttgcctgttgtgtgcacagcaagtgagaaattgaggtgggattctggccatggtctcttgctccaaagcttgggtttgtccttctataccatgcacagcctgttttctctctctagtactaagtttaaaacaatattatttttattaatttgcatatagtacaatatttaaaaataaaaaggccaggcacggtggctcacacct

SEQ ID NO: 91616 - DNA, 1061 bp, Homo sapiens
gggagaccctgtctcaaaaaaaaaaaaaaaaaagagttttggtttgatcacctgagttctaatacctgctctgccacttcttgtccgtgttgagcaggttacttaacctctctgtacttgatttttgtcacttgcaaatgaaagtgataatacttgcctcttggtcccatagatgccggcaattattattattcctattatttcacagcctctgctgtacagtattgtcagatgacgcagtgccagtggtagcagcgtcgccatcatttcagcagcagtgcccttcgttagctgtaccacctcaccttttctgcaggacaccttcccgcaaatcctttcctgtcaaagggttagggtagagttgctccgtgagtatttaggaaaggaggccctggaagagaggattgtctctttagtccctttatgagtcattggccatagaaagttacatgaccacccataactgcagggaagggtgagagatggagaattttcctaatcgcctcccacacagaatataaatatcaccaccacagctgtgtgcagtacgtatttgtgagcacgttaatctatcttgccatcagagaggctggctccagcatcttacgcatgtccacgttgtggtcagtttgcaagaagtcacccgtgatatgtggcaaaacagccggactcccaacataaagtgctggaaggaagactgtgagggacacagttgtaaaggttctcgaattgtatctgtctgatcagagaaacaatttaatgtcccagatcaaagtcgagaggcaggctctgggaactgggctgtgagcagccagagaaaggcggcagaaccagtttcttcagggcaggtctcttttatctgcttgtctgattgcctggtggacactccattggctcccagaggccttcctggtcatctcctccctctggctgggtccttgatctttgcagatggctgcgtcccctggggccagggagcacctactgtgtgcctagtgctggccaaggtactggagataatcataggtaatgttcttccagcgttcaccatgtgcttggtg

SEQ ID NO: 91617 - DNA, 1035 bp, Homo sapiens
acataacacaaaattaaccatttaaaacttttattgtggcacaatatacataacaaattttttttatattttataattagctttagcttgattgtggtgattttgtcacaatgtatatgtatatacaagttgtccaccttaagtatgaacagtttttatttgtcagttatacctttaaggaaactgtaaaaaagaaaatatgcacaactcatttagtaacctagaagtcaagtgtttaattttctgaaattttattatgcccagttacattactgatagatatagttaccaaaaaaatgtaccttacgtgtgcagttcagtggcattcagtacatgcacatggttgtgcatccatcatcatccatccacagaacatttttcatcttgtaaactgaaactctgtctctgaaaaacaatattctccatccccaagaccccagtccctggaagccacctttctattttctgtctctatgagattgacgaatgtaagtgtctcctatgagtggaatcatccggtatttgtccttttgtggctggcatattttatttagtatcatgtctttaaggttcattcatgttgtatatatcagaatttccttcctttatgaggctaaataatattccaattcatatttaaggctaaataataatgatatgtatatatcacattttgtggccaggtgcggtggctcacacctgtaatcccagcactttgggagtctgaggcgggcggatcacaaggtcaacagattgagaccatcctggccaacatggtgaaaccctgtcggtactaaaaatacaaaaattagctgggagtggtggcgtgcgcctgtaatcccaggaggcaggagaatcgcttgaacctgggaggcggaggttgcagtgagctgagatcacgccactgcactccagcctggtgacagagcgagactccatctcaaaaaaaaaaaaaaaaaaaaaaaaaaatttatatgtatatatatatatctcacattttgcttatctatttatctgttgatggacacttgggat

SEQ ID NO: 91618 - DNA, 1134 bp, Homo sapiens
tgtataatccatggtcttttgtgaccggctttcactcaacatcatgttttcatggcccatccatgtcacgcatggattcttgcttcattccttttatggctgaatattccattgtatggaggtaccacattttgttaattcttcagctaatggacattctgggttatccttactcccacttttcacatagcttccttctgctttttctttagttctgggcttaaattcattctggttctcaccactgaacttatatatgtacctgtttgcttacttctttactctggtcccctagtctggacggtacattttgtgagggcaggtacattttgttcaccgtacctagcatcctaccccacacagtgtccagagtgaggtagtgcccattattgaatgaatgactcaacatctcatatatttctcactttacctctccctaaggcaaagtgatcgtaaccccactctgtatctgggaagttctagctttctccctggtgttgaggagagcaaggcatcctaaagcatgaggatactttaaatagtggcaggttactagaaggatttctttggtgtaaaatactgtcccatcactcatctgctatgcaagactaccggctcatttgaaaagcccatttggctgccagtaacagacaccagaaataacagtggtgtaaactcagtggaaggcagtttctgtcctgagtaagacatccagagataggcagtccgtgcctggtgtggcagcttcacagtcatcaagaaaagcagagtgctttgatgcagggtccttctgctcaccatccctagcacagggcctttgtccttaaggtggcttcatggcccagtgtgactgctggagtcaagctagtgagtctggagtccaggtgggaatagggtgagggagaggcacaaaagcatagtccagctttgcgtttctgctgaggaattttcctcaaagtcccacagcttgtatttaccttgcattggccaggctggctgcaagggaggttgggaaatgtagtcttagctgagcatcctgagaaggaagagaagaatggctgctgggtgggcacttagcaactggagttgatacatttcctgcccacagtacccaggtccatcatagccagcttc

SEQ ID NO: 91619 - DNA, 1064 bp, Homo sapiens
gatgatgatgagatgatggtggtggcggtggtggaggtggtgatgatgataatgaggaggaggaggatggtggcagcttgcattcattagcccttactgcatgttggaggttaggtggcttagtaacagcctataagataataagcgtgagctgctgctgttgtgattattcattcaccagacatgtgaggggtcgccctgcacccagccctgagctggcacaggcctaggtgtagcaggactgtgttctgggagcagagttcatacagcgaaagcctgggccaggaatttcatgggccaagttgggagtttctttggtgtgtgttggagacccatggctcctggcctcctggtcccctttcttgttcattcctgagacttttcagcactggcctcaagagtgtaggctgcccttgacctctgtggccagaacgcatggatgctctgctcagcccatcagccaagccccaaattagacctgacagtgtgatttattctctgggatggagccgggagggcacagccccagtgggtgattcggagggaaggttgtcagcccgaattagcccagacctttcatgcagccttgctggttcagcttcctctggctaagagggttttccagggtgttgctggcttcagcactgcctccttccccgtccccagggacggacacttggctgtgatccctaaggagcgtgtgtcccgagggctgcccaggcaggccctgtctgaaggcagtggaggctttgggtcatttcatctgccccctcaggagcacagagtcgcagctccgtggagtgcttggcccattccccgcttctgttctttcactgagttccgtgctgggtggctggtggccgtttccctgctccacaccttccggtcggtgatcacagtgtctctgctttctagctgccttcattcattcacaggaatgcctctgatgggcgagtttctgctgcagtaacaaattaaccctgaaatcctagaggttggacacaacagatgtccatttcttacttgtgacatgggcaggtcaggtgggagggcttaaccttgta

SEQ ID NO: 91620 - DNA, 1070 bp, Homo sapiens
ggttggtttgggatttttgagttttgtttttttttttcatggattcagaaaatactagtggaagattcaccctgttgatggccctgttttggatgctggagatagaccagtgaatggtggcttgctggcatttgggtgttggattgctgctccccacccctcaccccgatgagtgcactgtgagtgcaggtgctgttgaaaggatgtatcgcgtgcttgccatgtgccccttagtatgggagtgccctatggggatcatcttgctggatctaccagcagtctcacgaggtggcacttaccccctctggtacatattagggccagaatttgatcctaggcaatctggctccaaagcataagcctaatttctgccttaagtcacccaggagtggagtgcaggcatttattaagtgccccggtgttcatggctctatccccaatctttagagatgacagtggttttaatggccatagatttgacctgcctgggttcaagtccctcttctgctttccctcactgggtgctcttcaacaggaacatgctgctctgagcctccctgttcccttctgtaaagtggggagaacagtagggccttcctcctcaggatgctgtgtgggctcagtggagccaggtttgaggccagtcctgagtgggggctgccattgctatgtgcagcttagggagcttgaccacagggcaggatgcccacttgggctcatggttctgtaaatgccagtttttgctctcattttattattattattatttttttttttgagaaagagtctcactctgttgcccaggctgtagtgcagtggcactacagtgatctcagcgcactgtaactgctgcctcacgggctcaagcggttctcctgcctcagcctcctgagtagttaggattacaggcgtgcatcaccacacccggctaatttttgtatttttagtagagacagagtttcaccatgttggtcaggctggtcttgaactcctgacctcaggtgatccgcctgccgtggcctcccaaagtgctgggattacggcctgctctcatttttgacaacagatgt

SEQ ID NO: 91621 - DNA, 1015 bp, Homo sapiens
ctgaaggctgggtccacctttaactttacggctgaaaatgctatctagcgacttggctggggccagacatctattaaggggcagagcccaggtgtgaggaggctctctagaatctttcttaacagtttcacaagggctaatccgcagttaaaccaagtggaccatttgcaaacacgggattaatcgcagtgatgctgggttgatggcatgccatgcactgtactaagtgtttcatatttgtagcttcatttttgccttcacatccactctctgaattgtgggtggcatcaaggtcctgttttctcagatgagagcgctgaggctcagaaaagttctgtggcttggcaggtggtacagtaaggtgggcttttgcctcttacagtgtctccactgggggtgtctgtgaccaggcatgaggtttgcgtgaccagcatcccacagattgcacaggaccctgcctggtcgccctgtctgcaggcctgctgggcatcagggcccctccttcccagacagctgagcctgaactcgcctgctcttccttcttagaacatgccaattacttcggcgtggatgagaagctggggccagtggctgtgagcattaagcgggagaagctggaagaccacaaggagcacggacctcagtaccagtacaggatcatcttccggacccgcgaggtaggtcccatcactctcgttcttattaaagaaatcatagccactcacatctcgagccaggttctgggggcaaacgcttccccagcttcatctcatggaatcctcccaacaaccccgggagagcaatcctgttagtctctccatctcacagaggaagaaactaagacgcagaatttaaatgacttctggccaggcatggtggctcacgcctgtaatcccagcactttgggaagcttggcgggtggctcacttgagatcaagagttcaagaccagcctgaccaacatggcgaaaccccatctctaccaaaaatacaaattagccaggtgtggtagcacg

SEQ ID NO: 91622 - DNA, 1235 bp, Homo sapiens
gggacagaaaagcaaagatcagggagtgttgtggtggggtggatctgaataacgtagtcagcaaaggcctccctgggagggtgaggtttatgcaagaccagaagaggtgacgaaggaagccatgtggggactcaggaagaatgttcctagcagagggaacagcggtgcagaggcttcgaggaagtgtttctggccatggtgaggcctttgtcctttatcctgaatgagagggaaccacaggaaggtttgtcacctgactcgggcattccttgggctgtgtgtgagcagggagtgggaatgggggtgggtggggggagctgtggcagtggtccaggcaggacccgtcaggccgacctgtgacaggttcctgtccccctctgttgccctttcccagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacaggtatgccccccacacccggcccccagcagcgtatggagagaggggcaggcagctggcccaagtgggtcccagtacagggcccccccacacctcacgttgtgcttcaggagaagagctcggcgtatactccccacaccatctcagagagtggtttttagccagaaaggggcatggctccccacttttgctaaggaaaccatcagggatttgtatttgcttgtaatcttttgtttcaagtgacagaaaacccatgtcaatgtggcttaagacaaaaagacagttgtgtatataggctctcaaaagtggcacctttaggcctggctggatctgccaccgccctcctgggggtcacctttccagcaggtctgaggtgaacatcctaccagctgcaaatcccccaaaatgagagcttttctttcccaagagttgcatcagaagccccagaattggggctcactggcccagttggagtcgtgtgcctgtcctagagccaaaatcaccagccaggcctgggcactgggcttcaaggaccaagaggcacgagtgatggcccagaggaaagtcggagggaagcagggcctacctgtggaggtaggccccactttggaggtagaattgaggaggtttttgttgttttgggtttttttttttttttttaagacagggtctcactctgtcaccca

SEQ ID NO: 91623 - DNA, 1018 bp, Homo sapiens
actacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtaagggagagagcccggcgatagggcggcgatttgtatggtttcggcctcaggaaccactgaaatacttccctagcccagtcagttaggctaagacacgcactggcccggagagaatcacagttgtcacttacaaactagacatcttgtgggttctgtagctaggttcttcctctggaaggtttgtgccagagatctgtggatcttcatgctattaccttggaaagacaagagatacttattaaccttggacactgatagaaagtataaatttaagcttaggttaaaaatgtaggccaggcgccatggctcatacctgtaatctatctcagcactttaggaggctgaggtggtggatcgcttgagcccaggaatttccagaccaacctgggtaaccatagtgagactctgcctacaaaaaaaaaaaaaagaaaagaaaattagggaagcatggtggtacatgcctgtggtcccagctacttgggaggctgaggtgggaggattgtttgagcccaagaggttgaggccacagtgagctgagatgacgccactgcacttcagcctgggcaacagtatgagaccctgtctcaaaaacaaacaaaaaaaaagaagtgtaagagtactttctaaaataattaaaatagaatgaaaaatgtccaaaccattaatggatagggcagaggtgagaggaggaaaaaatacaagaaagcacaaaggaacataaaattacatggcaggaatgagttccatgttagtaatcacagtaaatgtgaatggtttaactt

SEQ ID NO: 91624 - DNA, 1095 bp, Homo sapiens
tcctgacctcaagtgatccacccgcttcggcttcccaaagtgctgagattacaggtgtgagccaccacacagggctagtatgtttaactttataagaaggtgccaaactgtttcccaaaatgacaaagcatcttatactctgtctatcaacatgtgagagttctagttgctgcatgccctcaccagcctctgtgtttcattcattccggtgggcaggtggtgctaccacattatggttttattttatttattattttttaaaaacattttttacagagacaacgtcttgccatgttgcccaggctggtctcaaactcctgggctcaggtgatcctcctacctcagcctcccaaagtgctgggattacaggcgcgagccaccgcacccggctggctttgtaatttgaattctttatgtctgtaatttgcatttttctgaagactgctaagatttgagcatcttctcaatgtgtcttccccattattaatcatgttgtgaactactcagatgaatattttaaacataattccatagaacaaacttgtagcccctttgaagtctgagaaccagcagatgaatgggcgagatggattcagaaggaagcaaacaaatgagcaatgttagaaagcagtgacgtcagagtgggaggggtggagatgtcctcttagggagtgtctgagaatttccaggcagctgggagagctgaccccatcagcacaccagctcccccagatgctgtggggtacggaagaggctgcatgccccaagattcgtggcctggagaattcctcaatatctcagcccatggttctcttaaaccagagacagtgtcacgcctataatcccagcattttgggaggccgaggcaggccgatctcctgagatcaggagttcgagaccagcctggccaacttggcgaaaccccttctctactaaaaatacaaaaattaaccaggcgtgatggtgcatgcctataatcccagctactcaggaggctgaggcaggagaatcgcttgaacacgggaggcagaagttgcagtaagctgagatcgcgccgttccactccagcctgggtaacgagagagaaactctgtc

SEQ ID NO: 91625 - DNA, 1014 bp, Homo sapiens
ctcacctctgccctcgttcccatccactctcccctccttgctctgttccagccacactggcctcttgctgttcctcacactctccacgtccaggcacaccccagggcctttgcactggctctcactgctgcctccagtgagctccctccagatcttcttgggtgcagctcatgaggactcgctctaatgccaccccctcaaacaggtcctcctggccttcagtagcccaggctgtcattctgtgtcactgtactctgttccacatcccgtgtcccccatgggaaacaggtgccaccgtcttagtcacaaggcacttgtaacgtgcctggcacacagggcatgctccatcctgaacataagacgtgtggatcttgtttgattctcacgtgaccccaataagtagatactataaggcccccacttttcagtgtggcccaagttgggccctgctgaaccctgttaccctcctcaacaatcacccgtacacactgcttcctctgcctggaacccaccccccaacccgcacccccactctaggcccactcctgcccacccatgttaatttgctggggcagccgcaacaaactaccacacactgagtggcttaaactgcagaaatgtatcatctcacagttgcggaggccagaagtccaagttccaggcgtcaacagggtggttccctccaagggcggtgagggagaacctgttcctggcctccctcttagcagccggtgggtgtcagcacgtagattcatcacccccgtctctacctcctcttcgcatgatgttctccctgcatctgtgcccacatttcctctttctgcaaggacgccaatctaacgggattaggggtctaccctaatgacctcattttcacttgattgcctctgtaaagactctgtctccaaatgaggtcacatttggagatgctggggcttaggacttcaatgtagctttttgtggggccccagttcaacccataacaccactccttgggtatcaacacagacacgc

SEQ ID NO: 91626 - DNA, 1058 bp, Homo sapiens
gattgcctctgcacgccatgtggatctgccatgcgtctctggagggtgtgattctgggtggtgggcctggccctttcctggctgggggctgctgtctgctccacagacaggaccctgggagtgtccgtgcacatgtggcactgtggactcatgtgagcctttctgaaggacgcgtttccagaagtaggactgctagtgcagagagcaagcacattttattcatgcttccaggaggtcttggcacgcccctctcgaggggagcctgtgggcagtgcactggctggggggcgtgctgaaggccaggcctgcttcctcactgccgggagatgggcaccatgagccctgcactgagtcacactcccctgtgcagggcattctgggaaatattgaaatcaaaaggggtgggggagtccccttttgatttgtgtctgtctctctgtctctctatttctctcttttgaatctaaagcttttaatttgcccaaagaatacacatccctgataactgacagacccagcattaccctagacctggaattccaatttggggaggaatatgacctgaccaggaaaaaacctggccttgctctcgcccttcctttgttaaaatcccaaggctggcagctgagaaacagaaaaaggaaatccagtctttaaaaccctcgggaacccaagacatcttatttcttccccaggttcaaagcctctttttctttcttgcattacagaatgaagaagtccaggcaaaagcttttattaagctagtttttattatttttattgttataaccatgattatggttaagtaaattcagacacttcagaagaatatcagttgaaaagtaaaagtcccatttttccacctcctaataagattcctacctcccagaggttatcatggttcataatttcttccagaaattgttatctgcagacagaagcatatttttaaatccaatgtggctgttccccacaccatacgtgtttcctgccatctctgatatacacgtgacagtcaagcttggcagtggcgtgggtaggcactgcagcctggcggc

SEQ ID NO: 91627 - DNA, 1043 bp, Homo sapiens
tcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatgtgagcctgggccccctgggactggcgcggtagttaccccaaggttgggaggtggggatgcccgagcaggggctcacctggaggtcaaaggctagaggtcatcagtgtcggggccatctcagggaggaatggggttcacaggaacttcggggggcctgatggtggggcactgggtgtcacccaaggagcaagggatcattggccaagcatcagagggtcacctaggagtcagaagcacccaaggattggagtcacctgagaccagagaagaagtccaccctcagggtacaggcctagggaatggggctgcccagctgttgccctagcaccccccaaccctcccacccattccagctctaagcggtttgcttcctgagcattttatttgctttcctgactgctcccatgtttgccacacttgggggtggtgcatggtatgacttgttcactgcttaatcacccagaaaatatttactgagcactccccgtaaacaggtactgcgcacaccacccgcatcaaaagccacgagccagctggagttggccgtgccccagatgcaccctgtaaccccccttacccacctcctaacccccccacaactgaaagacagtacgtaagtttgcaccatgctcactgggtggcgaaacctggcctggaggggcgtgaggctgtttagggtccatagtccccctacttagtgctagcaatgaggagcttggggcagagcgctggcgtgccactgcgcgtggggtgcccctgacctttttgagtttgttacataatacacagcatctgcacacttactctctcaaatccaagcacatctcaaattcagaggcatgttctaccccaagggtctcagctgaggggc

SEQ ID NO: 91628 - DNA, 1050 bp, Homo sapiens
accctgtctcaaaaaaaaaagaaaaaagacagcatggctgggcctcttccttcccgcatctgtctcagacgatctgtctggatgtcccctgcgggtgtccctgtgtctcctctgcgagtgtctggatctgtccatatttgtctgggtatgtttgagagtcgctgtgtcttccctgagtaggtctgggtgtgcctgatggcctaactgtgtctttttctgaggctttctggtgtatccaaagttctgaccgtgtctcctgctgtgcatcccagggcatctgagggcgtgactgggtctccccagagtctgggcctccctcctagggcatgtggttaaatccttgcctctgcagcctcttccctcctgcaaagagcatggtccccccacctgcatagtttgaggagtcctccggggtcaacttccccatctgacccccccatggccctgtccccagactgtgaagcacccctgaagaaggagggtggcctcccggaagggccggtcctcgaggctctactgtgtgcagagacgggggagaagaagattgagctgaaggaggaggagaccattatggactgtcaggtgggcccacctctgggggacccccgctgcatggcttcgtctcacccctgcctgccaccagcccgggccctcacgttcctgctctgaaacccccccggtttcttctggctgttgggcatcccagtcaccatcctcccagacttcatctctatttggaagaactcctgacttatactctcacccccaatctccacctttgcccagagcccctcaaaagcaggtcagtggcccccactttcttgacccgtctcctttctctattgcccagaaacagcagttgctggagtttccgcatgacctcgaggtggaagacttggaggatgacattcccaggaggaagaacagggccaaaggaaaggtatcaccccaagcttctcctcttccccgctcccctcaatgacaggtctcattcatggagcaggtgcagtggtccgcccctgccacagtctgacctcagtctgacctcat

SEQ ID NO: 91629 - DNA, 1217 bp, Homo sapiens
cagtccgggacagcactgccaagacgggacatctgggtgttgggggggaggggtgacagatgggctgagagagccccggggccctgtaccagcccgatgcctgggcccatgggccccgggagcctcggggctggcacgggtctctcgccttggctctagttcccacagaggaaaacaggcctagtggagtcctggaatgtcagattctgggattcgggagaggagctggcttctgccctttcaaggaaaagtcttagcactaggtgcaggggaggagaggctggcagccagcagccagctggggcggccccttcccccaggggacaggaagggaggggacaggaagggaggggacggcttgggccagcccccagagggccaaaatgcagcctggtgagaccgaagggaggaccaccgaggcccctcaaggtgggtgggtgggatgagtcatggctcaactcagctgctaagagcggggcgctgagtgtggcctctacaggcagtggcccaagcgcaggctggctcagtacccctgctgggaataggacccagctgtccccagctgtcgagggagcaagagagccttggggttatgaatcctttcctccccaacccaaagtccggctgtcggcttcaggcctggggcttcagggctggatggtcctggttcatgtgtggtgaaggggcttcagcaaggacacaggtgtgtgagtctctgccagggccacagcctgatgccaagggcctggggctggccgaggatgcagagggacctggcatcgtgcagtggcttcgtatagtggactgtggtcctgcaggtgtgaggtgtgtggctctggcttgggtgtgtgacacatcagcatgtgtccacagtcagctgtggggcccaccacctgagaatggcctcatagatgccacctgccactagcaaccagattggttcacctgtatgggcccaggtgtgagtctgagaacagagggactgcatgtcaccatgggagaagggccatgccttccaccattgtcgcaccatgaagaggaggactcgtgggtcctgtgtacactgtagcatacagaagtcacagaaggccaggcgcagtggctcacgcctgtaatcctgacattttgggaggccgacaagagagaattgcttgagcctaggagttcaagatcagcctgagcaacatagcgaggccccatctctttttcttttttct

SEQ ID NO: 91630 - DNA, 1044 bp, Homo sapiens
agtagaggatagccaacaaggtaatcaacataaatgcattattattgaaaacacttttagattatttctttttttttttttttttgagatggaagttttgctcttgttgcccaggctggagtgcaatggagtgatcttggctcactgcagccttgacctcctgggctcaagggatcctcccacctcagcctcccaagtagctgggactacagatgtgagccaccacatccagctaatttttaaattttttgtggagacaggggacttgctatgttgcccaggctggtctcaaactcctggcttcaagggatcctcctgtctcatccttccaaaagtgttgtattacaggcgtgaaccaccacacctggcctgaaaacactttgacagtgctatacagaaaaggaatcaggggctgggatggaaaataacaagagatcttttgaatggggtggcggaggaagggctttgtgaggggtggctttgataatgaactctgaaggatgataaaggccaagggacaaacattccaagaatcaggaatggcacatgcggaggccttcaggcaggaaagagaatagtgtgttcaggagccagggccactcccactcttcagcctccctcctagcataataatacatgaaaagccgtaactgagttatcaaaatggtatttaccttaaacaatggaagtctaaccttgcaatgagatcatgggactcaaggtggaatctgaatgtgaggccaaaggtctcccccagcacttgaatctcccactgccactcaggcctactaaacctaggcttgagcatgaaaacagagaagtatgtgctgagccgtcaaggcttggaagaaggtataggcctcttctttctttattttattttattttgagacagagtttcacctgttgcccaggctggagtgcaatgctgtgatctcagctcactgcaacctccacctcctggattcaagcaattctcctgcctcagcctcctgagtagctgggattacaggcaccacccgccaccacgcccagctaattttt

SEQ ID NO: 91631 - DNA, 1072 bp, Homo sapiens
ggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacggtgagggccgggcgggtaggctggaggcggggcgcagggggcagaggctcgggggtcaacgggggtctgagcagggagaactggcgggggaggaaactgggggctacttgatggcgttcagcgggtgtggtggaaccagccctggaggattgagccttgaaatgaggtttgggagccttcgacagcgaagacgggcggaggagcgagggttaggagagtttccttcgggtggaggaagagtcaaggggtattgaccaagaaggcgtggcactgccccttcctgtggcaagaacggggtgaggag

SEQ ID NO: 91632 - DNA, 2753 bp, Homo sapiens
ttggacaagagcctcccctgaagtttttgtagttgagttgcagtaaagtaggtgcccgagaaggagggagcaagaaaggaaacaagctttggggaagaggaagctctgctaaggctcgagagagtattggcgttgagcagctggtgttggggtctttggattggcccttagaagtcggtggtgaataaggtgatttaaacttctacactcttaaggaagtgtggtctgaaaggtctctttgaacaagtgttgttataaccttaactgcttcagacaagcaccagcgtgttttgaaaagagctctcttgaaagcaagaattcattgattcagcaaaacttactgaggccctgctacgtgtcaggcactggcgctggttataacagttaactcagactagctgggttcctgcattcacagagctaatattccagtgggagaggcagagctagtgaaggtttaaaaagcacttgccatgagattaagttactgagaattaaatgaaccaggtgaagtacaccaacagggtgacgtaagatgttgggggcggctttagctcaggtggtcgggggacgtctccgtgaggagggtgacatctgagctctaacatgaagaatgaggcagtagccacacggagacctgggggaccagtgtccagttgcaggcaatagagtacaaaggccttgaagctggaacaagcttggttgggttcagggaaaagacagagccagcctggctggagcaggcgtgaaggaggggaggactggaggaggatgggaggtgggagaggttggctgcagccagatggcctagggctttatagacaggtgctggtgcttgaacccgggaggcggatgttgcagtgagccaagatcgcgccactgcattccagcttgggcaacaagagtgaaactcccatctcaaaaaaaaaaaaagaaggccgggtgatgtggctcatgcctgtaatcctagaactttgggaggccaaggcgggcagatcactggaggccaggagttcaacaccaccctaggcaacatgatgaaaccccgtctctaccaaaaatacaaaaattagctgggcatggtggtgcacacctgtagtcccggctactcgggaggctgaggcaggagaatcgcttgaagcccagaggcggaggctgtagtgagctgagatcaagccactgcacagcagcctgggcgacacagcaagactcagtctcaaaaaaaaaaaaaagagcaggctaggtgtgtaccaagtcatcacctgtggtaacttctggggactggttaatttctctgtgccctaggcaggagaaaaaagtgaattggtggggagaggctcagctgtaggtgactgggagtcaggaatgcagacgttgatcattcttgcaattcgaaccagaatttggcagctctgctggactttttcagtttaagtaattacgttaggatgtacctcccagttacctggcctcttgctacctctggtgcttactctgagctgggacatggcctcttgctacctctggtgcttactctgagctgggatgtgccatttaacctttgaaacagccgggtgcggtggtgaagttacttgccttgcccgaggtcactcggtagtagtaattgacaaagccaggtctcactgcagaggccttctctgttcagagtggcctacctgactgctgctgccgactggacctactgacctttcagaagtactagtgtctgactgggtgaactcatgccctcactcatcgtaagttctgtttgtttgaaagcttgaacagcttaatcggaggcagaaggcagttttgacttttttttcctcgctccttcctgattgcttctgttttctccggaagcgagtcatccactgggagtgtggtgttgctgaagctccatgcagtggctcaggtgctgctggatgagtgtggtggtgagggaggagtgaacagagaatgtgtgagggagggaggatgggggttggtcaaggaatttattctgtatgaaaacatgagggggcggagggccgaggtagatggtagggccagcagattgttggagttgaggttctgaagggaatgaaccagacagataggatgcagtgggtagtgagtgagatgcatgagagggaggttctgaagaggtggcagttactgagacaggtctaggtgtgaccctgagaggaagcgggggggcgagggtgggaggagatcaggtggaggtcttgggacctagaggtcagaggaccatctacctggatatagaaatctccaagaatgatcataagagcagcgggagaggtggcaggcccggagctaaagttgggaaggaagaagtagttgtctgggttggcagataacgtgccaggcggggtagtgaatgatttactctaataatggaagtctcccagctggggattttggggagggtggagggagaacagtccagaagcagctcccaggagcaaggagacctccccacttggaagggccccaggaggtgtgccctcaggggagattccaattaggtaagagggtggcaacaatgttcagaggagattgaggacatggaagatttgctcaagaccagtcctgagtaccagagggcccaggagttgggggaggggagatggggacaaagcaggccccaccgtgtgagagtgagggttaactcaggggtcggggcttcttgtgagaagcatcatgtggtctatgattgatgtgttggtgacgctctgagtagtgagggc

SEQ ID NO: 91633 - DNA, 1081 bp, Homo sapiens
tgcagtggcgcgttctcggctcactgcaagctccgcctcctgggttcacaccattctcctgcctcagcctcccgagtactgggactacaggcacctgccgccacgcccggctaattttttgtatttttagtagagacggggtttcaccgtgttagccaggatggtcttgatctcctgaccttgtgatctgcccgcctcggcctcccaaagtgctgggattacaggcgtgagccaccgcgcccggcctgagatgggatttcaacatgtgggccaggctggtctcgaactcccgacctcaggtgatctgcccacctcagcctctcaaagtgctgggattacaggctcgagccacgtggcccagccctctcctgcacttccaagggattttcgaaatgcatggacctctcaggttaattatagtgtctgtagaaccttaactgctgtaagctttccagcagactccacagacgtgttattagttgccaccctttctttactttcctcctcacccccatggatagtcgtgaccctggtggtcagagataagatgacagaagagctaaagtaaagctggtgttggcgatcagctgggaattctctaaaacagcttctcacattattcttatcctccatagaaggagtgcttgtcctacttgcaggcaaggcagtttggttccagggtagttcgaaatcttattcactgatatagtcagcaaatgtttattgagcacccaccaattgccaggcactgactcactcaaattagagcactgaacaaaatagaccccctcccccatccgtggcagacgtgtcataatgagaggaagacagtacaataaatgaacagatgaatgtatgtctggtgatgagtgtcagggttggtgtgcttagcactgaaaatgggggcttctgaggttcaaatggttgcagttcctaaagaaggttgagggccttgccttcaggtcaccgcgggagactggcccctttccactggaaacattgctttgcccagtcagtatttgagagctcagcctgcaatggagaaatcacacttctcctctttcaccctgctccccaccct

SEQ ID NO: 91634 - DNA, 1058 bp, Homo sapiens
agactgtagattgttgtcttagtcaccggctgattgtcttggttaaagctctagtgacttcagaaccagagaaacttgttttccaacacattcaaagaccagtttgctttgcaattttgcaatagctgacattcagaatgcctgcgaggattttgtaagtgaggttcatatttcggataatgtgtgacttttgccatttctgatgcttttccaaaagaaagttactcttccctaaaggcaggaattctacttttgcttagatattctgaagcttatgagttcatccaaatttggttcctttcagcattttcctgttggtccgtctccgttttgaaaacatacagaatgtacttaattttgccctaccatttgtgagcatacaaaatagcacttgagtcatatttttcatgattgcttcccaatactattctaagaccaacatagcattttgtcatttcataataatagaattcctcattaaggaataactttctaaaaatgtgtccagcccatttcccccccagccctggccgtttcctttggtatgttggtgtccgtgaccctgtcattgagtgtgactgaaaacagaggcctggcagagggcctggcctttgtgagccctcagattgtgataaagaccctgaggaatgttttggcttttaggcaacctcagttctgttttcctgctgcctgttgatgcagtggctttttcttcccatcagtctgaagggtcgtgttagtgcctgggctctcatcagaccacagggaactcatcctggcactgctggctgcctcactttaaccacctcaagtctcagcattctcgtttgtaaagcggagatattattacgtgattcacagttttattgtgaccattagaggtagggcacatgatatgccaggcatcatgcttggcgaaggcaataagtaatgcagccaggtgctgtggctcatgcctatgatcccagcactttcagaggcggaggcagcaggatcacttgagaccagcctgggcaacatggtgagaaccccatctttacaaaaaattaaagttagcc

SEQ ID NO: 91635 - DNA, 1055 bp, Homo sapiens
atcttggctcactgcaagctccgcctcccgggttcacgccattctcctgcttcagcctcctgagtagctgggactacgggcacccaccatcacgcccaactaattttttgtgtttttagtagagacatggtttcaccttgttagccaggatggtctcgatctcctgatcttgtgatctgcctgcctcagcctcccaaagtgctgggattacaggcatgagccactgcgcccagcccctgctttttttttagacagggtctcactgcagcctccacctcctgggctcaagcagaacctcccacctcagcctcctgagtagttgggactacaggcacatgccaccacaccttgctcattttgaaattttttatagaggcgggggtctccctatgttacccaggctggtcttggactcttggcctcaagtgatcctcccacctgggccttccaaagggctgagattacaggcgtgagccactgtgcccagccagattttgctctttagagacaatttattaactggaatgtggatactttcctctctttattagttcttgacagtggaatctgggtgacgttttaaaaagcagaagaaacaggcaccgtgtgaatgtcctggtggccgtacagtggtttcacagcagaccctcactcctcctcttcccagaaagggagcaaaacaacagggcagagctggggccagcgtgacccagcttcctttctcccactttactaagtgcaagtttcagagcagaccaaagaggaagtagccttgccttcttgagcagaggctttttgatccactccgacagggctgcccctcttgttccctgggtatttgggttattttattttattttgagacagagtcttgctctgtcgcccaagttggagtgcagtagagcaatctcggttcactgcaacctcagcctcctgagtagctgggattccaggtgtccaccactacgcctggctaatttttgtatttttagtagagatggggtttcgctatgttggccaagctggtcttgaacttctggcctcaggtgatctgc

SEQ ID NO: 91636 - DNA, 1924 bp, Homo sapiens
atgggttttcgcagtgtcggccaggatggtctcgatccctgacctcgcgatctgcccaccctggcctcccaaagtgctgggattacaggcgtaagccaccgcacccggccctaacttttgtatttttaataggttttgccatgttggccaggctggtctcaaactcctgacctcaggtgatccacctgccttggcctcccaaagtactggaattacagccatgagccaccacacccggccaagtcactgtctttttaaggtcactttgcacatctctgctctgattccctgcaagttaatcttaagtttcctcttcgggaggcaatcttggttccttatttccaagttgtggtctggcatgcacattgaaggtcccatgtaaaggagaagtggatgctgtggtgagaggcgcacagggccagctcattctttgtccctggcagtctctcgaaagctctttcactgtgctgtttctttgtccccttgcagagaatgccacgggtgacctggccaccagcaggaatgcagcggattcctctgtcccaagtggtaggttcttaaagagacccgcgatggagtgaggccaccggatgggtcattgtgaaaggacacttgtcatttgggaactgtcacaggcttccctctcatggttctgtttactcaaaattggcaaaccgggggctctgcctgggctgccggcttctggctccagcatccttatgggggagtttatactgtccagctgacacaggggccggggatcctgcagcacttcctggctggcccccatctcctcctggaggatgggatggaggtggctgctgcccatgaggctcaggcccctccttgctgtgcgggcctccagctgctctgctgaccccactccccacccaccctcctgtctgcctgttctgtctcctctgcttcctttgctccctgttgccatcgctgtcccctgccccgtgggcatcctctgtcctctgccacccccgcctccccgccactgcagcttgtgatctcaagatgtgtgttagcttgctttgtagtgctggcggctgctgccccattcctcctttatggtttaaggactctgcatcgggcgcctggggtgagtggtcccgatgcactaccaggtagcaaatgcaccctcggggcagacctcaggccatggactctgggaggctgctgtggagggggtactgcaccgcacccctgctggaggatgggactcccccggcagctgctacccaccgagtgcactgtagctcagcagctgttgggccggctggcttgcagagtgctggggcgttagggtggtcactttccagctttgctaggcctggagtcctgtgcctgtcctggctttgctctgcctggctccctgtttatcctctgctagcccccccacacaccagctctggtttccatcttgttggagaggaacatgtccccctcactgtattagaaagtgtgaacaagaccgtgttccctataatattaggagctgtggcaggcttggtttctataggaaccctgaggtggcggcagggccaccacatccagcactctcagtgtgtgcgtagagcccattagggctggggtgacgtggcagagccggccatggaaggggctacacaccccttcttaaaggcgtgtccacactcctcagtgggcccttccagacccagacccagctaggcctgtgtcctgtgtccggcccagcctccctaacacagatgtttgtgtttcagctcccagaaggcaggattctgaagaccactccagcgatatgttcaactatgaaggtaaaactccaaagaggccaggtgcggtggctcacacctgtaatcccagcgctttgggaggctgaggtgggcggatcacgaggtcaggatatcaagaccatcctaacatggtgaaaccc

SEQ ID NO: 91637 - DNA, 1043 bp, Homo sapiens
gtgacaggccccacgtggatgccgccagcagtgggaaggaggctgcgcctgtggagatgtgcgttagaggcgtagcctggcacgtggctctgcaatttacattgtccctgaacctctcgccagcggcttggctgtgggcaagtgactgttgccccgcctcagagttcccatgtataaaatgaagggtcccagataggtctcatagagactcagccactgcatgtaaaaggcctagaacagggcttggcagagagcagccttcaaagctccgaagccgtcacctggacccaaggagcagcgcgtcagagccgctgcactggtcttgggtgtaatttacaggcttctttaccagagagatgtttctccgtctgctggagccgcaagcctcctcaggcactttctggcttgcttcccctccttgcgggccctactaatttgtattccctgggctgtcttactcctagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgtaagtctgcagcccctcagcccaggaagccctgcccttgaggaccccggtccatctccccatccctaaaatatgaaggccttggaaatgctgttcttgggcccaccagggcagcaaggcctctaagccccagaaaagctggaagaaagcccctcagaaagagctccccatggaggccctggctgaggggatcccctgcggcagctctgtggaatgggggctgtgagctgacctcaggctgtgtgttctcttccaggccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagt

SEQ ID NO: 91638 - DNA, 1286 bp, Homo sapiens
ttcatcccgcagtagctctcagccctcccagcccctgcagggccacgtctttctctattgccggtcagcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactgagtgcccgtgaactttcgccaaaccacacttagcctcaccac

SEQ ID NO: 91639 - DNA, 1029 bp, Homo sapiens
gggtggatggatggatgggtggatggatgaatggatggacagatgaatgcatcagtggatggatagttggctagatgggtgggtggatggatggctggatggatggatggatgaatggatggatggatggatggttagatggatagatggatggatgggtgggtgagtgggagggtgggtagatggataggtggatggatgggtgggtagatgaatggatgcatagatgaatgtatcagtggatggatagttggctagatgggtgggttggtggatgaatggcagagcttgcacctgccagtccatctgacatcaaagccagtgtctctaatggtgacaccaccctcctctgcagcaggaggcagagctgtgggatgaatgaggttcgccaggtctcccttacctatcctgggtccccagctccttctcactctcttcccttgcagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacgtgagtgggcggggctggtgggagtggggggatgcacggggccacagggcttcagacttgagctctgcctccccagatcgaccgcttcatccccatcaccaagctcaagtattactttgctgtggacaccatgtatgtgggcagaaagctgggcctgctgttcttcccctacctacaccaggtcagcacccccaggggaatgtgggtctgcagtgggcctgtggggggctcaggggtgggggcaggtgcatggtggagccgggagattcgcctcgagggaggagggcctgtagcagggtgggaggggcctggctctgagggtcctgcccgtctccccatccccg

SEQ ID NO: 91640 - DNA, 1342 bp, Homo sapiens
cgggccctctacaaggtgctggtcacaggtgagctgggtggctagggcagggctttgaggaggacctagccctgtccctgggggagttaaaggctcacagtcccactctgggacttccaaaagggatccaaccccaccctgcagggtccagtagaactgcggccccgcctggaaaatctgagccccaggatgaccaacgccccttctccgcctttacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgctagacagtgctggagacatagttgggggtggagaactgcccttatggagcttgcagtccagtgaggtggacagacctgtccccagacagtgatggcccaaaatggtcaggactttaatggaggaggtgaggtgttgaaagcacaggcagagtggtcagggctgaagtcggagaagcatagggactaggcccaatccagcctggaaagtcagggaggacttcctagaggaagggacatcgaactaagacctgaactatgagaaataggcaggaagaagttgtacctgactcatttttctcaggtgtctccagggagcaggacccatggagggacccctggtgtaggcctgggcgatagactcttcctcag

SEQ ID NO: 91641 - DNA, 1087 bp, Homo sapiens
caagaaggtgccggctaagaagctggtgccggcgtggaaggagaaggtgtggggcgaggaaacaacgaagggcgaggaaagatcccgaggcgaagagacagttttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagtgcgagggtggggcaagaggttggggcacagccgggtggaagtacacgggtgcgatcgcaggcagaagcagtacgggggaacttaagagggggactgtcaaagcgagaaatagaaaccaagaccaggtgaagagcaagagtggaatacagggagggggcggaataaggagcaaggtgaggataaagttaaaggaagagacgtggaggcggcggggcggaacgaggcggaggagcaggggtgtggccagaaacattagtagggctggggcccggagcaatagcagaggtgcgatacccacgagggtcgggggcagggccaggagcaagagcaggggcgggaccaggagcaagtgcagaggcggagccaggaacaagagcagaggcggggctaaaagtccgtgcgggggcagggccaggagcaagagcaggggcgggaccaagagcaagtgcaggggcggggccaggagcaagagccggggcgtggccaggagcaagtgctgtgagaggcgcagaagcgaggtggaatcttaaaagtgggctccagagagctgtccggcgcgtgggtgttgactcctgcgttctccaggttctagccacgttatgtgcggcccagccatgttccctgccggtcctccgtggcccagagtccgagtcgtg

SEQ ID NO: 91642 - DNA, 1034 bp, Homo sapiens
ttccaaggagagaattgcatggatactaagggaagagcagttcatcaggagaaacagcatttcatcaggagaaacagaggccctgaggtgggcatgttcctgggaggtctgagaagcagagaagaggccttgtggctgggagagagggaccgagggggagaatggtaaggaatgaggtcaaggaagtgagaaggacaaatcgcgtggggccttgtgggtccaggtcaggccttggacctaaatgagatggagtctcaggagagtggggagagtgttggcgtccctcctgtccctccttggcagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggtgaacggtgtggggcagatggtgggcggggcgtcttggagggagctgggcctcagcccctgaaataaggtaggggcctggggctctagaagtccccaaagacatatctgtccccatgagaggcagatagcatgaagaaaaaacacaagattctacagccagagggcctaggttcaaaccctggttctgccacctcctggctgcctgaccctggacctggcagttcaacgacccggtcttcagattcccatttgtaacatgggagtaatatttatatttacttcataggattgttgtgaggatgatataagttaatagtttctggccgggtgcagaggctcatgcctataatcccagcactttgggaggctgaggtaggagaatcgcttgagagcaggagtttgagaccagcctggacaacatagtgagaccccatctctaccaaaaatacaaaacttagccaggggtggtggcatgagtctgtagtctcagctgctcagaaggctgaagcaggaggattgcttgagcctgggactttgaggctgcagtgagctatgatcacaccactgcacttc

SEQ ID NO: 91643 - DNA, 1029 bp, Homo sapiens
gacccacagtctcatgactgtgaccaaagacagacatgctctgataggccaggtgtgagtgacgaaaggccagagaatgagatcccaaggacggaggggctggtgggcataaggagggcaatcggagttggcttgatgggctgccagacaggagggagagggcctgaacatgaacccgaccttgctctgcagatggccaggtgtcctttgagatgctgcccaggcagtggtctgtgtgcgagcagataggaggtactcattaccccgatgggtctgcggtgggaggctgggggaactgaggatgcagaagagcaggggagggtggcaggggtcatgggaaagaatgggcagtgtcttagggaggggtgagttatggggaggggtacagctggcacaggaccaaggctattgagccctggggcggctctggactgcccctttccctctcagttaccacctgctccataatttggtctgaatacatcgcgggtgagtatactctactgctgctggtggagagtggatatggtaatgcaagtaaacgtttccaggtggtcagctacaacacaggtaatgagggtgatgcaaggggctgggcacaaaggggcaggatcccagactgtggactgcatgcccatcctgagggatctgtgcccagcagacagagggagggcaacattacctgtgtcactcctggttgaggagtagcagtggagaacaggatataggcttggtgatctgaaagggccctgtggctcacaataaagagattttattttacctgcagtgagaatagggcccctatgtagatttgtgcaggctgtgcagtgcacaaaacccccaaccgaggggtcagaggagacaggtcctgtgccttaacaggactgtttcctctcaggcagtgcctttttataattcacatgaagaaattctaaagggctaggcaaggggctcacacctgtaatcccagcactttgggaggccaaggccagaggatcccttgaggccaggagttcaagaccagcctgg

SEQ ID NO: 91644 - DNA, 1075 bp, Homo sapiens
gtgcagtcttggcctctacctccctggttcaagcgattctccagcctctgcctcccgagtagctgggattacaggcatgcaccaccacacacccagctaattttttgtatttttagtagagacagggttttactgtgctggccaggctagtctcgaactcctggactcaagtgatcagcccgcctcggcctcccgaagttctgggattacaggcatgagccactgcaccaggccgtgttaatgatattaatgaccatattgcccttgggggtgagggagagccaggcagctggtggtggtgtttgtgggagggggactgtccttcctgccccttacccctccaggggcctgaggagaccctggccacccctgtgagccttttttcctcccaccgagggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacagtgtgtgtccagtcccttcccctgcacagttcactgccctcttgcccccactactttgtgctctccctccccattcctctccccgcagactacccaccctttttcctgcggcatctcactttcccccgtctcggtcctcagcttctcgggccaagctaatttcttcttctggtctcaatcccctccaaccccatagttttctaccccttcttcttgattcaagatttggtgacaggagactccggcagtttccagggcaggtaaaggcgtggccagcttgcagctagggcaggtggagggagtggaaggagatgggtgcaggactcgagacccggaggccagtctgtgtgcacttctgtccctggtagctatgttctgctggtggtgggtggcgggcccacactggacagcctcaaggactacagtgaggacgaaatctaccgcttcaacagccccctggacaagtaatccccgtggggtcccacgtgtaatccaccttgcttcccctggaggcctttccca

SEQ ID NO: 91645 - DNA, 1075 bp, Homo sapiens
acgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaaggtaaagtcggcaggcccaggaaaccgagtgttgcgggcgtgggaggcgctacgaggtgtctggacccaaccaagtcccgggccgcggaagccacctcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaagtgagagatgactggaatggacccacgcgggggtggtgggggaatgattggaagacttatggcagaactgagtgaggggttagatttttggtgcgtggaggcttaactggtcggagtggcaggattgggattcgggcttttcctgatggtggat

SEQ ID NO: 91646 - DNA, 1610 bp, Homo sapiens
aggtgaagttacttgtcaagggtcgttgggcagagtacgattggtgagaaaagagagcataggacacgtgggcaagtgctggccccatagggtggggatggagcctttgtgatcactctactcgtctctaatccctcctttcctgcagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatgacatgtgaaatggaacccatctgtaggctgccagtttgggctctttgtggaacaaaaggtgtgggccctggtgtgggcttgtgggtcccaccctccctgagccagcatgtgattgaggacctccccgcacaccccccagcctaggtttcctgccttgaaattcttgggaaggtgttcaaggcgcagggtccaaatctggctgaatcccttgtgggatgtggaaatttcacaagtcttccagagttagttttcccaactgtgaaatgggaatgatcactcctttgcaaagtggtttgtgctgagcctgtgagcttggtaccaggttagctcagaattggggcttatggattaaggggaatcagatcccccccgccctggacccatcagtctgggtgctgggtgaatggaacctcagttactgctgctctggtccagcttcacgattgtttccaagatgtgctttaatggcgatcctgccctgctgcaccctacccactgccttggcgagtgattgacaggctgctggcatctggattggttattttattggcatggaggggaaggtggagggtgttgagccgactacactcagttggaatgggtggcctgcaagtcgtagtgctccagcttggccaccagagagccggacagcttgatggtggcaacccagggtggctcgcccaggtggttggtggatgtgctcagcctagtgggggagggtagagtcagcaaagcccagcaatgggaccaggcctctagcccttctagggcctccctgtccccatatgaatagggaagcttctgaaggctatattggaatatcccaaaggcagtttagggcagggctgtggccacttaataggaaagggagctgagggctggcgagtgtcc

SEQ ID NO: 91647 - DNA, 1099 bp, Homo sapiens
ctaagactgggatggattctgatctgtttgtcccttcgttccgcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgaggacggcctggtgggtcccctagccggcccgaggacccaaaattgagggtccaggaccccggactccgttcggacctaaaacccaaacctaggcacatccggaacttggagcttgagtttggattgagagatctcagacctggaacctggaacccaaacctaggactgagagaccccagccccagcttcattggggtgtctgtctaagaagtcccaggcgtcctgagttctggcgttcccccacccccacaccccacgaggaggctccaggcgtccccatactttgcatctcagaaaggccagggagcacatagatcccgaaaagggcaggtccctgttgaaatgaacaacctagaacccggtcacgcctggcaccatgtccctcag

SEQ ID NO: 91648 - DNA, 1039 bp, Homo sapiens
caccacgcctggccaagtgtaccccatctttaagagatacgagcagagtcaggcacagtggctcatgcctgttatcccagcactttgggaggccaaggcaagaggatcacttgagctcagaagtttgagaccaccttgggcaacatagcaagacccccgtctctactaaaaattaaaaaaaaaaaaattagctgggcatggtggcgcatgcttgtccatctcagttactcaggaggctaaggtaggaggatcacttgagcccaggagattgaggctgcagtgagccaccatcacgccaccacactccaggctgggtgacagcgagaccctgtctcaaaaaataaatatttatttgagctgtgggcagtgaggtcttgaatggtaaagtaatgcttccaagatgacaggtcccacgtggggaagggctccagggtaccttctcttacctcctccccactccaggcccaaggagaggccatgagggcagtgctgatcccaattcgagaggttctgaccccagaatcggacatctccattgcacacgttctggctgcccgagccgacctgtcttgtctcgtcccagccaccagcgtggctgtccgcagagggacctgctgtgccatcaacaaggtgggcatctggggtagggaagggccctggcatccttggccttcagattggcctttcagcctctgctccagtccaagtttcagacttaccacctctaatccacccactagacatggcagctagaaggacctcgctcacacaaaaactgactgtggactccccagctcagaatgcttccgtggctccctaatgatctgaaaacaaagtctagctatttactgagtccctggctacttctccagcttgggcttaaaatccttccctatcaccaaacactacctatttgttgttttttaacctttttttttttcaagacagagtcttgctctgtcacccaggctgcaatgcagtggcttgatcttggctcactgcaacctccacctcccgggttcaagcgattctcctgcct

SEQ ID NO: 91649 - DNA, 1051 bp, Homo sapiens
tcagctcactgcaacccccacctcctgggttcaagagattctcctgcctcagcttcccgagtagctaggattacaggcacatgccaccaggcccagctaatttttgtgtttttagtagaaacggtgtttcaccatgttggccagacttgtcccgaactcctggcctcatatgatccgcccgattcagcctcccaaagtgctgggattacaggtgtgagccactgtgcccggccagtctggtgctatttcaatcttcagcaagacttgccaggggtgatgctgccccatgcacaatacagataaggaaactgaggcacaggaggttaggttgcctgtccaaggtcatgctggggatcaccgttagagctggtctttgaaccaggtggtccggcaggatctggagctacgctctgcattgcttgagggccattctgtcacagagtacccctccttccaccccagattcagctggcagcctgtgccacgaggaccacatgctcaacatggtgctggccatgcacagctgggtgctgccgtccgccgacctggctgcccgcctgctgacctcatatcctccaggactgtgagctatgggtggagggcagagggcagagtcgtgagaacctgggcaatgggaatggggagcaggcaggtcatggatcctggaaaacagagccttgaccagaactcaaataccagaaggccacaggggacacccaggagctgagacggctgcagatctgtcacctggtcaggtagggctgggccgagatccccactctcaggacccacgacttccatcctgcttccccctcaaaaaacattcctcagagaatccccaggccagttcccacagacccaaccagccccacaggccaaaatcccacttctgagacacctgtagcttggttcctaagaccctcttagttccgttccttagaacccccacttcctagagacccccctcaccaaccagatcccatagaccctcctagctggtgcccagagacctccaactctgatccccaaaatctctacctcccacagaccc

SEQ ID NO: 91650 - DNA, 1029 bp, Homo sapiens
aggggaagtataaactcagtcctggtgttaataaggactgaattatcatagactgaatctcatattggggatagagtcagagaggacaagaatagatatggggagccaaggaggagaggagagcaatgggactgattgggaatatgaaaccaaaggggctgatttagatctgggaacacaccgtcactagttgttgaaggaatatgaattcgtgaatccaagaaagacaaggaagggagggcctgggtctcctattgtgatgcctcttattttcctcatcctaggggatgctctccatggtcctgaattgcatagaccgcctaaatgtctacaccactgctgcccactttgctgagtttgcaggggaggaggcagccgagtcctggaaagagattgtgaatcttctctatgaactcctaggtaggggtcccagtcctgactcccctgagaacaccccagatccccagtcctattggatctgacacctcttcccccctcagcttctctaatccgtggcaatcgtagcaactgtgccctcttctccacaaacttggactggctggtcagcaagctggatcggctggaggcctcgtctggtaggagaacccgggggagtgggacagaggcttgtgggaggggatgggcatggccgcttcacctctcattctgggcaccctggcaggcatcctggaggtcctgtactgtgtcctcattgagagtccagaggttctgaacatcatccaggagaatcacatcaagtccatcatctccctcctggacaagcatgggaggaaccacaaggtcggcccctcacccctgacctctcatcccctgaactctgaatgctggcctctccccagggctccagaactctgctcactccctcacttccctcctccatctcatctctcacctgtacgccactcccactggctttcatctccacacaggggtctcaaacaatgactcttaagttgattctgggccacagatgtgcttggttagatctctgaaatgtttttttttttt

SEQ ID NO: 91651 - DNA, 1029 bp, Homo sapiens
gggcagcagggagccccaaaatggcctatgtggagggtttggggcccaaaattgggggtccagagtgaaatccctcaattttggggggttcaaggaggagaaggttctgcaagtttggatctaggaggatctatgggttgaggcttcgatttggaggttatgaaagagggggtggacctctagtttgggagcttggagagggcaatatggggatgatttgagcatacaattgggactgacatttgggtttcaaggagagggaccataattcaggtttggggttcagggaggagggctgatgattgcagtgtgtgagtttgaggtcctgggggtcagtaaggcttatagcgacctcctacccctgcttcacccggttttcccagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaagtgaggcctgggggctgggagacagagaggaagatttcaggggtggagggaaccccagctccaacatctgctgaccctgtgcccccaacagtgtgatcatcccggagaagctggactccttcattaacaagtttgcggagtacacacacgagaagtgggccttcgacaaggttggcctcagggtcctcctatccaagaaaccctcaagaccccagctttccccccgacctggttcttccctgaggccccagatctccctgagaccccccagccttccctaagacccttagcttgttctgggacccccccaggattctctgtcctcggctcctccagggtcgccccgtgtgtccccaactgctgcctccccctcaccctgcctcccctccatctctagatccagaacaactggtcctatggagagaacatagacgaggagctgaagacccaccccatgctgaggccctacaagaccttttcag

SEQ ID NO: 91652 - DNA, 1055 bp, Homo sapiens
agccagtacacaaacccttggctccccttcccacattcatgcctgcctcacgcacactgcataactgcaggcccctctcacactcatactcctcctgtccccccacagagtcccaggcccttgcacacctgccccgtgtgcccacgtccaccgtgcacactgagcctctcgtggttgcacacttttggcatcttcccatgccgccacgccctccttactcctgatccctccctggcccccggtgtctcctcacatactccgcaggaacccttgagatcttgcacactcatctgtgcccctcggggccccactgcatacacacccccatctggcacacaagtggttgcagcatcctggcacccaggatgtccacacatccctgcctctgcaggaagcccctgttcaccacggcccttcccactcattctttgcacgtgctgggggagctctgccctcctctcttcctctgaccctgcgtgctccccatacaaacactctttgccttagtgctattcctccaaacacccgcttccttctgctcaccccttcccattccactttcccctgcttctcaggcatccacgtatgcccatgtggccttggagcacctgtggggcagtataataataggtaacactacggtgttgttgttgtttgagacagagtttcgctcttgttgaccaggctggagtgcaatggcacgatctcagctcactcaacctccacctcctgggttcaagcggttttcctgtctcagcctcctgagtagctgagattacagccatgtgcaaccatgcccacctaatttttatattttcagtagaggcggggttttgccatgttggcaaggctggtcttgaactcctgacctcaggtgatccgcccgcctcggcctcccaaagtgttgggattacaggtgtgcgccaccgtggcctgcccactatacagcatttatcaggcaccgggcgctgttctaatcatgcagcatctattaactcatttaaccctcacaccaaccctataatgtaggtcctattatgcccattttacagagg

SEQ ID NO: 91653 - DNA, 1049 bp, Homo sapiens
cccacagctcccctgttctcacatcctggcccgatccctctgcctgtgccccacccccattccagccctgacccctatatgcccctacatcccagccctgacacccctgcctgtgcctctccactgccagccccgactgctctgcctgtgccccccaattccagccctgactcttctatctatgccccctatcccggccctgacccctctatctatgcaccacattccagccctgacccccctgcctgtgcctcccccatccctgccctgacccctctgcccatgttccccacatcccagccctaagccctctgcctgggcctcatttctacccttatcactgggaaagcacttctgatgtggggtcacacacagaccccagcaagatgtcatggcttctgctgagactatggtccagccaaggtgcctgacgcccacctttggcctcctcccactatccaggtgcccctggtaatctttaagcgggagaaggagctggcccggaagctggagtttgatggcctgtacatcacggagcagcctgaggacgatgacgtgaaggggcagtgggaccgactggtgctcaacacgccgtaaggacccagcccccacctcagggtggcagcaggaggggacctgggtttccacccagtccaggcctggaccccaaaaaactagggtttcggtccgggcacggtggctcacacctgtaatcccggcactttgggaggctaaggcgggcggatcacgaggtcaggagtttgagaccagcctggacaacatggtgaaatcccgtctctactaaaagtacaaaaattagctgggcgtggtggcgggcgcctgtaatcccagctactgggaaggctgaatcagaagaatcacttgaacctgggatgtggaggatgcagtgagccgagatcgcaccattacactccagcctgggcaacaagagtgaaattccacccccttccccccagacaaaaaaaaaaaaacctagggtttcagtccctgcaggccctgcctcattctccccaagtcttactctttct

SEQ ID NO: 91654 - DNA, 1815 bp, Homo sapiens
cacctccctcggaacttggccatggcctaaacgtaaggctgctgcgtgcattcccgcagagctccgtggcctcatggccgcgcgcaatacaacgcgcgcgcacgccgccagagctccgggtgcttcccggtgagttcgcgcgcgcacgctcccgcgctaccggcactggaactgggtctgtgaggcccgggaaaagcttagccccgccccctcgccacgagaggcgcctgcgcactgggatccagtaagatttttctcacgctgtctgtccagcttgagtggcgcgaatgcgcacgcgccaattgcgcctgcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtctgagcccggttggaggaagcgctctggccaagcggggcggaggagagggttttccggagacagcaaggggtgttcagggtcctgggcttgccgcggggtggggtttctctatcctcctggaggaggagatgcttaaagaaacggcactgagctgggggtagtggctcacgcctgtgatcctagcactttgggaggccgaggtaggtgggtcgcctgagcccaggagttagagaccagcctgggcaacagccaaaccccgtctctaaaagaaagaaacaaaagcactgcaaaggcctagaagcgagagaatcttggtaccactcagtctcttcgtaaattgccttaaggtttccttctctgctccgcctcctttgagtgcctcttaatctctcccttctctgctctataagtcattcattctccacacgtttactgaaataaactgtcagtgctaggcaatgctgggaaccacaggcgaatcagacagcggcagatcatgccttcacggtctgagttccctttccataagggagacaaacctgacagcagacagcgatagccgggagagattagaactgaaatgggggaagcaaaggccagagtgttcaggtggacatggaggaagtaggcagcgaggtaggcaggagaggatggggctggatcagggtggaggcctgaacaggggaggaaggggtgagtagcagagacattcaggaggccaggtgtacaagctgcagtgactgactggctcagaggttgaggaggcatcctagggaagagccagggctccagtggagtttagagcttaggcgagaggtctgggataagaataagttttactagagattatactggacataattcactacctggatagagcaagtggccagtgccagatttagaggggaagggcgggaggagcaggttacagtggccccttgctccataaggtggctggcctcagcttctgtctcctctgtgctcacctatcttgattctcctttaggtacaatcctgagaacctggccaccctggagcgctatgtagagacgcaggccaaggaaaatgcctatgatctggaagccaacctggctgtcctgaagctgtaagtgtctagctctctgtctacactcccattgcagcaactagcagggtgccactcccagtacagggcaagggggtggctggtagtatcctgaacaatgcagcatctcttggtgtgcaagactaggaagccaaggaagtt

SEQ ID NO: 91655 - DNA, 1049 bp, Homo sapiens
ctgagcaacaagagcaaaaactccgtctcaaaaaaaaaaaagtgtattgtttctggtaatggtcatgttataattttgcaaccgtttcatataggttgtgggaaaaggtagataaatacgctgctcttgttaggaaccaaaatttgcccagggagagaaaacagaggaatagaaattaaggcagaagccccacgatgaggctgaaagagctcacaggctccctctggcggccattcagagaatgacccgtggaagggcaggggcggaagcaaggagaccaggccagctgctgctgtccaggagatgtcagtgggcaaggggggctgccctggcttcctgagccatgactctgttgcctctcagtcccctggaactgtgggatcaggctgactgaagccccttgctgcccctgtcacctgcagacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtctgcacctgccagattccattcaccttgtgtcttggggctcccgcccaggaggaatagcggggagctgggtgatcttccctggaacttctaggccctgtgtcctgccccatagcactcagcaagacttcctggggcccagcggggcctcacagggggtctctgcacccttatttgtccctgaggcctgtctcgttggccatcttttattcttggggtgcccaagcctcatgtgcagacttggaatccggtgaacagtaggaatcttgattctctagtttgggtgattccacatttttgtgcctcagttttctcatctaaaaaatggggacgactgcaacagtaactatgataaacactgtgtaggtccttacacttacatcatttg

SEQ ID NO: 91656 - DNA, 1049 bp, Homo sapiens
gcaggagaatcacttgaacccggaaggtggaggttgcagtgagccaagatcgctccactgcactacagcctgggcaacagaatgagactgtgtctcaaaaaaaaacttaagagtatcctgcaaatagtacctagtaaatattatcatgtaggtaattacaaacaacacttccttggcactttgttctaagcacctcgtttggtcctacaatcctataaggtaggtgcttcttaaagataggaaggtaggtgatgctcagagatgttcagtaacttgtccaagtgacccagctgttaattggcagagctgggatttgaacctagccctccttgctccagagtccatctttttaaaatactgcaccaaactgcctttgtgatggtaactggggcctggaaggagtttatgatctccccctaaagaattgtgggtgctgtagcaggtggctggaggtttgtctcccgcccttctcaccttcagtctggtctctccttccccacaggtgtgtccagcatcatggcctcctcccagtaacttcaggtgtttaataaagatgtgttgactcagccctactgtctcctccctggcttcctgcctctgccccttgcccaccagagggagctcaggagcaggcctctgctctgggttggcccccgcaccgtacccccagcccccaccacaccacaccccatggcggggtttccgcctcctttttcccctgcttcgacttcctcccttgccccaccctaccttcctgaccttttaggtcttgggtggggagggcagcattgagtcagcaaggaggagggagtatgaatgggatgtggcagcccagccctgtggtggaggctgagcacctctgggaggagtgaaggtgaagtttccctctgtcttgatggtggctcttgctttgtgaccttggtcaagggactgtgcctcttttttttttagacgaagtctcgctctgtcgcccaggctggagtgcagtcgcgcgatctcggctcactgcacgctccacctcccgggtttatgccattctcctgcctcag

SEQ ID NO: 91657 - DNA, 2556 bp, Homo sapiens
tgtggcttcctttactagaaggtagtttcatgaaagttgggatttttttctgtttttagtgcctgcgtaaaacatagtctggcacagaataggtgttcaataaatatttgttgaatttgtgtcgctgaatgggaacccggtgcagtgcattccaagcctgagctggttcaggtccgatggcggggcctgcccttatgaatcattcatgatctggccccgcccatacgcgaacgacgcgcgcgttcacgccggagagggggcgcggctcgcccccgggctgagtcgggcggccaggaagcgggactctgcgcaggcgccaagctccggagcgcggccttggtgccttttctggtttggcaggcgcgcgcgcgcgggagggcggcaacctcggcgctgtgcgcaggcgcggcgggcagtgcgcaggcgcgggcggagggcgggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaaggtgcgcggcccgcgggccggacgggctggaggggcttttctgagggggcccggggaggggtgggaggtcctgaaaggtaactggagcgtctgtgatgggaacgggggggtcccgagaaggaattggcgggtccgggaagggaattggagtcctgaggaggaatcgccgagctagaggaaggaattgggaatctgaaaagagaattggcggctgggtggggaatatgggagtcaaataaaaggaatcgggaaggctgatgaaggatttggagggtctgggcgtgccattaggggaaaccgaggagatgactgggcaggctgaaatggaactgggatccgaggcgggcttgaagggtcggagcatgggttgggggtgctgggaggagaatcaggggaggctgagaagggaatttctgggtctgggaagtgtgaggaggagcttgagtgtggaggggttggttatttggagagcagaaagatctgaaggagattggaattgggggagcctcaggttgggggagttataaaggggatgaagaatcaagtgtgaggatggagtggagattgtggggtctgaagacgggtgggaagactagggaggctgggaagatgaaaacaggggctaagggtagaattgagcatgaaaagacatgggcttagggtgtgaggagggtagaggtgccaggactgggggtctgaggagggtggggtgcggaaggaagaagttaaggggcccgtgaatcagacgtttttgaagggggtgagatttatttgtggtgccctgttccaaaggggagaagattaagagataggaggaataataagaggaattgatgagggatggagaagccgaagtagaggggatacggagagtggggataatttggggagggatttctaaagaattgatgggaagctgaaaagctaaagcgttggagagaatgaggaagtgtagagggagaaggtgagatcggtgggagggagggtgagctggaatggtggataatgggagagaggttcgtttaggaaaatgaaagtctcattagaaagggaatgcgtaatggatagactgagaaaggaatttgaggagggggtgctggctcctggaggtgcagtcccgggactggagagcgtgtgtgtgtcgtgcaggcagaatgagtttggggaggaagcgttgagagtgtccaggaagaattgtgtcttttttggagagaccggaggtaggtgaagggatcctgaagcagagactgtgttcaggtggcactgtttttttggggggcggggggggcaacttggtagggccccacagcagtgaaaaggtgatcagaagtggagtgggatccccgagcgaggtgtcagtgtctgtgggggggggataaatccagtgtggttgaggggggagctctgagtgtgtgcaggaagagctaaagaaaggagcgtggtgagtgggtgtgtgtggggggaaggggttgttcagaagttttgtgcgtgaaatgggtgggaggtacttgaagttggaagcatttcgtgggatctggagatctggattttctttccagatttgttactgattcgctctgtggccttggacaagacccttgaactctccgggcagttttgttatctgcaaaatgcaaagggatccgagggttccctgcggtgattctgttaataaagagggatgtgtgtagagttgggactttggacagggctctgaaggtttgggagagtgagtttggtggagatttttcaggaacaggctacagggctttgagtggtgacctggcagagtggggagtgactggaagcctctcgagggcgcgagttggtggccaggagcttggcacaggcagcc

SEQ ID NO: 91658 - DNA, 1326 bp, Homo sapiens
aaaaaaaatcagatgacagaggggagcggggacaagttttaagtctaagcctcctgggtggggagttctgctgtttcaacatatgctccagtcatggcagactttggccagacagcgccctttttcagagtgaactgagtgtagcacaagttatctgccagtgctagttagcaaacagaatggagccaaaaaagaattgatttgggaaggcccaaggaatttgaaaccgttgagatgaacactttccgtttttgctacactgatttatgttgtgctgggaattgtacaagcctttgaccagaccttagggttgttctttaaaaaaaaaaaaaaaagattcccttgctgctgcttttacttttttgaagggcagaagggaagggcaaatataattagtgaacagctgtttgctctagtatcacttgctcgttcaggttttctgaatagctgaaatatcaacatgtttatctcttcccttgccttagtatatcctagagcagtgttttccccggctttatctttattccttcatttaatgaactccgtgttttcatcactcacattttgttcccttccctcagtttccttcctttgccttcatttatgtatttagtttacagaataacaaaagcactcgtgttacttttaaacaaggtaaaacttaaacagttttttcctccgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcccaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcgaacatggtgaaaccccatctctactaaaatgcaaaaaattagccgg

SEQ ID NO: 91659 - DNA, 1265 bp, Homo sapiens
ggtgcacccctgtaatcccagctactggggaggctgaggcaggataatcactcaaacctggaaggtggaggttgcagtcagctgagatcacgccactgcactccagcctggacgacagagtaaggctccgtctcaaaaaaaaaaaaaaaagaaaaagaaaaggagttaaatctttgcatatatttaactggcaagagcatccttacatcagtgcatgggaagttttatccaagtagcagtttccctgggattataaaaatccccgaggcatttgtcttggtgttgtgcctttttttggttgtgttttttcacgtccctcccctcccctttctccataaacaagagaggcattaacttggaatgtccgtggaaagtcttagaagctgattggtgtaatttgcctgccttccctttagtttgaacagcgtttactctggaagaggtcagtggcctttttcttggttgtgatttatgcaagtgttatctgaaggcgagtggagtgagtttacgtgggatttgctgtttgccacctgttgttgtgctggctccttccttcctgggatgagttccattctctccccctcccccaggagtgaggctccccagccagagcagtccccctgtgcttatccccttccttcgtaaactgcagccatttgtgattttccataaccacttttatagacacataataatttcctttgaatcagtttgcattttaaattaagttttgaaaggaaaactgacaagagtatggcaactggaaaacccagctcccctggccataaatataatagaaggaaactgcaaaaataaacacattgaaaacaaaacagtgttgtttccaggtggttaccactcgggctgaaggccccccaggcttgaggcctgctccctttgttagaaagggattggcaagtgttggtgaggtgttaaagacccaccagcaccaagcagagactttctctttgaagtcatcaggtttacaagagaatcaaaggaaataactttctcaatgtgattcagggtgtaatgtaaggtgtagataacccttaaaattttccatgtgtgtatgtcacacttgggaaaaaaacttgatctcatctggtcgaggtgggcagggcagcaccttgtccaggagcacacagcccctcttggctctgtgtgtcatccggccatactagactcgaacatatggctcatgactggatgatgcttgattcatcttcagtttcaagtgttagtgcttttgaggttttgtaaga

SEQ ID NO: 91660 - DNA, 3052 bp, Homo sapiens
acatgcagaaatggatccatgggcctttaagccacttgcccctgtgacagtgccaggatttgaatgtagaagttgaggctttcaagtttatgctgttatttctacactacactgaagtctagtgattgggaatggctttgcgagcgggtggtgaggggaggagtgtgcagtgcaggtacttcagatggagaggaaggtctcaaagaggtggcatttcagctgttccttaacggatgagaaagagagaaccaagagagcaccagaggaacgcgcttccaacagagaaaaccaagcaagggggcccccgaggagcagaaaggcccgagtggtcagagcggagcccgtggaagagatgggcacagccagattgcttagagctgtgttgttagaagtgctgatgagtctacattcaacttgcgcctgcaaactcagtccctcttagatgccagtaggtcaggaacctcatgcttccaggactctggcgctcctaccctttcctcccaggcctcctggacaggccaaaccagaactgacttctaaagtgggaaccccaagacggcagaacatgaatcagccaaacaaaagctgcagttatctctgtgatgatttcggcagtcggcacgtgtatttgattaaagcgttggtaactttgaatctggagttttatggcactgtgtactactcataatggctttgtagtgtggctctcttagggagcttaacttttacaacatgaacaagttccagcctcctttggtcccatcaagaggccatttctacctggtgggatgccacttgctttacaaagcatcttttgtaaaatgttgagtctccttctttgaagttggaagccaggaagcctgattttttttccaataagtattgtagaagatggcagcctgatttatttttatttatttatttattttgagacggagtctcactctgttgcccaggctggagtgcagtggcacaatctcggctcactgcaagctccacctcccaggttcacgccattctcctgcctcagcctcccgagtagctgggactacaggcgcccgccaccatgcccggctaattttttgtattttttgtagagacggggtttcaccgtgttaaccaggatggtcttgatctcctgacctcgttatccgcccgcctcggcttcccaaagtgctgggattacaggcgtgagccaccgcgcccggcctggcagcctgatttttaaactggcttttctcctaggtcctttccttctctataaatccctctttcacttagtatttcctccttgtttcctttggtcagttggagtgagggtggttctagttcagagaaagagacaggcatacaggctgattcagtctgaggtgcttagctttctgtacctcactggaaaccagtccaggaatatgacaggtttcagtaggtttcattggacccacaactccccatttgaaggcagagcttgtcaaacgagttatgtggcttttactcaaggagggaggaacagcaacagggagctctgggctattgatagacactcctgcctctgaacacacagcacccagcaagaagttaccttcatgggttgtctagagtgaacatgggctgggattctctcagccttagcactgatgatttgacaacaaaaatcgccccgtgggtagagtataacggagcaaatgattatggtggcctgtgatggtgcagccagcccagctgcttcagctggaaagaagatggcgaggtttccattctcctggcagcatagccatgtgaacttgttaaatcttttaagtagctgtataggaggggagataagtgtgtgtgtgtttattcttatccccttaaatacaaaaacaaaacttccactttataaaatcaattcagagtgggaagaggtgcatggcacatggaaaatgtgtcggattaggttgagtcctaccccacgtttgggacacagctgtaagtttccatggtgggtggcttattatgcatttatgctgagctgaacctgctccaagctgctgcagataggaaagtctgtcttggagggggagctgcctctttctatcacactataaagacataaaaggtcctttgaaagactccagcagtcaccacttgggtaacagaattaggggctgctgagcaaagtgggtctgtttttttttttttttaaagacagagtttccctcttgttgttcaggagtggagtgcaatgtcacaatcttggctcactgcaacttccgcctcctgggttcaagtgattcttctgcttcagcctcccaagtagctgggattacaggtgccggccaccacgcctagctagttttttgtatttttagtagagacggggtttcatcatgttggccgggctggttgtgaactgctgacctcaggtgatccacccgcctcagcctcccaaagtgctgggattacgggtgtgagccactgcgcccggccacattttatagccaaccggcttcttgtgtaacatgagttggggcttcttgggccccagagtccagcactcaggtagaaatatgaccgccatggccagacagcagccctcgctgggcccctcttcagagcagagctctgtgccgagcctttaggggtatgagagaaaccggagacctggtccgtgctctcaaagagctcgcggtgtagctggggagagagcaaggccacatgagacctcagaaggacactaaacggcacaccgacaagctcacagcactctagctgtgtcccgggagaggaaaggggtgaatcagggcaggtggggtcagtcatggaaactttcataaaggaggtgagtgtgcaggaggggcgggcctttgcccccgctgcgggcaggttgccgagggcaagtattagggggtccggcgtgcaatcgaacatttcttagctgcctctttggagtagcgctaccagttcctgtccccatgagcatcgtcttcggggagctgctggtttgaaggatgaggtaccatgctcatcttggccatgtcttagaacctgtgatagccagacctgtcgttct

SEQ ID NO: 91661 - DNA, 1084 bp, Homo sapiens
aaatcacaaggggtggggggtgtctcagaaatattcttagctgggttcaactttcctcgtttttctaagtttaaaaaatcctctcttactatttttgctcatcaaaatgctgctgctttttcagagacagccttttttgagccattccctatttagtgttttgggtaattggctgttacagtatggaatttgtggcccaaaggcagcgtggtaagttagacactaggtgcacggtgccccattgttatgaagtgtggaaactgagacgctggactagtctgatgtatctgtttcttccaccaaaaaaaaaaaaaaaccattttggagaactacccaatgccagtgacttggcatctctgagtcgctaatcttcccatgtgcctccaggaaccgtctggagcgtccctgaaaaaaggacaaggtttgtatcttgtcatttttcctctggctggaagtctaagaggtataaacacagtcttaaaatgaaagcaacaaaaataaactcaaagcagccctgcgtgaaggcattaatgcaaaatatgcaagctggcttcctatttatacggcggaaggcagtcagaagagccaggcctggttaaggaaggagttatgtctctggaggtgcctgttccttagaattacaaataaaccctgggtgattactcagatgaggttgtaatgtggtgtctcatttcatgctttgcacagtccagtttcttgatggaaccaacggcctctgaaatgctaatgcaggatcaggatacagttagagtgccccccttcctgtgcccctcctaacatcctaacagctttagaaggaagtttgaagattaaacaggagagccatgtaagtttcctgtgatcctagatcctgtgatttgttaatattctttctcttcaatccacctgacatttacccagataccatattaggcttggagatacaacaagaaagaaaaccaacccaaccctgtccttaaagaaaagatggacgatgaagggccaggcgcagtggctcactcctgtaatcccagcactttgggaggccaaggcgcacagatcacgaggtcgggagtttgagacc

SEQ ID NO: 91662 - DNA, 1029 bp, Homo sapiens
gaagagctacccatttgtgacccctaaccttgcatggtcttgaccctgtctctgcctctcctctagtctcccctttcctcttgtctgaattgctgctgcttaatcctctcactaggagcgagaaaattgtactttgccccttagtgacagctctgataaaaggtggttgaagtggatggtagtaaaaagggtttgctttagctgtggttttccagcctccggactcctccccctttcccatcaccatagataattaagagttgactcctcaaaattcctcccaccatattgcatatttttaggcttcaggtttttgtgaaccaaaatagtggaaagtttttttgtttgtttgttttgggtagcccaaagcaacacttttctacagaggcagccattctgcacgcacaataacctggtgaacaatgccagctttctattaataaatgaactgccagttcagaatttgtacccatgtggcagatggacagaaatagtttctttaggattgatctcttaaatttgactttgggaagatactggcagtccaggttttgtgacagagatccatcctgagatctttgtaaatggaaaagcctgaatgcagcgtttcttattgataggagagttgatggatttcaggaaaatgggatatagtagatgtgcaatgaatttgttgacttggaaacaaatttggacacttatccctgaaaacttcaggccattttttcctaaactctaattgagtccctgtgattggagtactagccccacagtccttatcaaacttcgcatttggagcaggcagtctgtctgggaaaagccaggaagctcgccatgaaggcatcgccctctgcttttaacttttttaggctctgttacctctgcactggcttgagtatttcctggctcaattgtttctcaggctggccttgagtccttagatgttatttgtgtgcctagaaatagctggaagaaaaatggttgtaatgctttgcattgctcactgctctccatggatggaaattctgt

SEQ ID NO: 91663 - DNA, 1123 bp, Homo sapiens
tgctgggacagatccctaacacagctcattaaagcagatagcaccattccgtctctttcttcagcttcactttacgtcagtcccagcatttttatccctacccttacagatgagagaactaaagttcagagaggtgacgtgacttgccccaggcccctcagtcagtaaaagacagaactgagaatccaaccagactcttccctttttaggttatttctctaacattagggccgagtatcgattctctttacctctgacttcgtgtccctggtattaagactcagggcccacagtgcctcttggaattcaggcatatggtgacatcagtgtgcctaccattcaggtcttggagaatagggtatggcgaaaggagagaactcgtgatatcgctgattcagtagcccagagttgtacgagtccttgggtgtttcaccttcatccaggcatctgagattggagacaagcatgtggctgaatgacgtatctgggggaagctgtctaaacagccgtgtggagttggagagttgaattagctctgtggccaaacctctgggctcagtctgcctatatatggcttgatctcaaagaacaggtgatagcagtaggagttgttttctgtgttgctggtgggagatgcccaggcacattcctttgtagacaagcacaaactagatatttttgaaatcggaggtctgaaaccagccgaagaattaatcctggcctggaaagcatatgggagagtacagccaacctggcttgggtgttgctttcttggttttgttgcatttttgaggcagggtcttgctctgtcacccaagtgggatcacagtggtacaatcatggctcattgcagccttaacctcctgggctcaagtgattctcctgccttattttttgattttttttgtagaggtgaggtctcaccatgttgcccaggctggtcttgagctcctgggctcaagtgatcctccaccttggtctcccaaagtgttaggattacaggcgtgagccgctgcccctggtgactttgttgctttttaataagcccagaaatttctttcaagagggaggatctttgtgaacatcttgagccgcgttcttgatcgctggctgtggaagcctc

SEQ ID NO: 91664 - DNA, 1947 bp, Homo sapiens
acccctgccaggctcattgcatcccatctaaaagtgtgctctggaaggtcataagaagtcctcacctgggacacttctaggcccagtgttcagccagctgtcctgagttctgcatcagtccctgctagatatgaaacacaaacaggatgcgatgcttttcttttttttctttttcttttttgagacggagtctcgctgtgttgcccaggctggagtgcagtgggtgcaacccctacctcccgggttgaagtgattctcctgcctcagcctcccaagtagctgggattacaggtgcacaccaccatacccggctaatttttgtatttttggtagagacaatgtttcaccatgttggccaggctggtctcaaactcctggcctcaagtcatctgcctgtctcagcctcccaaagtgctgggattacaggtgtgagccaccgcgcctggccaaacaggatgctttgcaagtaggcagaagagggagacatcactgtcccatggagaggtgggaaaatcatcgttagcacaggataattcatcctattttgtgctcatgtttactgagctaggattgacctgtgtccgggcagcagggacacagaggtgagtaagacaaagagaaggcccttgcccttaaaaatgatacgtgtggctaaaacgctgtagacctttttgttttttcctttttgagacttcctttttatacagaaattgctacctgcaggtaaaattaacttacatcgtgaaagcgacagtaaagtgtttctagggatagctaaagacctaagaacacagccctgtggtttgactggctggccaccttcctgcagctgggtttactatggtgctgtgttctgggacagcccactcgtctccatttattgggctgagcctcgagacctgcaataccagggaaggaagggaagtctaggctgtctttggtggccattgttatttatggggcatcggcagagaagtcagtaccatggaaaatctagagaaagatagaggatacgcagtgtggttgagcagaatctgatagctccctggctctctccgggccatgggacccagggcgacacagccaccctttttctctctgctgtctggcttgggcttgggctttgtctcctgtgtccctccacaccttcttcgctgtcagtggtgaccaatcccgtggaatcagccactgtgtgttaccccaagtccttgcccctgggacctcgctctgttcggagacaaaacccgggactgtttctccttttaaatgcaaccttgttccacaggagaggagaaaagcaagaaagaggtggcttgtttatctgatggtagtggggtgtgctctgatatgcctttgaaaggggcccagctttgctttgcccagcggcctttgcaggataatgagagaaggaaaacacagggaacttagtgggaatttgaaactggagtgtgggagtgggaaagttcagcttttaccttggagcaatccagtctttctcctgtaggaaaacagaatggtgctgtatggcctccaagctgggttacatcctgggaaaaagacacgtgcttggctattggcctgggcgcagtttatgtgtaagcctttccttgtggattccattttcttatttcccgaatacttctcagccccacaagtccactgagtcttctgtctccagagactgcctggtttccatccccgagggcatctgcgcatcacttaccatggtgtaccatgcacctccagtgtgcccggcactgtgtcaggagctggggatacaggtgctggtccccacctcactcccctcaacctctgcaatatatgatacataacccacacacacagaccatatgcaaaagtggtgggactcctttgtacctgtcacctgcatcagtgattatcagcattttgccagacttgtttcatcagtgtctcccaacacactcc

SEQ ID NO: 91665 - DNA, 1099 bp, Homo sapiens
aggccttatgccccacccagtcataaaaatgcctcttgctgttgttggttcaggctcagccccttagtggctttcatggggcaggttgacatggtacccagagtcctcctcggtcctcttcccatggtgtagtgagagcactcaggaccacctaggcctttcctagaaaactgaacccacaccttcccagtgctgccccaccctggtcccccaccccctgcaggacaaaccactcctcccttgttttggggccaggagtcagatctgcccctgagagcagcaggggcccctttgtcctttgacgtcatacccacaccgctcctggagacagccaccccttcatgccagccccaggaaggcttgtaggtggggcgagccagggtgagagtgtagccctgttcctcggccagggcagatgtttcaccatttttaatggagcaattatgagtcagaggtttcagtctctactggttcctcccgatcctataattactctttggctatagaatcctattttgatctcttcttttcttttctcttctttctctctctgtggtcatggtcaggtttttctttttttaaatcctcccaagacactgctaatgttgtctgtctcatgcatccaaggaatctgagatggactgaatattgtcaagggaaaaaaaaagagacccccaaatccagagtgatttcttaacccacccaaatggctttttgtttgtttgtttgtttgtttgagacggaatctcgctctttagccagggtggaaggcagtggcgtgatctcagctcactgcaacctctgcctcctgggttcaagcgattctcctgcctcagactcccaagtagctgtgattacaggcacatgccaccaagcccagctaatttttgtatttttagtagagatagggtttcaccatgttgaccgggatggtctcgaactcctgacctcgtgatccacccaccttggcctcccaaagtgctaggattacaggtgtgagccaccgtgcttggccaacccacccaaattgtgtaccctacaccatcctagtgcttgggagccaacacccactcacaggaggctaagggcaagtttaggt

SEQ ID NO: 91666 - DNA, 1056 bp, Homo sapiens
gcaggcctggagaggagccctgtggcctcagcaaagggcaggcaggctggtgagcacccaacctctggatcgaggggactcaattatgcggataaaggcccctaatcctctcagtgctccaaactcactctgcttctgaaagggatcttcgtaccctgggttcagagagtaggaagcccgcagggaccgagtatgcatgaaacaagcccaagtctgtgggggctgtacatggtcaagatcacagatttccagaccaagccagctccaccctagctgggatgcccaccctgagacacccctctctgctttcactggaataggatggccctgacttggccgggtggactgttgaatcagagcctctcaaaacaggaaaaaggaaaaggatcaccaagcaggagtttcagttgtcaaagacaaaacccttaccacgattaaagattactccagggcctcgcatattcacccttccaccagcagggcccagtttacggatcatttgaatactagcaaaaaaacaagccatctgctggagagattgaacagagggagaaacaggagtgtttgccctgcttccagacacccctttcctgtggcagttcctgcacctggcaagatctactggggaattcccggggtcccactagctcaggacgggtgtgtagcacttgcctaaataacaatcccatcagtgccctgtctgaccttttctccccaaatgccaaaggcctcttgtctggatgaacaaatccctgggcggatttgtccagactaaaacgttaattctaaagactgggccccttaggcactcgctaagattccaggccacactgtctcaaggccagaattggcttacttggctatctttttgaaagatcaaagtttaaaccagatgatctgtagtcccccacccccaccctgaaacctgagcttagctgtaagcattgaaagtaaatggggtgtttgtagctcaccctccctgttctccaggtgaagggccccgtgtgcctgatcatttcatagcaaaatgctagatggggccagaggaggccccag

SEQ ID NO: 91667 - DNA, 2320 bp, Homo sapiens
agcctggtgctcagtcatgtttgtgtgactgagtgagccggcggcgggctgaggcgcttttgtctggtgtgcgtactggtctcccttgaggcagcttgggggtgtggaaaaagcacatgttgccaaaattgacagacctgggttcaaatccaagctctgccacttaccgcctggatggtcttgtgatgggtcattaaccaccccgagcctcagtttcctcacatctgcctcccggggtcactgtaaggatcagaaacaatgtgtgtatcggccatgtacggtgtgtgtcggcgagtgctccgtggcagctgcggttctcctgaggtcagagctgcggccctgcaggtgtgtggagagagccccgacagccaggctgactctgcgcactgtcctttgttctgcttccccagaccttcacggcatggtgcaactcccacctgcggaaggcaggcacacagatcgagaacattgatgaggacttccgagacgggctcaagctcatgctgctcctggaggtcatatcaggtgagactcccagccacgcagtgcggccgagccctggcacaggtgctctgccacagcggtccccagagaccctgcccacccagctgtcccattgctcctggggaggagagggcaccccttaatagctgcacggtggtctgatgggtggggccagagtggcctggtgggccagcagaggaacctgcttttggagaacagaggagactctaaagcctctctccctctcgccctctctccctttctctctctctgtctcgccccctcttttctctttgtgcacttctcaggggagcggttacctaagccggagcgggggaagatgagagtgcacaaaatcaacaatgtgaacaaagcgctggactttattgccagcaaaggcgtcaagctggtctccatcggggcagaaggtgagctggaggtggggcagcgagggtcctgctcggtttctgacctttaggctctgaagcacaacatctgcatcctgaagagaagttttgttggtggcagggcgcttggggcactcagagccccagtacatactcagcagtgatcacaacaactgctcttgatatgatgctgggcccacaagctcccccaaacccttggaaaaatccggtgggcgcagtccaaatctaggaagtgcaacccacccaaccacgggggcgacggcttctgcagggggaggaatggttttgactcggactcaggtcgccctcactggttctccttgtgccaggctcagcagacagtgacaaacatgtgccatggcctctctctgtaccaggaacacctttctcattatgccctgcccggtatcagagaaggactggaggccccatgtcaggcattgggacagggagtgcacggccaaaggtcagtgcctagactttgccctgtgtgcatgggcttggagaattttgcctctgaccaccccaggatcctcctgggccccacgtagataaccaggaccacagtccactacctgcaggccctcactagagcagcaggctctcagcaggggcccctgggttgagctcccaggcgcttttagagacaggcgaggcctgatggagccccagcagcatgagctcgcagtccactcattagtcagagtaagatttcttcaccctgacatccatgttgtcccagcttctagaaaaacaaagtaaactaattgccgttaatgacagggctctgagagtttggccaagactccgggccagaatgtgtgtgctgagttccaaggctctgccccggcccaggacctctgcgatgaggggtgccaagccttgcatgccacagtcgaggtggttggtgtttgtttaaaaaaatcacaacccaaaaattcagtcaggccctgagattttctgtccttgcatgggtctttcctccaggctctgttccagccttctgcttctcacagctgcatttattttgctcaaatgctagtctgtaaatacagaaggggttagaggagagacccatgtcagtcatcagttttcatttggagaaaaacttggtctaaaaatgttctctgttcatgcccaaattggttcactcccaatccctgtgactgtggggccttggaacaaagcctaatggaggcgttcctggggctcaaggcacctgagaaccccgccccaccctgtccccctgtccttccacatgattgggcattcgcgggagcattggcttcccgtgggggtgatgagaggggccggaggcacagctgcaggtcagagaagcagctggtggatgtgtcatgagaaacgccatcctcctctcctcaccggaa

SEQ ID NO: 91668 - DNA, 1139 bp, Homo sapiens
tcacaataaacaataatgtagtgcacatttgctgactgcgagatgaaaaagaccacctttgccctgagagtgggggcccggggtgcccccctgtagtcaggaggtacgcagattacggcagaaatgtacagagcactgagagttgagagaggtgtgaacagaggccacacgcctgggaccagcctcttggaggagcggttttttgagttgggtcaggagaaggagctggctgcggggccagggacccttgtggccagaagcctgcaggcgctcagcagcaggaggctctgggacagtgctgcctagagactgttccctgcattttctcctgagggaggtggaggaggacaggcctgggagatgcaaccagggggtggtttggagcctttctctagatggggctggaaggccaccttcaggttgggcggaggagcctcactctggttttaacgaccttctgccctctgcccccttccctgtgtgcagagattgtggacggcaacgcaaagatgaccctgggaatgatctggaccatcatccttaggttcgccatccaggacatctccgtggaaggtgacagccacctgtactgcccccgcttcccacctgagtcagggcgggttagaggagagctgaagtgtgatcttcatgcttcaagcctcttcctgtttccttggggtcactcacagggcctggcccttgcaggggtagtcagtgggtggcaggtgaagggaggctcctcccagctgcctgcctcttggctccagtgccttccgagtgcctttgctctcacagcctcatctcagtggaccctcacgccaccctcatgagatgggctaggatggctgggcccgttttacagtccaggaacccaagtcccagaacagactagtgagagagttgggcctgggcctggttctctgtctgcttgacatccccatccttgaaacttggcccccatggacccgttatgagctcaggccgtccaggaatggacaatttcgcttccctgcaagcacctgtgtgcacacaggatgggcagagccacctgggctagcgtgcaggggctcccaggtgccaggtcgcagtgatgactgggagagatgtgcttcctgccctcgaagggctcccggtctgtg

SEQ ID NO: 91669 - DNA, 1126 bp, Homo sapiens
atccacggggaacagaagggccccctaggcctctctacagctggtatttcaccttgttcaaaagaggccaaggccggtatcaagggcctgtctgcagtgtgttctggtggtgaaaggcacaggcttggtggccaggcacatggcacagattcaggccctgacaccaccacctcctggggcagccctggtcaagcgactctcctcggggccgtgaggattaagcagggccgtgtgtcctggcagttgggcctggcagcatccgtctgcatccggaatgggagtggctgtcccgctgctatcactgctgctgttgttaggacagatatcctctccccttgggtttcgtttgaccccaggcctgagccgaaagtcccatccaacttgggctgagttctgagggtttatttttgagccagtgctcactgtctttgtgtgttttgcagagacctcggccaaggaagggctccttctctggtgccagagaaagacagccccgtataagaacgtcaatgtgcagaacttccacatcaggtaagcgccagtcctggtcatcctctcctttcctctaggaacctgagatccttcctcccacctgccctgtttgctgtgtttttgtcgtggtctgtgagatgccagccctcagtcagcccctccctggccacgggccctacaagcccatgggaaggtcacctggtcctctctgaggaagaggaggcagtttcccagccatcctggctgaaggcagtaaggtcagccctctcgccggcctaatagaacgttcttcgtccccaggcaaggtgactctcagaagcaacaataaagcttttcatttttgagacagggtcttgtgctgtcacccagactggagggcagtggtgtgatcactcatccctgctgccttggcctaggctcaagtgatcctcctgtctcagcctcccaagtagctgggactgcaggtgcatgcagccacacctggctaatttttaatttttatttttagtaggaacagggtctccctatgttgcccaggctggacttgaactcctgagctcaagcagtcctcctaccccggcctcccaaagtgctgggactacagatgtgagccactgcctgcctctggcctctt

SEQ ID NO: 91670 - DNA, 1050 bp, Homo sapiens
ccttcctgtaagtcaggtccgccagggtgtggaggccacacagcacaaacaccagcatcctgcagtggccacctcccccgaagcggcctgtctggttcagggcggcctcccatggaaggtgctagcagttataaagcagttgtcaggagtcaggcactgatccaagcatttactcatttaatccgcacaacagccctatgtagcaggtatgtcactatccccatcatacagatgtggaaaccgagatagcctggcttacccgaggtcacactgtcagtaggcagaagagtcaggatttgatcacagactgcctggccccagaggtcatgcttgcagcctctctgccacactgtctccatgcagtgcctggcacaggccagactgcagtgaatgggaattagtcactgctgtgggtgcacagggccatacggcactctcatgacagtgagcgggccctcctataacctttgcctttccttccccagctggaaggatggtcttgccttcaatgccctgatccaccggcacagaccagagctgattgagtatgacaagctgaggaaggtgagtgtctccagctccccttgatggcccacagacgtgccctgtctgaccccctaactccgggtcaccatccccatgcccttccatcgccagcctccagatctgggttctgcacgcagatgggcagcctgggagagccttgtgcaggctctccgcaacccctggctcggtggctgactctcacctcccttattcccctcgtggactgtccagtctccctccatggcactgcaaccaacccggggttatttaagggcctggccagccatgctttataactccccttcctcaatcttctggattctagaacctcctctgcccaaaggggcagagggcaaggaattccaaaccatcaccacaagcccatgttgcccatgcagggtcctgctgtcatttgcctgtacaaagcctgtatggatccaggccctggccaccagaagctgccagcctcgtgggggaaggcaggacaaaaattgtgtccaaagc

SEQ ID NO: 91671 - DNA, 1620 bp, Homo sapiens
cggtttgctccccttacccagtccccagtgctctctcaggcctggcccacatcttccagtcaatgtgaaaaccaggttttagggcaaggggcttaagctagggtctgtgggtggctggaaattgtatgaaaagagtacacctgcatttttctggagaaaaagccctggtttgccccacaaagatttcacgaggcactcctgtgagtgggaattgaatttatccaggcggtgccctcccgctcacacatcacacgtggctgagaactgcctgaagaaacccccaaccctcgccctcccgggtctctccctctgggccagccctgcctccctcctgctcctgcaccctgccctgacggagttcttgttgtccccacttgcctccttctaggacgaccctgtcaccaacctgaacaatgccttcgaagtggctgagaaatacctcgacatccccaagatgctggatgcagagggtaagtcatctcttctgttcagccaccactgtgcttcctgatggccttttctgtccagggctggcctcgggcaaggggctgtgggcacatcagagctttgggtcaccttggggagctggcagagccagcaagaagggctgaatgattctgggtgaactggggacagccatgtcgccctgggagacagagcaagggtagcctgggctggccagatgccttcagggatgaagaagcgtatggggagggggagctgaaggatcaactctcctgagggtgcatctcctcagggcccaggaagggcaaggtggctgaggaggggtgcttcaggcttcctgcgagcaaccctggcctctccctccctacctgcagcaggcatggagtatggagcccgacaaagtggagtgttttgttttttccttttccggctttgctccatttcccagccatgcactgccccatttcctagccatgcactgccccagctgggacctgtgtctctggcctctggtggcccttggagttgactgtcctgctgctccttgaggccattctcagagagaggaagtggcctcattttaatccgcttcccacagccttgtcctttccagacccatgggagagggaggggctgagggtgtggctgagcccacccaagtcacgcgtcactctgcaggtccctctcccccaaggccgtggccttgggagcccgtggatcccagtgagtgacgcctccaccccccgccctactcgggcagtttaacccttgttgttcacttgcagacatcgtgaacacggcccggcccgacgagaaggccataatgacctatgtgtccagcttctaccatgccttttcaggagcgcagaaggtaccgagcagggccaggcaggccctcctcgccgccaccgcgcaatgccgccgctgcctctcgcctcccgtgctcacctcatttctcttgcagacggcagtggcctctctccaactggaagccacccccagctccctggcgttgctgccccctcagccttagctcacacacctattgggtacctcatctgtgccaggcttttccaggcattgaggatgccctggtgactgagtcagacaaggtccctgttctcagggcacttccatgctagtgggagaaacata

SEQ ID NO: 91672 - DNA, 1094 bp, Homo sapiens
tgaagtgagcaggtacttgcagcaggagctgctagatgcaggctggggcacaggtgttccaggcagagggtgaagcactacgaaggccctgagacaggaagaagcttggcgtattcagggaccagctagagaggagtgagtgacacgcagtgatgggtcaggcccaacaagacccttgtggtgtgggataagaaattcatgttccactctgagggccatgggagccccttagggtcttactccgtggtgggagctgctcactcacattttcagacagatcatttagcaactgactcctccaacccaaaacaaagctgcctttatagggcccacagctagtctgtctccagcccaggccggttagaaaaggaatgcaccctattcggactccacaaaaccccgcaaggcatgtccacgcaggcctggggctggcttccagtccagagcaagtgctcttcctcctgcatgagcctcaggccggcccggccgccctccctgcgtctttcactctctcctgcctctctctctctttctctctctctctgtgcagatattgtgggcactctgaggccagatgagaaggccatcatgacttacgtgtcctgcttctaccacgctttctcgggggctcagaaggtgagctgggccaggcacacctcgctgctggggctgcagacctgccttcaccaccgcccttgcatcaccgctggccatctgtggttggagccctggccaggccgtgggccgccacaccacacagactgaccctgccggcctctgactcggaaggtcccctggggcaggtttcccgcctggccggtgctgggcctgtgctgaggagtcacagacctctgtttgaacacagcccaccctgggaggtgggtggtggcatcctaggctctcaggcggggaaactgaagccctgcattacagtcaatggcagagctgggatttgactgcccggcgttcccactcgccctgtccatcatctgcaccagggctgcctgcctgcccctgccaagcccttcgtggggagcactgggctttacccgttttgcagctccttcctgccaggaaaggctcagcatgtgcag

SEQ ID NO: 91673 - DNA, 2941 bp, Homo sapiens
cctccaaggccttcacatgcacaggcttccagagggtccctgtgcacacccccaggagggctaggcgcagttagccccatttgagagaggaggaattgaagtttagggaaacagctattcctaaaactagaaggggggggccgtaccttctgtggacccctgctttgagcctcccaactagcaggtgcattacctaccgtcagtctggcctggccccactctgccacctcttggtactgtgaccttgggtgggtcacttgacctcagcttccccacctgtgaaatgggcatcgctgtagttcggtctcacaggattgttctgggcgtgaaacgagctcctgcaggcaaagggcttagcacagtgcctggcacggcagctgccatttaggcagctgccagggagccacagtggtggggagtgtggttcttcccagcctcgggccagaaaggcctcttcacctcctcagcatgcgattggagcttgtgtttggagtgttctgctagagggcacgggccaggagggtggagggaggacccctgacccacactcccgcgggagggtgggcagggaccagcagcaatggacgattcgtcaccacagaccccaactaacagcatgtttgccattggactcacccctacgggccccgaaccagccccctgcccaccacatggcctcaccagattgcttttctttctacccacactgctcccctgtgcttagggctgaactccagtctggaggctctgagggattttgggggagcagggactggcaggcaagcccaggacagtatgggtgggtgctgaggcactgggcctggaggcttgtcactggcccctctctgagggggtagtggaggcccggctgcagggcgctggctggtcagaaaggaaagtgctgggtccctgtgtgctcctcaggacagccccgtggtgctgctcctgctgcctcgtttccccagagacccagtccaagctcttgcaagagtgctctctggggttcatgttttataaacgcagagtgaaccccaggtctagcgccagtgtgcccattctgtcctgagatcatttatttctagtcaccgaagcgttcccgcctcgttcctttattcactcactcattcagcaaccctgaacaccgccagtgcactgagccccaagctggatgcgggaactcagcggtgaaacatgattcccttgccttgcggcagccccgtgctcacagagaggacttgagtttcgggtgccagttgtctctgccaagttaggagtcagggactgacctctgtgacccccacaagctgcagccctggctgtgttttccacactggcctggggcccatgttcattggctgaggaacctcttggacctcatctctgaggagcaccgcctggggccctgggtgtgtgtcccgcagcatggcgcggggtgtgcacgtgcgtgtgtgcgctcacacgagcaccggctgccgcctccccgcctgtctccaggtgccatgtgtggaggggagaggctgggcgtcgctgcctgcagcactggctctgagccgttggccaagcctctccattttccttccccatcactctgtagaccctcctcactctttctgttcctgttctgttgccgtttcaactcctcctcttggaccctttctgtgcttcctgaaaggtacctggtctctctctccccgtgtgcaccccctgcctcctctacactgttcactgccccctagcaggacagggcaggacgctctcctgtagttcaggcccagggactatgtccaccactctcaccctccaaagccccagcacttttctgccccacggatggtgacttctgtcctctggagctcctattaacattgcctccaaggcaggagagtggacaggcctgagtgtgctcctgtgcacggaccactaggctcctccgggacccgggcgcccctgctctgttgcccccagctctccagctctcggcttcccatcctttcaccttcccaccgggagagactcctccgcagtcttaggtccaacgcagccgacccgtccagcctcaccctcctctgtgtggggcactagagggtttgcgagcagcagtgggagggctccccaaccctcctcggtgcctccagggtctgggctttctggacccaggggcattttgcagtcagcagtgaggatgccaacaaggcctattgggacagggcaccatctcactggagctgtgcttcctctccttcccctctgtgaggagttccgtgggccatggaccagctgctttcaagggacgtgcccgtcaggagggagggtggccagcccccaggcagccctgactgtgtgctcccctccaggctgaaactgccgccaaccggatctgtaaggtgctggctgtcaaccaagagaacgagcacctgatggaggactacgagaagctggccagcgacgtgagtgttcccccagtgaaagtcagggccacctcattatcctcagccagaggtcactgtgactcttgcagggggaaagcaggtgtggcagcgagatgacctagaaaaggctgcgtggtcacagaccatggcatttagccagctggtgtgtacacgacctctccgtttgcttccacaaggctaagggtcagaccggcagccaccttgccagccagcccctgggctcccgagcttgggttcctacagagatgctcagggacagtgtttcctgggcacctcagtgctttagaatcacctggggagctttgtgaaagcccctcttcccgtgccctggccctggagagagtgattcagaaggatggagaggggcctgggaaccaataggatagcaggccctgtgcaggtgcttaacgagcagcccagcaagacgggaactcggattatcctcctttccaagtgaggaaactgaggcccagggagggtcaggcacgtgc

SEQ ID NO: 91674 - DNA, 1915 bp, Homo sapiens
ccagcctgggcagtatactgagacccccttctctataaaaacttaaaataaaaatcagccaggctcggaggtaggcacctgtagtcccaactacttgggagactgaggtggaaggatggcttcagcccgggaggttgctatgatcatgccacttcactccagcctgggtgacaaagcgtgaacctgtctttaaaaagaaaagcacaggcaggaacaggaagtaacaagagaacagtacagtgatgcagggacagggagggagcccacgctcccagagttccaggttgggggttctagcaggaatcgtggagaagttgggctggggagcaggggtaaccccctaaggtggggccctcaaagatccagatcccatgtgcccataagctggggggcagcccgtcagcactctgagggtcccccacaaaggccacgctggcttctgtggcccacagctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggtgagcaccaggattcacatgggagcagctgtgaggggcagaggcagccctagaactgcctgtgggcagtttggccagcgtaatctttcctaagttgttgatgtcctgtgggacatggcatggcctttcggatgcagtggtcggggaggggtgcacttcactcggcattgtgctcccctttggccctcactcactgtattttacacccagggttttatacgcatcccaaatccttgccacgggttgtgtgggtgtggagtggtgtgaatttggagccgtggtctgccatgatggcatgaccgccatgtgcttgaggcccttcatcagcggaggggcagtgcgccctggacggtaccacctccccatctatggtattcatccattcattcatgcactcacccgttcacgcattcattttgttaatccagaattgattgtacctgctgagtgctggggggccctgtgtaggcatccaggtataatagcaaagcatgacacagacatgaccccagccaagttctgccaccttcccatcagcatcccttggagacatccccctgggtgcctccacttccttgtgatagccctgcctgctcctgccctgccccaggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacggtacggcccagctctgccccactctgcccagccccgctcccgtgctcccctcctgtctctcaggcatgcatgggtgtgcacacacagccccctgccacgttgggtctgtttctcaggtgccctttcttgctgcttgggagcatgtgtgtgtgtcagaaatgctgctttagagccaggttcagtggctcacacctgtaatcccagcactttggcaggccaaggcaggaggatcacttgagcccaagagtttgagaccagcctgggcaacatagcgagaccctgcctatacaaaaaaattttagaataataaaattagccaggcatagtggtgcacacctgtggtcccagctactttggaggctgaggtgggaggattgattgagccagggaggtcaaggctgcagtgagccgtgattgtaccactgcactccagcctgggtgacagagcaagaccctgtctcaaaaaaaaaggaa

SEQ ID NO: 91675 - DNA, 1673 bp, Homo sapiens
cctcccacttcttggccatcagtgccagagccgatcctgtggggagtctggtaggtgcctgacagttgagactgggagaggctgaggtgaggctggtactggctccatgcctgctgtgctcgaacaccacctcactgaaacttgagaatagttccatgccacacaggtactggggctggccccattttacagatgaaggcacaggcccagagaggcctcggtggctgcactgggcgggcagctgtcaggtgctgggacagagctgaggggatctccgctaccacttgggggaagcccaaggtggtgtgcctgaggcagggcccctgtaggagctggggtgcagccaccttcccaggctggcattttccctgcggttccctaaagaccttcacttgcttgcagggcttccttgagctttggttctgggatgtgtaattagccaggatcagggactaataacagcgttcctcctttcctttaaagggcctgatggtgggcccgccccaatgcacacaggacaccttaggacagcgtggggcacttagacgtggagaggaccaccacctgtgcgggtgcagggtcagggtcctagaagaagctggctctgatgcttccccttccccaagcctgctgggacatgggctttgaccccgggtgcttctccggatcaaagccctccagaaacaggtgctacctttctaagccgtgctaccacggcccgatttgtatggtttcctactaacaaaagttgctaagtttaggacacacaggttgagatggaatctctctctcaggctgagcaaccctgaagtgtccatccaggtccatccaggttacagttgggcttagagatccctggagggtacggaagaagattctggaagtttccatgccactgtcattggcatggaaggatgtggggtccacagtctctctttccctccctctgcttggacagcccctccagactcctgccccacagctgccgtgctgtggtctaagcgtctctctgctcctaccagggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaagtacgtgcgggctcaggacactatcatcacctggctctcaccacagcctgcccagactggtggcggcagcacgccgaggcccagcctgcctcaaggcctggaatagggtccccagtgccccaactgcacctccttccagaagccagggaagggccttatgggatgaggccttttgcccatcctgtctcagccccaggtgggacacctgaaggatttggattctctagcaggagggaggtgtctggccccttgtcttgattcttcaggctttaggggtccctgggggtgtcacctctcctggccaccccaagtaggccctggtcccctgatgggatgggccccagcctccgttgctcccagccataggtccctgagggaaccaggctgcacagtgagcctattgttctgctcggccccttccctttcttgctcagaatacacttattgtaagagcttccaggcagccgggctccttcccctccccacccagtcagataaac

SEQ ID NO: 91676 - DNA, 1950 bp, Homo sapiens
aggtttgcccagggtcacacagcaagggagtggttgagatgggaatggagcccaggcccccagccctactgtggagcacagcctcagcccctgtccgctgtctgtggctggctcgcctgctccccatgtcctgttcctccccagagtcgttccctgccccctacccctcctcaggccccaaggcctggttgaagggccacactcttagctgatagtggcagaatgagtcagggatgggtgagcaggaggaagccgcttcccttctcacccctggttatcacctgttaaccagctctgttatcaccccttcccttctaccctgggggtcccatgggccagaaccaagctgtgatttgattgaccaattagtgattggttgctgatatcctggaatgttgactgccccaacaccctggcctgggaaccttgggggtagatgggtccaatccatctagccacttgcccttgccgagtctcattgctctctgcccggcccgcagcgagctggattactacgactcccacaatgtcaacacccggtgccagaagatctgtgaccagtgggacgccctcggctctctgacacatagtcgcagggaagccctggaggtgaggagggggtgacatcacccacggagctctgtgcccctgctgccccggggctggtggtgtggatagtgtccagacctgtgagctccccccacctcccacggagaggatgttctctgactcctcagggccctctggacccctccccacccctcctgctcacatactgacctgccttccctctgtccctgcccccttccctcccacacactagaaaacagagaagcagctggaggccatcgaccagctgcacctggaatacgccaagcgcgcggcccccttcaacaactggatggagagcgccatggaggacctccaggacatgttcatcgtccataccatcgaggagattgaggttcgcaccccccggccccccatcttcccaagagcctctgtggggctgggccgccccctcactccagctcctcccctagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgggccggggccatccgtaggggctggggcaggacggcggggctgggggccacctccctgaccgctcccacaccgcgtctcctctgccaggtgcagcagctggtgccaaaacgggaccatgccctcctggaggagcagagcaagcagcagtccaacgagcacctgcgccgccagttcgccagccaggccaatgttgtggggccctggatccagaccaagatggaggtgaggcacggctgagccccacagagctgagaaggttccaagagagctcccgtagtgagggggtccccggccagcccagggcctgcagactgaggcgcctggcagagcaggtcccaattctcaccacccaggggccgtgatcaccctgcggggttaggagagtccacagagcttgcgcctggaatcccggcacctggggaggctgaggcgggcggatcgcttgagcccaggagttcgagaccagcctgggcaacatagtgagaccccaactctacaaaaaatacaaaaattagctgggcatgatggtgcgcagcccaaggaggtcgaggctgccgtgagctacgatcatgccactgcacttcagcctgacagcgagaccctgtggtctctagtgggctacctatgggaggtgggtttgatccctgaatgccctggtctgatgattgtgagactcaggcactattgaacctctgatcctgtcctcccagctctaaaatg

SEQ ID NO: 91677 - DNA, 1009 bp, Homo sapiens
ggagctgcagccaggccagggttcagatcccaactctgcctctaacagcactgagctgtcctccgtgagcctcggtttctacctctgcagtcagggcctgccacagccctggcctcacagagaggtcaagggtaaaatgaagttgggcacagggagcgcttggcagagaaaacctccctgtcattgtcatagctgctttaacatgagagggcaggaccggaggggacagttgtgagcagtgggccttccctcccagggacccatgggccaaggccccaggccaaaggggccccggggaagatgcaggccagcagcgcgagtgggctcctccaggtggtcagtgggggcaggcccaccagcctcaccccaccgcctgcacccacccccgtaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggaggtgcgcggctgccccgcccgctggcctttccaccagcatggccggcttcctcactggaaatggttcgggccagtgagaagatagctgtctgctgtctgttgtttttcactctgtttaaaaattattgaagagaccagcactttgggaggccaagtgggaggatggcttgagcccaggagttcaagaccagcctgggcaacatagcaagaccctgtctctacaaaaaatgaaaatattagccaggcatggtggtgcatgcctatagtcccagctccccaggaggttgaggtgggcagattgcttgagccagggaggcagaggttgaggtgagccgaggtcatgccaccacacttcggtctgggtgacagagccagactctgtctcaaaaaaaaaaaaaaaaaagattgaaaagactagatcaaaatgtttagacatttt

SEQ ID NO: 91678 - DNA, 1735 bp, Homo sapiens
gcgggtgccgggtcagggcagcagctcccactggctaacactccggggacattacaagctggtcgccgtcatattggtagcttgagaaaccaaaagactggacactcttgatccaacccatacaggtccacagatgcttcaaaccagagttggcttttttgtttttttcccctgagagccagtggtgagacactgaccagagtttgtccaaacagtctccacagggatcccggcacaagattcatgggtccttgcccttctgctgcccctgtagctgggaaacacacttactgtggagacagacattggcagaggcagcagggaggcaccatggcccgtgtcccctgtgaggtgtacaggagagcaggggctttccccagggcgggaggacagttcacagtcctccacgtgtgaaccacggtgaggacagttcacagcacccggcccacgatcacgcccccgtctttccgcagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggtgagcagcctgccacctcctcggcctctcccctcccgccgttgccgtaccagcccacaccttcgtctctgcatctgttcgtccattcccatcacagttgctgagcgtcggccgccactcccagggccagcagggccctgccactgtcagggtgtaggtgtgcggcaccaagaccccagcctgggccacttcacacgcacaggcagggggccggaggtcccaagtcctgccttctggggtggcatcctcaccacccccagggcagatgaagtctcagcacacccaggctttgcgacccggtctgtgaacctggacacagacaccccgcacagtgcttttagaattcagatttggtccggcagcctcatcagaggggccctgagcgccagagtttgctgccatccccagcccacccctgccgggctgacggactgagaagtgtgcagcctcagctctgcacctggcgcccccaggacaggatacagtcccctctgtcccactccaaatcccaaaggcaaggagaaccccccccccgaccctccaccagtcctgggacttgtcctcagttctgtagcatccagctgccacccctgctgtgggcagagaggtcggggaggcctctgccttcctttgagcttccgaggttggggaaaggatgaaaggggcccgtgccgcccccgaccccacgtgtccctggccatctccttgtccatgttgcctctaactctgtgtttccctcccctacgtgtcccttccccctgccctctgcatgtgaccccgatccctcatcctggtctccacgccgcccctcccgcacacctgccttcggatggccccggcaggatcatggcggggcgctggggcccgaggagttcaaggcctgcctcatcagcctgggctacgacgtggagaacgaccggcaggtactgcaccctgggccccagcggaccatggcattaactgctctctctctctctctccttctctctttctcccctcgccatcccacccctgccatcctgtgtgccatctcatggctctcttgcctccctgcccacatctccctggaccccttcccttttacctggtctcttggggccgctgtctccctgctc

SEQ ID NO: 91679 - DNA, 2200 bp, Homo sapiens
agggcagtagaccccagttccctgctgtgggagaccacgagaggggagggtgcagagaggccctgcttcccggcctggggcactgggggcttggaggcctgggtcagctggagcagtggcaggctctgcccggggccaaggctgctggagcaggcggggaacagggcgcacgcacacgtgggttgggccctactctctcggctgtttccctggagaccccaccagtgtgggcctggctgcccctgccccactaaatgtcgggtgtcccccaccccaccctctccttgcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaaggtgagcgagacccctacgaggtgcatgggggctggcgagaggggtccctgcagtgggaggggctgagggggccagtgtgtgggtggggatggctcagagtcccatcctgcctgccccagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggattcctgcagcatcatctttttttatttctcctgtgtctgtcctccaccttctaggagagccagggcagagctagcactgtcttaagctgtcaacgtggactagctcgtgtcatctgctcgagaagggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccactaaggaagagaaggaagacagtggct

SEQ ID NO: 91680 - DNA, 1147 bp, Homo sapiens
gttggatgaaaggatggttgaacaatcagctcaatggatggattgatgaggtctagatggttggatgtttgattgatggatggttggatggacttttggttggatacatggagagattgatggatgttgggatacacgagtggagagatggatgcatggatggatggaacgacaggctgtatagtggttaagtgtgcagatccttgggagccagatcagctggatttgaatcctccttctgccatttatgcaatgtataatttgggcaatttgttttattttcctttgtttcctcatctgttacagagggatgataataattgtttctacctcttggggttgctgtgagaagtgaatgagccctaaatcagtgcttggggcataaccagatttatgatgacaggaggatggatggtcagatgactggatggatgaaggatagatgaagtgcatgactgaaccaaggaagggaagagtagccggggagcagatggagacacacactcatgagacaccctcagacattttattaggggcttagaaaggagtcctaggggataattctgttttcccatgagttatggccccaggaatagattagatctggacataggacaaggtgacatcaccctggatttccaatgtgtccaccctctggaaggccgagaggcgatgggcaaagtcaaagaggtgctggccattggcgtaaaccttgaagcgatccaagccacagcgaatggacagctgcagggagaagggtgggcatgaggccagggccaggactgaggccctggaaggaagtgggaaaagagagctcagactcacatcaaagaactgtccgggaccaaatgggttgtgggtgatcttcttctcctcggatccccacgagccattcagaaggctgttccggaccacggtaccgttgcccatgcggggattaatgtgcagagctatgtcccctgaggagcccaccttgaagttgatagcaaagctggggacagagagggatgggggagtcagatggagtccagtgggaagaggccagtgggctggacctctgaatccctaaaggaggaggggacagagggtctagattgttgggtctgagggaggagggggctgggggttcccacctagtttacgttat

SEQ ID NO: 91681 - DNA, 1265 bp, Homo sapiens
gtgattgctgccgtccatgggggctgcattggcggaggtgagtctgcggctatcctcctgctcgggtgctccccaggtggggctgctgctccgatgccgcggccactggcatccagcctcagctctgtcatgggccagactgtgtcccaagaggcagccccacctcccgggagccagggttggttctggtggtcattcagcatccctggcctctacctcctaggtgtggaccttgtcaccgcctgtgacatccggtactgtgcccaggatgctttcttccaggtgaaggtgagtcatcctcccgagctcctgcttagagctgggcagtggggtgaggttggggggcctggagtgagcctcgagggcttcatggaagagtcggagttgaacccgacaaagtaagacttgcccatagaggaagtcaagaggtgaagttgtgagtgggtaaggtatgaggtggggttgaggctggcaggtgtcagaggcagagattgctcctggggccatactggtgagggtgggaggcaggatggagccgggggatgcagtaaaggggtctcaggtagggtgaggagggttcctctctcacagatggagctgccctgagggaatgggagggtgcatgagtgggaaggtgggctctattctaggttgaaggaacttgcctgagtcaagaagctgcctgggcaatggaatgggactttggaggaagtcactggggtgaaggtggggcgggactctccagtagacatgaaatttcatggacgttgacattgcgaggggcacagtattgggcagaaaccaaacactgacccgattcctcccccaggaggtggacgtgggtttggctgccgatgtaggaacactgcagcgcctgcccaaggtcatcgggaaccagaggtgggtgcagggggtgtgggggtgtgggcaggagaccccagagcatctcccagccccggggtggcagccgcctcctgatgcacgcttgcctttgcagcctggtcaacgagctggccttcaccgcccgcaagatgatggctgacgaggccctgggcagtgggctggtcaggtagggccatggccgtggtagctcagtgctgggggcagccaggcctggagggttggaggcctctccgggtccccttgtctcctcgctctagaattcctagtggcatcctttcttggtgagctcatttctttattgtggggtcagccccctgctctgattgggctgtttctctggggtcttgggccttcctctgtga

SEQ ID NO: 91682 - DNA, 3617 bp, Homo sapiens
agatggacaggggaagtggaggacggggcttaaataacgcgcccaggttcacatagcctttatgtgaagcaggactcagagccagactgcctggctccagagccggcactgctctgttgtaacccagctgaaggagtattttaccttgtgactgtagacacagccatccatagatcacacacgtctgtgtgtaacagacaaaatggtgaaaatggctgatttgatttctgattcctgtacagttttctgtcatgcttcactaaatgatttactggtgggttatgtcccacagttaaaaacatggcccaggctctgcttctcactatgggttgagcacttggtgtgggccaggcatgtttttctagtggtcccgattaactgtgaggacatgggaggccagagcaggggttattatcactaacttgggaggggcaggagaggggaccctggcagctggacagaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctggtaggtgctcaggctcgggagggcagcagaggtacaggggagagaaaaggaggggaatggggcccagcagaggagcacagtgaggccgaggtgttgactcacacagaaatgggatgtggcaggtgtgttcccagacgtgtctctgacaccacaggagaaagtgagtcagccttgcctcaggtgtagagcaatgccccaaggcacacagggcaagctaagcctctggaggccacaggggaaagcttcagggacaactttgggtatgacaaaggctcccctttcttccttgctgcagtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgaggtgtgtgccgtggagctgcgcaggcagtcgggtccttgccacggccgtctgagtaggccattcatttcagtcttttctgcaaatagctgttgaactcctgtcctgcctggccctgggttgagtgctagggacacagcagaggccaggacagataggaatctgtgctctcaaactggacagggtgagaatggcaccaagtttctagcaacaccatttgccgcgttccttccttttacatttttggcaagcagggcaactgctcgtttgctgggaaagctgcttcacaggcccagtgatgagggcccaatttcacaagaaccgcattggcgtaggcttcgggtgccatcaccctgataccatcagaaggtggggccctgtaaagctcagtcagggggaactgaggcagcggaagggaggaggaactcaagtggatctggctgtggtctgaaatgttgaccttgcattcagcaaacagtgttcagcaaacagccgggtgcagatatccacatagctgttgaagttgggaacgaaaaagcagcttcccagtctcaggcaacttaataattaaagagcattgttgctggcctttttatgacacagggatgccttagggtatgtgataaaatctacaagccttttctcctgaaaacttcaagtactgagtcatgcagggcctggtctgcttgaatcctgtgtggcggcccttttgtttcagagttcatttactacctgttttcttttgcagatctgcgatgagctgggagtgaagcggccatcttctgtgaaagtattctcaggcaaaagtgagtcgagtgtgcccacctccttgccctaattgcatggtggttggtgggcagctgcctagttcctattgggtgagtctaaaacctttacttttccccttggtttgcaatcaggtgagcgcagctcctctggactgctggagtgggaatccaagagcgatgccctggagactctgggcttcctgaaccattaccagatgaaaaacccaagtgagtatctgtgtgtcctgcaggcatcaacctggtgacctaatgggttggctggcttcaggccagggatgtccttcctgcccttgagataggaccccgggatcttcgcactgttggtgacacaggcaggtgggacctgctcatcaggagagcagcctgtgctcctcttgggagagccagcctgactgcctgctgccactcactctgccagcttgggagttgctcaggcttgtcctccagggaggtggcattctcttctttgcatcagagactggcttaggtaggaaagccactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctgggattccaggatgtctgcttttctccctctctgtcctgaagacacaggcaggcctgagcacagtcacaggccctctggaggcatacagagacccaagaggagcagggtgggctgcagactgagaatggtgctagcaattgagtctttgaggaaaatccatcaggcttagtggcattcttactgggccctgcccgagcaagctctatcaggcccagtgggtcatcacacctataattccagcaatctggggaggccaaggtggggcacatactttgagctcaggagttgaagaccagcctgggcagcatggtgaaacgtcactacaaaaaggtgggtttggtggaacacctgtagtcccagctactcgggaggctgaggcaggtgggtcagttgagcctaggaggttaacagtgcagtgatcacatcactgcactccaacctgggtgacaatgagaccctatctcaaaaaaaaaaaggtttccagccttgcca

SEQ ID NO: 91683 - DNA, 5312 bp, Homo sapiens
gccaacgtggtgaaaccctgtcgctaataatacaaaaaatagccaggcatggtggtgaacgcctgtaatcccagctactctggaggctgaggcaggagaatcgcttgagcctgggaggcggagattgcagtgagccgagactgtgccactgtattccatcctgggcaacacagcgagactccatatccaaaaaaaaaaaaaaaaggtggggcatgtgtgaaggttgctgaggaggtgatgtcctatgagcaaataggagcttatactcaaggtggaggaaacagcctctgcaaaggttgtaaagtcagaaggagcttgtgttggatggagaaattgaaagacctgaggattgcaaagtggctggcaagcagacgggtttggaatagacattggaagaagcttttagggcatcctagacagcgttgcgatgcttggggcaggggcaggaaaaagccactgatggactttcagggcagagctgtaatcgagttgatgtttcagatttagtcgaagggtgtgagagggctgagacggagaaagtggtgtggcagaagaggttgctggtggccatgggtcggggtgcagattatgagagaactctggccagtgactgctcacccggggcagcgttgagtccatcaacaccgttttggtctcttaacctgaggctagtggctgggcagtgagctaatcccaaagcttccgtctgtaccacagtcttggggtgctaccttgtccttatcacactctggggtaacttgaagcccttctcaaagatctcctgtgatgggactttccttaacttgactcacatttgactcagttcaaagtgcccagcgggccaaggcctctctcaatggggctgatatctattctggctgttgcactctgaagatcgaatacgcaaaggtacatctgggaggtgactgactgccccttgtcagcttccaggtgagctggggcatggctgacctcaagtcttgtcttgtcctgtccttgcagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagccccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagaaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgtacatgattgcttatttgaactgattctgctgttgccctgcttgtcagctacagtcagtccctcttgggctggcgggactgggagggaggggggactgggattaagaaagaagggatctaacagagacagtctggagctcctagaactttgggggctttgggggtcaaacttgcttgcttccctctggggttattttcctcttaatctactctcccttcattgggagtcactttagaaagctgcttttggcccgccataatatatcagcttctgtagcagctgcacattccccagagggcctgggagctgggctttctcccagggccagggtaggtgagagcacagaatctggccttgtccttcacagaacaaggccagccctttggtatgagcaggggaaggagagtgggcaccagctttgaggctcgggcttcatgcccgccgtaggtcagatcacaaaaggaggccccacagccctcgaggaagggagggcttgcagttggcaggagctgggggctcagatcagcctgtgcagtcaggagggagggagagaccccaatttctgagtgagactcctaactgttttctctctccacaggtgaccctggcagcaaccccaacaaacgccagaggcagccccctctcctgggagatcaccccgcagaatatggtgagggcagggggttcccctccgtggactcccgtggctcatgtgcccctgcccgccgcccgccgtgcaaattctcacccgtcctccctctctttccttcccaccccccaggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgagctgctgccgggccccctgggttcctcgctgagcctcgtatcttgccagtcagcacgggaaagaaccaggggggagcctggtgtggcgctgggcgggcagacgccaatgagtgactcagtgagctcaggcagcctgcttgcagacgggttttgtttggtcctcactgtatgtgggtgttgtgtttttgaattaccaatgtttaaaaaaaagattttatcacataaaagtactaataccagtacatgaacatagagatttataaaacataaaaatgaatccattatagtgaaacaccatcgtttaaggatttcctcctgaaaacttaagacctggcaacaccgggccttctgccttcccatgggacagttgactggggctagcggtggctgagtgtctacctgagaccaggcggcattttgcttaacattaaacccgtctgggtcttgggggcctttgtgcagctcatgacttggcccattacttaga

SEQ ID NO: 91684 - DNA, 3599 bp, Homo sapiens
cagtcgttgcttttggagtggggcccagtccccactctttccaaaatcttgaagtcttacagggccgcctatttgcagggttttccagggtttaggggttacgagttgctagcgttttaatcttggccttgtcccacacattttaaagacatcttaattgaaaatccttaacgcttcctgaggttgggggagatactgggattcccgatttacaaaggaggaaatgggccaggagagagatgagatgaggtgaattactgtaggtggcacagctagtgaggggcagggctggagttagaactcccatttgtgggagctgctaacctggcgggagtgcctcaccctgtggttcgcgtggatcgctcctgaaatagaatccaattctacccaccttccacgcacttctgcccagtgattctcagacagggggccggccccagagcccaggagaggcggaagagagttaatctttctcctgatgaccagaggcttttgtcggtgggtgtaagatacttctcttaggaaggagcagtcggttcttaatggtatgggttggagtctctggtctttctaaaagactttccatccgggagtgggggctcatgcctataatcccagcactttgggaggctgaggcaggcagattacctgaggtcaggagttcgagaacagcctggtcaacatggcaaaactccgtctctactaaaaatacaaaaaaattagccaggtgtggtggcgagggcctgtaattccagctactcgggaggctgaggcaggagaatcgcttgaacctgggaggcggaggttgcagtggactaagatcacgccatagcactccagcctgggtgacagagtgagactccatctcaaaaaataaataaaagacttttcttgtctggtttttcttagtctgacctaggcagtaatttccaaagcagattttggtgggagggcgattcaagactagaaggggtcaagactggcctggctgccccagtttctggggcatgtgttgttttttgccctgactgaacctgggtgtgagtggtggggaacaggtgtgcttagctagatgatggtggctcagccagttaaagggcaaggaatttggggcacatgcaaaggggatgtcctcattcaaactgtagcagatagctgttagagcccttgctgccagtgtatctccttttccagctactcttttcccatgtttccttggtcgagtggaccagtgggaagagaggggggtccctggaagaacgtaagatttgggacttgtgtggccctccctccgttataccttcctcagaagctacagcaagagccagtgggcaagtgatcacccactcaggaccactgttctgctgacccagaatccttctgggctgattggcttcaattgctgcccctagtctttcctgtgcatccttcacggatgacctccaactgttttatctgactgggtctacaacagtacagaggccagtggggcgtcatcttgtacagcaagaaaataattcttgtttttgcttcctttctcaggagaactacgatgacccgcacaaaacccctgcctccccagttgtccacatcaggggcctgattgacggtgtggtggaagcagaccttgtggaggccttgcaggagtttggacccatcaggtactgggctcagaggccaggtgttgggcttccaaagttgactcctgggtgtccttgtgtgtccacgatttctggttggaaatagtgattttgttgccatcctggtctagattctgtggccgctctgcttttgggttggccattgtactttgtgtcagattacagcaagttccatgaccctttttccttccttcgtttttcctctgccttgtagtttctagtcagtgttctctttttcagacagagcaaggtctcgctttgtggcccaggctggagtgtagtggtgcagtctcacccaggctcaggcagtccttctgcctcggcctgctgagtagctgggactataggcatgcgccaccatgcccggctaatttttacatatatatattttttgtttgtttgtttgttttgagacagtctcttgctctgtcgcccaggctggagtgcagtgacaatctcagctcactgcaagctttgtctcgtgggttcacgccattctcctgcctcagcctcccgagtagctgggaccacaggcgctggccaccccacccggctaattttttgtatttttagtagagatggggtttcgctgtgttagccaggatggtctcaatctcctgacctcgtgatctgcccgcctcggcctcccaaagtgctaggattacaggcgtgagccactgcgcccggcctaatttttatattgttctgtagaggtgaggttttgccatgttggccaggctggtctcaaactcctaggcccaagcagtctgcccacctagccctcccaagttttagggttacaggcatgagctactactgctcctggccagtgttctttcattcagcaagtagttactgaatatttggtgcatgctatatactgcaaatacagtagtgagctgtatctggatgcttctcttagaaagttgccctcctagagtgatttgcactgtcatagtgtaagctcaagaagccgtctgtgggtggcatctgacagtctggtgaggagaggtcaggaaggcttcccagagggacatgatggctcagctagacctctttggcttttggtactacttgtggcacagggtgttcaggtcggggaaccatgatagggttgcagaggagttcagaggccatggaggagtcagttctcaaaaaatcaaatgataccctcctcctgtctacattttcctgagaggattgaaacctgtgttctctctgccagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcaggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatcttaggggagagagcagtgtgttgggagatacaaaggaatttatttttctttttgttttctttctgttatttacttattta

SEQ ID NO: 91685 - DNA, 1152 bp, Homo sapiens
gcttccttgtctccttgcgaagtggcgcgggaaggtcgtcattgtgactggtgctgacggattagcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggtgaggccagggccctaggcgctgggaaggccgggaactgggggacaatttcccagcttgagggcattttattttttgaggggggcctctgcgcacgcgcccaggccatcgcgtcgttgacggtgtgggggaggggcggccgttgggcaaacggcggggtttgcgcgaggacaggcgcctgcgcgtgcgcggggtccggagcggggtgtgggggagcgcagaggaagtagctcgtgaggcgaatggcccagtgcgcaggcgccgcgggctggcgtgtgggggccgggcacgcggcccggccggtttttttcccctttatcattttcttcgctggctccatgcgcaggcgcagtgttcccgcccggcctcgtgggcggttaggggagcgcctggtgagcgggaacgggtgggcggcggccttgttctctagagtggggaattccgtctgat

SEQ ID NO: 91686 - DNA, 1440 bp, Homo sapiens
ggctgctcagagacatgatccaggttagctgggcggggccctgggcctctgaaggggagggagctgctgcccctgttctaggcgaccgaatgccctcctcacttccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggtaatgggaggactggaagggagcccccacgggttcaagtgtgcaacttcgtcctctccatcggtgcgcacacgtttccttctgcacccacacgcccttcctacacatcccacgcgttctatcgcccacgtatgcgcgcaagttcacacccaggctaactcttccacacatgttcacaaccatgtctacactcacgggggaccagagctaggcaggggtggctgtgggccagggtgggttgttggagcgcgtgggtgggcgtgggacaacttggcggtcctgtgctcacccgtcccccacaccccgcaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagccccgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaaggtaagggaggggtcaacgtctagcgtggtggggagagccttgagagttggagccaggcgggagagggtagcactggtgggaggaatctatgcggtcctgaagattctggtaggaggcgctgtcatgcccgacaaggtggaggggcagccagccctcgtggtcctggggatcggatggaaggtgtctacgcgccttgagatggggatccatctcaagacctttcctctggttttcccagatcccctgggggccgacgccttcctgccggcgctgaccgaggaa

SEQ ID NO: 91687 - DNA, 1043 bp, Homo sapiens
aaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatccggtctggcctcctgtttctttctgtgggcacccagggaaatctctgaagggagggggttagatcttgggccactaaggaaccagaaagtctccgggatccagagtgaggggtaacaagagggtcctcacgggggccctcgtggctctgacccctggactcccagcctgccagtgtcccttcctctaagccccgtcactaaaggcctgaggccccagaaagagggaggaaagttgacttcagataccccagccccgcctcttccccctgcctgctcagcttcctctctccacttcctgctactgcaggcctctcctccgagaacaggtagggcccccaggaaccgagcatctggcatcttcagcccctgctgcctccctttggtatgaggcagctgccctgacc

SEQ ID NO: 91688 - DNA, 1039 bp, Homo sapiens
tgcctttttagtggagagggggttttgccatgttggccaggctggtctcaaactcctggcctcaagtgatccgcccacctcagcctcccaaagtgctgggattacatgggtgagccactgcgccagcccctgcctcagtttcgtctgaggaggaaggggctctgcagcaccccttcttcagggctgagcttggggtctggtaggggtcccagctctgctcactcatcctctcccctgaacagggcttcacccccatgacggtgccagaccttctccgcggagcagtgtttgtgagtgaggcctctccgcttccctcgcccacctgggtgtcaggccctgccgtgggtgcccgaggcagggaaacctgaggagaccgccctggggctgggttgagggggccaggccataccagggaggccagggcagctccagatgttttcaggggaggagctggggttgggactgtaaaacgagaggccagggttacctgtcccctgatccctgtggcctggcctcctcccccaggaaggctgtgggatgacaccaaatgccaacccatcccaaatttacaacatcgaccctgcccgcttcaaagatctcaacctggctggaacagcggaggtggggcttgcaggtgaggacctgtgtgggtggtggggaggagcaggagtgatgtggaaggacaactgggagcgtccagggagcactgggggggatcacctgccccgagcagctcagcagccccagggccaacatgtacggctgtgtaggttgtttactgtacagcagtacagtgataatccagccccgggccttgacctggggttgcatccaccagagggagtgcctcttaatcttccaaaggcttcctctgggcactggcagccctggctcaccctgtggtctctcctcccaggctacttcatggaccacaccgtggccttcagggacctgccagtcaggtgacacctggtttccttagaccttgaccccacctgtgacaatcagtcttccctccttgacccgactttccctgctc

SEQ ID NO: 91689 - DNA, 1048 bp, Homo sapiens
caacttttttaaattggaaaaaaaaaaaaagccaaagtcctcctgtggcccacaaggccatgatctgcccatgacctccctgacccctctcttacctctcccctcactcagctccaggcattctcccacctcagggcctttgcgcgggccgttcctgctgcctgggacaccctccagagcccctcccggctccctctcctccttcaggtgtcacctctgtggggcctttgctaactcactctactcacattcctgccaccttcctggcagaatgcccctggcccctcacccccacctatctccagtgtctgggccccctgctagaatggcactgacaccagggcggggtccttttccggttttattcactgctccgtccccagcaaactagcgcaggactggcacctcctcagtcctttgggcctatctgttgaagtggaggaagagaaggggcccgcaggccctcaccctctcactccccttccccctgcaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggtt

SEQ ID NO: 91690 - DNA, 1040 bp, Homo sapiens
cactccagcctgggcagcaagattgaaactccatctcaaaaaaaaattaaaaaattaaattagccaggcgtggtggcatgcacctgtggtcctagctactctggaggctgatgtgggaggatcgcttgagcccaggagtttgaggctgcagtgagctatgatggagccactgcactccagcctgggcgacagagtgagaccctgtctctcacacacacaatgaagagcaggactgaaggagaaagagcaagtaagggtggctgaagagaagctgagtggatgggcaccgctgagagtcacagttgtggggtaggaccaggaatacagaataatgggaggaggagtcggtaggagaaaccagggaggattggagcacaagagggagaggctggtggacagcacaagctggctggttgcggggtctcttctgggcaggctggcaggtgaaccatatgttcaactcttgttttcccacagagggcttcagaggctgggaggtggagcatggcgggaacggctgggccatagaaaagaacctaacaccggtgcctggggctccttcgcagacctgcttcgtgacctctttcgagtgagtggcccaagtgagaggccccgatccctggggcaaaggccccaaagaaagggaccctaccccccacactgtcctcatcgtcaccttcaccctctccttcccccatttatttattcattgattcattccatcaatcaacaaatacttgttgagggtactgtttcatatgccagggatacaaggaaagatcaggaaggttagcaaccacaggcagcaatgctctgtgcatcatcgcctgcagtttgtgagacaacagcaagacagctttgatctaaagacagggttttgggccgggcacggtggctctcgcctgtaatcccagcactttgagagcccgaggtgggcagatcactttaggtcaggagtgcgagaccagcctggccaacagggggaaaccccgtctctactaaaaagacaaaaattagctggacgtggaggctgaggcagg

SEQ ID NO: 91691 - DNA, 1049 bp, Homo sapiens
ctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcgtgggtgacgggggcggggcccaggaggctgaggggggccgcgcgagcgaggcgggggcggggccgggacagagtctgagagatgtagccaatgggcgagaccgctggaggagccagggggcggggctgagggacgcagtgcctgggcggtaggcccggtgggcggggctggagaaggtgaagccgggaatccgaacgagtgggcggggcaaggcaggaagaccctggctgggccgggggagaaagcaagtagtttggtatgcagaggggatgcagaacaggacaggggccaggcgcggtgggaatggcaacgctttgggaggccaaggcaggaggatcgcttaagcccaaggagttcaaggctgcagtgagctatgatcgtgccattgcactacagcctgcgtgacagagaccttgtctcaaaaaaaaaaaaaaatggtggggtgcagtagctcacgcctgtaatcccagcattttgggagtctatggtgggaggatcgcttgaggccaggagtttgagaccagcctgaacaacaaagtgagactctgtctctaaaaaatttaaaaattagtccaggcgcagtggctcacgcctgtaatcccagcactttgggaggcccgagggggcagatcacttgaggtcaggagttcaagaccagcctgaccaacatggtgaaaccccatctctactaaaatacaaaattagccaggtgtggtggtgcacgcc

SEQ ID NO: 91692 - DNA, 1051 bp, Homo sapiens
tccccaacgaacatccggggctttcccccctcaccgcccaccagtccccatagcaacgaggctgaccgggcagtgggcagggccagtgcgggggcggagtcgggcgcctctcagggcccgctccagcctccgattggtacagagcgtccaatcggagaccttcgggcagaaaatgccaagcggggattggaaattttggaaaaggtgcgggaaggctggctcccggcccactgaggtccttaaaggggaaatgactgttttcgtgtgataccgattttctaacttcccccccagaaggagttaggggctgggagaaagtaatgagttaatgggcagaaacagttcttaagcacttactaggaggcaggcaccgggataagtgttttacttgcattttctcgctgcatatacaaccctgtggtataatatcattaatacccattttacagataaagaaacagaggttcagagggtgaaatagctggcttagcatcatagaaagaaggtaatgagttttgaacgctggtctgtctgagcccgggaacctgagactgtttgctcttcaatttttaaataagtttttacgaagtaattggtcaaaatattgaaaacaaacagcagacatcttctttaaaaatttttttaaattttatttttacttatttatttgtcttgagatagagtttcgctcttgttgcccaggctggagtgcaatggcgcgatctcagctcactgcaacctccgcctcccgggttcaagagattctcctgcctcagcctcctgagtagctggaattacaggcgtccaccaccacacccagctaattttttgtatttttagtagagacagcgtttcaccatgttggccaggtcgaactcctgacctcaggtgatctatccgcctcggcctcccagagtgctgggattacacgtgtgagccaccaagctggcctttttcttttatttttaaagagagagttttgttgtgttggccaggctggtctcgaactcctgggctcaaactatactcctgcctcggcctcccaaagtgc

SEQ ID NO: 91693 - DNA, 1005 bp, Homo sapiens
gggcatccagcccattcttgactttttgtaattccctttaaatattagacaagcatgttgtcagtgtatgtacgtgtgctcgtgcgcacacacctgacactgagtctcccaatccatgaacgtggtatgtctctccatttgtttatgtcttctcgttcatacttttccagccgacgccttgcccacctcttgtggggtttttcccagggtagttcatgatgtggcagggagtctgtgccctccactcccacaagatgccgtgcaccctgggtttagccttgctggctgaggacctcatggcggtggcaggaggccacttctcccattctctgcttcttccctggtaccgcccctggaccctggcggagggcgggcagggtgcccagaaaggaggctgtaattttcctgaatgatttcaagggctaattaaaggtttgccttgactaatcagcttacggtttaattattagggaacaggctctgggatgcgggaagcagctcagctggggtctccccacagcgtggcaggaaggagccaggacccagccctactctggggggctggcaggatatggggataccccagcaccctccagtgggtcagtggggggttctccatcccccactgagctgtgacaggtggagggcagcaggtgtgatggagattacagccgattcctcccctgattcacatcatcccccacagcccatggctggctggggaggggctggccctgtccctccagcagctttggcagggcccgtccctccccactttcctgcagcaccccagcctcgctggcctttgtggagtgctcggacttcatttattctgtgggtcttggcttaaaggtcagcacctctgggaagcctcctcgggcctccctcctgtcagagctggtgatcagccgcacggccccttgccagttcttgggatcatggttgttcatctgctgcaactcctgcagacactgagaagtacactgagggggatgcctgagctgg

SEQ ID NO: 91694 - DNA, 1063 bp, Homo sapiens
cacgagcagaagttcacggggctgccccgccagtggcagagcctgatcgaggagtcggctcgccggcccaagcccctcgtcgaccccgcctgcatcacctccatccagcccggggcccccaaggtatgtggcacccaccaccacctcccccagcccaccccaacccccgagtggccctggccctcaaccccacactcgaccctgtgaccgacacctcctcactgacatggaaatggagacaaaccccagccttccacccctatcctgggtccagtgctggcctttcaccctccacccactggctccaagtcctaagaacccatgccaccccaacctgagcctcccccacggcccatctgacagcccccacaccagcctccaagctctgctgtctcccgcagactcatgtcccgggggccatgctgctgtaccccggaccacactcctgtctcacccaaccttgagcctttccagagctcctggcagtggaagacagacccattcccagagggtgacagccccaagtggtcagggcttgggtgggggagcccggaggaggcacctgacacagaccaggggtccaggcaagcttctgggaggaggggacaccgaggcagagcccagggctgaggaggaggaggagaaattccagcagatgctggggaagccgggctttagtggagaaaatcactcctgtgaaacgctgggggctttttggttttgggtttttttttttcttcctgccatctagagcaaaatggcaaggttgggatttgaaccaatgtctgtttccaaggcccgtgctcttaacccctctgctgcctccatgtgaaatcataagagttgtggagccggtgtctgggtgtggcctggcatgaggctggcctggcctgagcccgtgctgggcctctgaagccagccttggagcctggactctctcccatggtcagtggggaccaggaggggccgcaggccaaggggaactcggccaggtttgcatccagcgggtggagatgggtgtgcctggggactcaccctcccggtgcccagcccagcctggcgg

SEQ ID NO: 91695 - DNA, 1092 bp, Homo sapiens
cccggctcctgggacccccttgccctctactttgggaccaggcctttctgactctccctgtcccccactccttgttgttcatgggagcagagagtgtggttttggggctaaggaacactggcgcccacatgggaggaagtgccaggccaggccctggccccagcgccctgtcatttgcagccctcggggctgattatggggtgggtcaatttctgcccttcctcccccaaacccctcagggcaggactattccaccagtgtgaggaacaggagaaaaacaaggggggcctctccagggtcccaccgagcccagggggcagcagcctggccatggcgatcactcctctggcccctgcagctgtgtccccagggaggggaggggctgcactgcccatgccattgtcactccatggcatctcttcattgcgtctctgtcttgtctctgtgtgtgtcgtgctgtcctgtccctgcgtgtcggatgcacgtcctgtgtgccccactccttgctgggcccccacccaccattgcctgggaccccagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccaggtaacccatcccccgccccagggcccccactgtcccctgcccgttgctcctctgtccccaccttccagccccgccccaccaccgtgcatctca

SEQ ID NO: 91696 - DNA, 1050 bp, Homo sapiens
ctcccacctatgggctcctctttttccctgggtgttttgggtaaagtccccaggttggctctgattggctcagcctgggtcctgtgcctgtttctgaaccaatcactgtgtctccactgtggtgatgaggccgcatgggtcctgaacccaccagtggatgctacctgggctgagggagggaggacacctgggggcagttgacagaaagaagaggggtgggtgctgggggggcagctctcttgaggggctccctggaggactagtgctctgtggactgctggctgggtgcccaagagggagttctgggccaaggactccaggagccagaggcagagacagcgctggagcggtccctgcctgaggcctccccaggacccaccatcccccaacagctcagccctgctgtcccttctcccgccccaggtagacatctggtcgctggggataatggtgattgagatggtggacggagagcccccctacttcaacgagccacccctcaaagccatgaagatgattcgggacaacctgccaccccgactgaagaacctgcacaaggtaggcccctccctggctgggaaactgtgcgccagctggcgggtggcagggctccaggtggagcatggggtgtggatgggatggggacaatgatggcgcctgggatggcgcttactgtgtgctgggccccccacccccgggcctcatgtgtctgtgcagaccccctctgtggggcctgggcgacagaggcagcagagccacaggccctctgcaccctcaccattgccctgggccccacccagccctagagagatttgcacgtttagaagtggaggacagggccgggaccttcctagtggaggacttgccaggagggaaaggggcacctctgggccccagttgctttcagcttcttgctaaaccatggaaatagggagtacatgagcccccagggtttgtcacttcctctggggccacatagtaagcgccatcacaggtgccatcactgtccctgtcccgtctacaccccaagatctagacacccatgacctc

SEQ ID NO: 91697 - DNA, 1102 bp, Homo sapiens
attttcctgcctcagcctcccgagtagctaggattacaggtgcctgccaccacgcctggctaatttttgtatttttaatagagacagggttaccatgttggccaggccagtcttgaactcctaacctcaggtgatccacccttcttagccttccaaagtgttgggattacaggcgtgagccactgcagccggccaaagctagatgttttacccaaaggtgctgcatgcagataagggggagcgacctgcatcatggttttccctgaaaggcaggaatatgtataaaagaggaactagaagagcatccattgttccagtaggaatatgacaggcgctgtgagctgaccttagtgtccacctgagtgggggatggggcatgcagaaaaggggaggtggccagtagcgttggcccagttttggggtagaaatgcctagatgaaggaccttgaatggcagttgtcctagcaagagtgagacatagctagggagcatgtcccttgagggcagggcttaaaagccatagcacttctcccctgcaggggccgggatatgcagaggaggtaatacgaatgatagatatattgtcccagtgggtgatgggacacagccaggaggtgggtctgagggcggggcatacagatgaggggtgtgaaagggtgggaatatgttgatggaggcggggcttgaattgctgctgttgtctcagtagcggctgagacttcgatagcagggtttagtccccactgttcaccatgggcggggcataaagcgaaggggcgtggttcggggggactaaccccgccctgaacccgccccctcctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtg

SEQ ID NO: 91698 - DNA, 1731 bp, Homo sapiens
gatctcggctcactgcaacctccacctccctggttcaagcgattctcgtgcttcagcctcccaagtagctgggattacaggcgcccaccaccatgcccagctaatttttgtatttttagtagagacggggtttcaccatgttggccaggctggtcttgaactcctgacctcaggtgatccgcctgcctcggcctcccaaagtgctgggattacaggcgtgagccactgtgcccagcatggaagtgttgtaatctgttgttaatagctgatagtggcttcctctcaccatcctatggaacccagctgtaggcggtaggggagggatccaggcctgactcgtagcaggacatcccatggcggccaagtcccacgcctgggtaaccggctccttccccggcaggtctcacctcccacccctcctgccttcccactgcaccatggctccaggacccttctcctcggccctcctctcgccgccgcccgctgccctgccctttctgctgctgctctgggcgggggcatctcgtggccagccctgccccggccgctgcatctgccagaacgtggcgcccacactgacaatgctgtgcgccaagaccggcttgctctttgtgccgcccgccatcgaccggcgcgtggtggagctgcggctcaccgacaacttcatcgccgccgtgcgccgccgagacttcgccaacatgaccagcctggtgcacctcactctctcccggaacaccatcggccaggtggcagctggcgccttcgccgacctgcgtgccctccgggccctgcacctggacagcaaccgcctggcggaggtgcgcggcgaccagctccgcggcctgggcaacctccgccacctgatccttggaaacaaccagatccgccgggtggagtcggcggcctttgacgccttcctgtccaccgtggaggacctggatctgtcctacaacaacctggaggccctgccgtgggaggcggtgggccagatggtgaacctaaacaccctcacgctggaccacaacctcatcgaccacatcgcggaggggaccttcgtgcagcttcacaagctggtccgtctggacatgacctccaaccgcctgcataaactcccgcccgacgggctcttcctgaggtcgcagggcaccgggcccaagccgcccaccccgctgaccgtcagcttcggcggcaaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccg

SEQ ID NO: 91699 - DNA, 1107 bp, Homo sapiens
cttctcttcacccaaaagatagagatgaaagaagacagatttcctccatttgcattgtatttgccagctgcactttagtgacctacagagtaataataataatgaccactggtttttgaatgctttctaactgccaggcactgtttaagtgctttacatgtattcataggaggtaggagtttacctaccctatgaggtaagtaaactaccattatcctcattttgcatatgatgagattaagaacaggtaggactaatagagggtctgtgggcactgtccattccaagatggtagtgccttgggtcaaaaagtttgatttttagttaagataggtttggctgcaatggggcagtagttgttaggtatgcagaccctgggtctggacaggatttgtatcccacattaccactcaccagttttgtaccctaggacgagttacttccctggtcttttagtttccacagctaaaaatatgaaggaaataatgatactttacttcatagaattgttacgaggattaaataagttaatacatgtaaagtacttagaacaatgtcttgcccataattgcaatgttagaaaaacaataaaataaaaaaaaagctcatatcagccagaactctaaaaacataaagtgatagaaccttagctcaaagtggtttaatgaaaaaagtgggggattaattggcttttgttactggaaagtccagagctaggttggcttcagacctagctgcatccaggtgttcaaataattttctcagtcatctcctcccatttctccactgagttagcttcatcctcaacaagcttctgctttggatgacaaatatggtcctcagcagccccaggttttaaccctacctccttggaaagccttagtggaaagagaactctttcttgagagtcccagtttgaaaatagtttcttccttgaatagatgtgagattatgccagaagatccttagaaacatattttgggttctgtaccctgcaactcagtctctggcttgctgagccaaataggcctgtgattccatccgatgaactttctgagcagtgatggcaatctccctccccactgtcccccagccgcagtcattctc

SEQ ID NO: 91700 - DNA, 1036 bp, Homo sapiens
cccgggctcaagtgattctcccgcctcagtctcccaagtagctggggttacaggtgcacgccaccacgcctggctaatttttttgtaatttttgtagagacggggtttcactgtgttgcccaggctggtctcgagctcctgagctcaagcgatccacccgcccatgcctcccagagtgctgggattacaggcgtgagccactgcacccagccctcttagccattttgttaacctcatttcccacctctggaggtggtaggggcttcccaagaagatcacttggacctcttcaagtatggtggcaatattgctgggctgttggagagacttctgttatagaggctcccctcttgtgtttttcctcaaaggcaaggagtcatttttggtcacatgaggacaaagagaccagaccagtagtgcattctgttttgcatgggaattgtcaaggctctttcagttttaactgaaacccaactcaaactggcctaagtcaaaaacgaatttattcatctatgtaactgaaaagagtgggccacaagggggaggcttcaggctagctgcatctaggttttaaatcatgtgaacagatctccctttccccctcccccatctcttgactttgctgtcatctgttagtttcattctgaagcaggcttccaccgtgaaatagaagaggtggcaactggtgacatcatgagacgatgtgtaatctgagcaaccctaaccaagaacttattttccttagtagttccagcaaaaatccagagaggactatccttggccaggctttaccccatgtccacttctggagccaagaaagacagttccttctccaaggggaacccagggtgttgatactagaagatggaaatggatacagtaagatgctgccacagtgagatgcctcacccaggtctccctctgtcacttcagccaagcacatgggatagaaagtagcaggcggcctctggccctttaatggaagagggccatccagtcctctccagttaacatctagaccgaacacaaagcatcc

SEQ ID NO: 91701 - DNA, 1018 bp, Homo sapiens
ctatgctgcaaggcctaaacaacagcgattgagaatgtcagggtagggctggaggggcaggctgactcgactactggagaagagaggaaaacacccgtcactgagccacagactgaatgtttactatgagtacactctgtcagatgcttttcatgcatcatctccctacatcttctcagcagctttataatccttactttacagaggaggaagcatactgcccaggccactgtgtgtttttgactggggtgcatatccttgacttatttttatttttttttattttcattcttgactttctgtccctaatgggaatcactgtctttcttctttctcatcaagaactgaaaactacaggactaagttatcaaacagggtaccacagagttcttatcgtttgatccagtgccaggtggagttgggagggcaggaaagacaaaagttctgtgacttcagtgaggccttttctgccttggaaaatgatctttagatgtggagatggcctgaaggacagcttcataatcttggcagtcggttcaagtgaagacagacaagggaatgaggtttcctagctttgagtggcagatgctgaaggggatctggaaatccagggaagaagagagacttgggattggagagataaaaggttgtgggtaaaaagttcccccctggctgggcgcagtggctcacacctggaatcccagcactttgggaggctgaggcaagtggatcacgaggtcaggagatcgagaccatcctggctaacacggtgaaaccccatctctactaaaaatacaaaaaaaaataaattagccgggtgtggtggcgggcgtgtgtagtcccagctactcaggaggctgaggcaggagaatggtgtgaacccaggaggcagagcttgcagtgagccgagatcgtgccaccgcactccagcctgggtgacagagcgagactccgtaaaaaaaaaaaaaaaaaaaagttcctccctgccggacaccatggctcacacctgcaatcccag

SEQ ID NO: 91702 - DNA, 1029 bp, Homo sapiens
taaactcattttccttccacatctgattccgtttccttgccactgccttctgtttgtatttttccctgctcagtgtctaggtctgaatctctgattctatccttgttgggtccttgagactccaacattagactggcttttcgtgagttctgtgggacttcatcttaatgggaaagaggaaatgtgtacctatatgtttgtgggcttgcagtacccttacatgccttctctatgtgctggaacccagggtcctacccagccttctgcaagccctgtctgactctctgtgtagatactctctgtccctcattgtagggtctgcatgtgaccccagcctgtgtcctcccatccaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaaggtgagaccagccacagcctagcaggaaatcctgaggcagaaagccaagtgaacccaagcaccagggatcaaatccaagttcgatggtgggagcagggctttgtaaagcctactggagactggaacactacagagagtagccaagacagggtgacaaggccccttgcccttgggcacgtctgggctgatggtggataacagcccttcccctcaaagcgtctccaggctgagcagaaatggggcagtgggtcagaagaaattccatgtagtaaagggtgagcagttgaggggagtccattgatttctctcagaggggaccaaagtccaggggatgggg

SEQ ID NO: 91703 - DNA, 1050 bp, Homo sapiens
gcacctgggggttgcgggaggtatgtgctgggctgaatgacatcataggggctgggaggggaagtaaagagaagttgactttattaacagcaaaggtttgggggtggggaacaaacaagtgaaaggctcacaaacagaccactagaaaagtgctttgctgctcacaataatggtgtctgaaccagccctgaatgccctgggactcagtcactgtcactatcagcttcactggaatcagaagctgcagcttcactgccatcctcctgggccgagtgctcgctgccactggggaagggactggcgctgcggctgtggctccggctccgctggccacccccattgctgccgctgtctgaatcattgtcactgccaccttgggcctgtcctctgtcctcatcatcagagtcggcatcgtcctcagaatcagcatcactgccaaagatctcctctttgtcacgggcagcccgggcctcatcctcgctgctctcgtcctcaccactgccactcttgtcactggcctcgtccctgtcaccttcctcccgttcactctcgctgcccgagtgctcatcttcactgccctccttctcactgctgctgcccttctcctgctcctcatctggaagggagtggagagagatgaaacccacttttccaccctcccagggctcccagagtctggcctgtccagatttacctgagcccccagcttctttctcttctgtctccatctcctcttcctcttcctcctccggttcgtggttttctagctgggccttccgtgcctcctggaagcagcaagattggaatgaggggaaggagggtgttctgctgggtttttgtccccctcctcacctacaaccaccaccctccctgccatgggtgccctgagccagtggtgcttgttacctgagcttccagttccttctcattcatgtcccgatgtttgaccacaagcagggcgttggtgcctgactgaaccccagccttggcccggcgcttactaaggcggaccctgcagggggtgaatttgggagagagaagtggaagatg

SEQ ID NO: 91704 - DNA, 1835 bp, Homo sapiens
ctaccgcatcgaccccaatggtgtgtggggagacagggagggtctgctctaggtcagcaaaggctcaggcctgggcctccctcatggtcctcctgccccccgctctcctctagttcttctagatccagctgatgagaaacttttggaagaggagattcaggcccccaccagctccaagaggtgagtgggtagcaaatgggtactggagactggctcaggtgggccctacaagcaggagggcagtggggtcctgagatacctgatttcccaccccagatcccagcagcacgcgaaggtggtgccatggatgcgaaagacagagtacatctccactgagttcaaccgttatggcatctccaatgagaagcctgaggtcaagtaagttactaacaggaagagagggaaggtggagatattaggtgtgtccagtggcccctaaggacctttttcttcattcctaggattggggtttctgtgaagcagcagtttaccgaggaagaaatatacaaagacagggatagccagatcacagccattgagaagacttttgaggatgcccagaaatcagtaattgagggactgggatggggagaggcaagggtgcggctgcagagctcctcctcaccttgtttttgttccaccagatctcacagcattacagcaaaccccgagtcacaccggtggaggtcatgcctgtcttcccagactttaaggtcaggcccaaggtgggaggtagaaagggacagcctatttgtgcctgttcccatctaaccccagtgcctccatctccctagatgtggatcaatccatgtgctcaggtgatctttgactcagacccagcccccaaggacacgagtggtgcagctgcgttggagatgatgtctcaggccatgattaggtaggtggtcctgctgtccaccttggcctgctccttgctgcctcttgtcctcacacttcattgctactccttttcccccaaccaggggcatgatggatgaggaagggaaccagtttgtggcctatttcctgcctgtagaagagacgttgaagaaacgaaagcgggaccaggaggaggagatggactatgcaccagatgatgtgtgcgtgggttgcggttaagttttggggattgggaagttttggggattgggatagggaagaaatggggctgaacctgtgccctcatcttcaggtatgactacaaaattgctcgggagtacaactggaacgtgaagaacaaagctagcaagggctatgaggaaaactacttcttcatcttccgagagggtgacggggtttactacaatgagttggaaaccaggtactcagcacactcctatctgattagcctggatctgtgcttcttaagaccctggggcatgcaagagccaccttggaggtcatttgtacctaagaatttgtcatatgcattggtaaacaagagcagcagatgtctggtcatgcacatgagctggacttggttctaacaggaggagccagaaaaaaaatctttttttttgagatggagtctcgctctgttgcccaggccagagtgcagtggtgtgatctcagcccactgcaacctccgcttcctgggttcaagtgattctcctgcctcagcctcctgagtagctggcatcacaggcgtgtgccagcatggccagctaattttttttgtatttttaatagagatggggtttcaccatgctggccaggctggtcttgaactcctgacctcaggtgatctgcctgcctcggcctcccaaagtgctgggattacaggtgtgagccaccacgcccagccagaatatcttaatgcaggagacatttagagc

SEQ ID NO: 91705 - DNA, 1330 bp, Homo sapiens
agaatatcctggtaaagggggctgcactcactgtccattgtcgatgttagtgttctgaatcaagttttgggccgcaaccttcatcaaggtctagtcaaaacaaaaacaaaacacgtgggaaatggaaaaacaaaagggaatacctctggcagatctacactctttcttgagatcactcagtctcaggttttcttttcaactggcaccttccctcctgactttccaaagtaatattcgtttccattcctatagctgtcaccactccatcctcccagaggcccgctctcacctgagcttctcgccaataacctaagggtcctccctcacctatcaatcaagggcagaatctccgtataagccagtactctcctcaggctttaacgaccagagcccagtttctcctttaaacaacccctcactcaagctccggccagtcccagcctcagcatcagcgctgatcccatctctgccgagcttcgcttaggtctcgcagaaaacaacagttttatttatttatttatttatttttttgacggagtctcgctctgttgcccaggctggagtgcaatggcacgatgtcggctcactgcaacctccgcctcctgggttcaagcgattctcctgcctcagcttcccgagtagctgtaattacaggcgcgcgccaccatgcccggctaatttttgtatttttagtagagacgaggtttcaccaggctggtcttgaactcctgacctcaagtgatccgcccgcctcggcctcccaaagtgctgggaacacaggcgtgcaccagccaggccaaaacagcaggttctattcctctttctgcttagcgctctctccgactaacctggccctcggcctgcccctctagactaccaaatccagtttgcttctcgctgcttaaggccaatcacctgtagactctccttcagctgcgggatgagcatcttataacgctgcacaggatcgaagtcctgttgctgttgctgcaggaggccgctctgggcagggcccaccagttgtgctggcggttgcggctgctgctggggacccgggccgccagccgaactaggacccgatacaccagcagctgaggaagccgctgaagcttgctgctgggatgcagccatcttcctcgcgtagaccgccggaagtgcgttacgactgcgtctctccccgttgcttttcagcatccctatttctagtccccgtttgctagttagtcccgccccctaggcaattaagccaatggaggggaaggaggtgccccaacgttacgtcactctcaaatctgcgtccagactgagatatctctccaccaatcacaga

SEQ ID NO: 91706 - DNA, 1035 bp, Homo sapiens
atgattcaccccggctggggccttttcacttctcctttggggctaaaaatactgggacccaggcatccagctgggccagccttgccacaaattgcacaacgcccctcactcaagttccgctgacgcaggcttgggtgggggcctgagttgctccctgctcagacctgtggagctcagagcctgggcccctccactgctcctctcctaggccaaggaccctggggtctgggctgacatgcgagccgctgggggactctgggcttggctgtggcccctggaaatgaagtcccttcccttagccccagataacccaggggtgctggccccctgcatagacacagagtcccagttaggagctggggatagaagacagctaaaggggactaagagagagaggtcagagtgagagaaataggaccatggggagaaacacattaacaggaacagagaaacaagggaaaaagagacaggatgagagagacacaactgtaatagagacacagaggagtggcacacagagaccacctcccagctggagacagtcaggaaggactgagggagaggggacagccagggctccacacccaggcaagaatgggggagggcctgtggaacagagaagtcatcaacacacacagttcaaagtctaccctaggctaggagggggagcaggaagaaggggcagggacgcaggggcccggcctgcgagctccctgttggcctctgctgccccctgctggctcccgctgcggtgctcaggcaggaagagaggaggctgctgtgtttaggcccaggacgctcttcattccctttgcacaccacccaccaaccactgcctgccccactccctgtcccccacttcacagagtgcccccagggccagcaggtggtgcgggtgtcttgcccgtgaccttgttggcacagtccagcagggcggtgtgaatgtccttggcacaggaaatctgggctttgatgaccgccaggtactgtgggtaggggaggctgtcaggctgcactgcgtcgggcttggtggct

SEQ ID NO: 91707 - DNA, 2101 bp, Homo sapiens
gagtgcgcgggcgagctggggatcgtgtacccgcggcacgtgtgctcgcgccgtgtgtgcgcctggcgcgattgcctgggcctgagcgggcgtggccaagggcggcgctggccgtgtgtaccctggcctgcgactgcgtgggcggcgggcctgggctagccgtcatgtgtacccggttgtgtgaacagtatgtgtgcttgcgggtgcaaaggtgtgcgccttggcatctggggctgcgagagcctgtgtgcctgggtatgcagtgggggaacgtgagggacacgagtgtgcccagtttcctgtgagaaggctgtgtgcatacaatcccgcatgacttggctgtgtgaatcaatgtgtgaaaccgcctgtgtgatcgactgtaccgtgtgtactttggccatctctgggtgtggggtggatgctctgttgtaactgtactgcaatttgtctctgaggcggcattcttaagaacatgagattttcatccccacctgcatatctgtgcgtagctctgagccactgtgggatctgcagtgactaagtgtgtgtaactccgcgcaggtgcctgggtgagggaatgactgccctcccctgtgactgaggctgtgtgcacacacaactttgtgtgtgtgtgttgctttgagacagggtctcgctctgttgcccaggctggagtgcagcctcgacctcccaggctgaatcgatccttccacttcagcctcccaggtagttgggactaaaggcacgtgccaccacacccggcacacacatttgaagctgtgtcagcatctgtgactctgcagctgtggccgtgtgcaaggcctttgtggctcagtgtgtgtagtccctgggtgtgtgaagtgttcacatatgtccacgtcctttgtcgtgggtgtctgagactgcatgtgcagaccacagcaggccggcgtctgaatgcagttcctgtggcccgagtcacaaggcagagaaaccgatgaactttggtttctgacgtctacagcctgcgtgatggggagagtagctggcgagctcccccctccatgtcactgttcttgtgtcggcctctgtgggcagagcagacgtgcagacatgagtacctgagaagctggggcagcgccgatgaggctgcttctgatagtgctgggctaaggacagggctgagtcagcctgtgatgggcaaagtctgcgatggggtgagagatagcttatctggtaaagtggtggttagagggttgtttgtgtattcatgtggctgggttgctccctgaaagtatgtttgtgggactgtcaatgggatggggtccctgggggcaccatgattgtaggatggtgggttagctctgcagtggggcagacatgctgtgtgctggagtccccacggtctgttttgtggtggctgtgcacctcacgtacaccccgtccctggagcatgcagtgtgcaccagactgtgtagtctccctctgggtttagttacctagcaaacccaagtcctcaccaaggccctctgtgacctgtctggatttcctctcctatccctgctccctcattgtgcccaagcctcctttttatgtgttccataaatcccagcacattcctgtcccaggtccctggcacttgcagttccctctgtctggagcactcttgcctggatgtgtggatgtccccaagctcattccctctccttcggggctgctctaatatcgccttctcagtgaggccttccttgacctctgtcaaggattaaaacaaaaattaaaaggcccactgcagtggctcgtgcctgtgcctgtaatcccagcactttgggagaccgaggcgggcagatcacttgaggtcagaagctcaagaccagcctggccaacatggtgaaaccccgtctctactaaaaatacaaaaattagccaggtgtggtgatgcacgcctgtaatcccagctagttgggaggctgaggcagcagaatcacgtgaacccaggaggcggaggttgcagtgagccgagatggcgtcactgcactccagcctgggcgacagagtgagactggtctcaaacatatataaacaagaataagaaaacccttgtcatctatttaataataaa

SEQ ID NO: 91708 - DNA, 1008 bp, Homo sapiens
aaagggcccattgatttatgggtggggtttggcaacggctttggctacttgcttttggagggtaatttgagcaccaggattccccctcaggagaggttccagttaccaggagacactggaacctcaggtctataaaaactggaggggcagtgaaggcctattattcacagcacataagattctaggagacagatttgggcagggaagaggtgggggagagggttcattgcctcccttaaatatgctacaattttttttcccccaagaacctcggaagacactccatcccccaccatcatgaatactgagcttgcacacttggggacctgccccagcgtgaggtcaggggagtgggttaatgcattctggaaaaggggattacttgattactgtcccccaagtccccacagccctggggtccatgcagagaccacagtgcaagagacgtggctccccgctgagatccagctgatctgaccgggcagtcactttgtcactcagaaacagagatgcgattgaagatggggagtcgccggggggctgccacgggctggggtggtgcaaaaactcccgcctcgaagacgggagagtcagagccccccaggctgctgccgctgctggcatattcatcagggtcggatcccagggactgtacagagggggtccgaaccaggccacccaagggcccccagacgctgataggagtggcccttcggcaggaggggcaacagactggggtggggtctcttcgagccaggggggtgccaggggcagcagagaaggcagagggtgacagtggaaggtccccaggtggtggtggggagctggagggcgagaaggagctggaggacagggaagggccggccaggcctggtggtggtggtgaggtccggcggccagagggcaggccggagaagctgatgctctggcgaagcacaggagggtggcccggggccgccaggtcttcgctagggttgtggatgaagtggcagcgagagccgtaggggc

SEQ ID NO: 91709 - DNA, 1056 bp, Homo sapiens
gtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaagctgggatcctggcttcttcgcggtctagagacaggaatggagagggagggggtgactttttggaagctgggtgcagttaactcttcctctccgagccccgcggcgcttacctggcaggaagtgacgtcaccgggcctggccgttcacctgaaagggtgggaccaggtgaggtcaccagatgggaaccgggggagccagttcccgggcgtcgggggcgccgcgctcccgtcctgctgggctccttgacccagcttcgggcgggtgcggtcggggacgggatgtttccgtccccacggggccgcgggaggcgggaggggccgggtggggaggacggaatgtgctggggcgcgcgcccagagcgagcgggggcgggcgcggggcggggcagcctggg

SEQ ID NO: 91710 - DNA, 1057 bp, Homo sapiens
agaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggtgaggggggaggcgaggggcccaggcggactgggggagggggcggcgccactgctgaacaatgagggggcgtgccggcggggggcgagccgaggcgccggcgggagttgggggctggaggggtgtgggaaggcgctggggaggctgtggctgtggggacggcgatcggggttcggagagaccggccggagggggtgcgagggctcggggccagcgccccagcgcgcagccctcggcgggggagggagccgtctgcaggaccctggcatccggtcccccagcctccgccctcccctgggaccccgcggcctcccgcccacggcttttcccagccctgcccctcgccctccgctccagctggagcccaaacgttcccaggatccctaagcctccggccccagacaaacgggactcgcagcttctgcgcctcctgctccgctcactcttctttgtctcagcctttccatctttttcgccaggttctctctccttgtccccttctttctgtcactttgtgcctcccccattagttactcccaggggcccctccctggatttacaccacgctcctaattcccagcccccatctgtgagtctgggcggcggagaggcccatggggtcctgatatccaagaaggggctctttctgcaggactctgctgggccgctcagccatgcctgagggagcccaaggactgagcctctccaaacctagcccaagcctcgggtgtggccgaagaggtgaagtgtgtg

SEQ ID NO: 91711 - DNA, 1820 bp, Homo sapiens
aattgagccaggtacggtggctcacctgtaatcccagcactttgggaggccgaggtaggtggatcatctgagatcaggaatttgagaccaggctggccaacaaggagaaaccccgactctactaaaaatacaaaaattagctggacattgtggcaggcgcctgtaatcccagctactcaggaggctgaggcagcagaatcgcttgaacccgggaggcggagattgcagtgagcagagatggcgccattgcactgcaggctgggcgacagagcgagactccatctcaaaacaaacaaacgcaaaagaaggggattgggacttggggtcctctatgtgagggaggagtcttggctcttgccttccattgctttccctcctcacagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccaggggtgagctggctgtcccatcatggtgtccttgggcctctgggtgtgggcacacagaccagggaccagataggccagcccatgctgatacctttattttttttttatttgagatggagtcttgctctgttgccgaggctggagtgcagtggcgccatctcggctcactgcaagctctgcctcccaggttcaagcgattctcctgcctcagcctcctgagtagctgggactacaggcacccgccaacacacccggctaattttttttttttttttgtatttttagtagagacagggtttcactatgttggccaggctggtctcgaactcgtaacctcaagtgacccgcccacttcagcctcccaaagtgctgggattacaggcgtgagccaccacacccagctaccatgctgatatgtttggcttgttctcctgtgcccactatagccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagc

SEQ ID NO: 91712 - DNA, 1201 bp, Homo sapiens
caaggagggggattctagggaggataggattctggaagtccttaatctgagaatccagccagatttcttgcagtagattccaaaggaagattctgatgcgggggattcggggaggagggagtccagaggggagaaagattacaggtgttgggagggtgggaactgatttaaagaaagggcgaagggagattattaaagagccagaatgcaaagaagagctgcggtagtcgactacagaggacgcgaagcacactcccgcagccttcccttcagtccgcacacgacactcccaggccccgccccttccgcccacagagcccgccacttccgcctcacagggcccgcccgctctgagcgcctaagggccttcccgccgctgaccagacgccccgcccgttagccgcaacagaagccgtaaagctctctcccgtcgcgacgcagtgctcaaggcgcctgcgcagaccctgaaaagcggccagggtggcccctagctttccttttccggttgcggcgccgcgcggtgaggttgtctagtccacgctcggagccatgccgtccaagggcccgctgcagtctgtgcaggtcttcggacgcaaggtgagccagacgccggatgggaaggggaggggaaggagaaggccagggtctgggagaggtcggtgggcaggaatctagggggtaacatgggagctggagccggagctcacggggcccctgtttctcttgtatcttacagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatggggttgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggat

SEQ ID NO: 91713 - DNA, 1026 bp, Homo sapiens
ccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtctgtggctggggcgctgggggagacattgcgtctggggacaggactccgggcagaaaggcccctgtgggaggctcgaggggttcacagcgggctctggcttctgggaactcccagattgtctcaagagatagagaattaggcaagtcgaagtcaagcaaagggacaggttctggaggccagaaatgggtcaggtccagtgagataacaggtgatgttttgaaagtttactctgtgtgcatatagtaagcacttagcattagtttttttttttagttatgtctagtcattccataactatatttgtagtgcctactatgtaccaggcgcaattctttgctcttagggtacaccagtaaacaaaaagattttaaaaatgtctgccttcgggaatgtaaataaatatagccaaggaataaactatatagtaagctggaaggtactctggagaaaagaacagaaaaggggaatggagagtcctggttgctcttgaaatagggtcatcagcatgagtctgaggggtgacatttgagcaaaaacttgttggaggtgagggagtgagtcgtggttagctggaagtgtagtgttccagtgagggggaccagcaggtgcagagatgggagtgtgtccgccgtgttcagggattaacgaggatttgagaggccaagctgggaggatcacttgagcccagaagtttgagagcaatctcggtaacacaacgggaccctgtctctacaaaaatataaaaaccattggctgaggccgggcttggtggctcacacctgtaatctcagcactgtgggaggccaagacagtggatcacctgaggtcaggagttcaagaccagcctggtcaacatg

SEQ ID NO: 91714 - DNA, 1009 bp, Homo sapiens
gtagggatggcaaataatgagctacttttgaggggagctgctggttcacccatcatggctccagtaacctgttcatttattcattcaacaaatgttctggctgggtgtggtggctcacgcctgtgatcccagcactttgggaggctgaggtgggtggatcacgaggtcaggagattgagaccatcctggctaacatggtgaaaccccgtctctactaaaaatacaaaaaattagcgtggtggtgggtgcctgtagtccctgctacttgggaggctgaggcaggagaatggcgtgaacgcaggagacagagcttgcagtgagcagagatcgcaccattgcactccagcctgggagacagagcgagactgcatctcaaaaaacaaaaaacaaaaaacaaatgttccttgacttggcatgttggggtcacagtctcccttacagagatctcagtctcaaggcagaggcagttttatagatacacagttactgcaggggatgttgaggacggtgagagcacatccaagccctgaggtgagcagagagtggtgggggcatcctccactgggagggaggagccaggtttggaaagaggcatctctgggacctgtcagaggggaactgatgacaaggttcctagaaatcagcctgtggtcctgtcatagtttgggttgttaaaatgtgcttcatcgtgggctagtcgagatttgtgttaagcaaatatttctgaagtcttctgtgcttggccttgggctgggtgatgttgggggacccagcagtgcctgagatggactgggccctactattgggaggctcacagtggtcagggctgtgatggagggagcccagagaattgtgagcatagaggatgtgcctgactctgcctgggggagagggggcggggatggctgcctggaggaggaaggttagtttggttttttttttttgtcttggtgtcttgctctgtcacccaggctggagtgcagtggcacgatctcagctcactgcagcc

SEQ ID NO: 91715 - DNA, 1070 bp, Homo sapiens
actgcacctgaccagatttcagatttttggattagggatgttcaacctgtattaggtaaatggattgtagtaatgacatggaagaagtcgtgaagttcatgagttaaagactgaagtttggtatgcatccattaatgttgtttctggtatggaaagagggattagaggccaggagagtagggaggaggctggggtaaggatccaggtgttagagggcagtgtcctggcctaggctcagatatatggggctgggggaaaaggatgggttggagaaatgatgtttacaggcagaaaggatgaggatttggtgcctgtcggtaattggaggaggccatcacaggtctaggggaagacactgaggtcagtttgggacacagtgagtatgaaagggctcagaggccatctaggggaggcatccaggatgctgctggtgcatggaggtcttgagttctggaaaaaagtgggactctatagacagatgaggacacgtgtcatctctagagacaggaactgaggtcatggaaagtaaaatggacagggagagagggcatggagggagaacaaagtggccctggactgagccctggtaattgatgtcagatttgaaggggttaacagtaagaggagcttgaagaggagctggtggagttttgagaaaaaccaggagagcatgatacggcagaagccaagagaggagcatttctccagggagggcatggttggggtgccagatgctgctgggatggtagggaatacagaatggccacagaattagcaacaggggtggccagtgatcttcgtgagcagtgtggactagaaacagagatgggagtcactgtcacagagatgtccaccaccgccaagggagaggacgagatggccttggggagttgtagaatgggaagagatgggccaggtgctgtggctcacacctgtaatcccagcattttcggaggcagaggcggatggatcacctgaggtcaagagttcgagaccagcctggccaacatggtgaagccacgtgtctactaaaaaaatacaaaaattagccaggtgtggtggcgcacacc

SEQ ID NO: 91716 - DNA, 2881 bp, Homo sapiens
cggggttgccaggaagatcagtgaggaacctgtgtcaggtactcagaacagggcagggtgtatagtatgctctcagcattagctgttataaatgtacaagaatcataaaaccaacagaccatgaaccatcttttaaaaaactatttattgatcattttctgatagttgggagggaacttttctttttgcttactttgatcttagttttttaaaagggatttgggagtggagtaaggagaggggatgacttttagagttagttggagctgtatgtccccctcgatcctgatgcgtgcaccagctctgtggcacggccccagacgagtgcctccctgttggagcctcagtgtcctgctctgtgcggtggggatttgtagtgcacatctcccagaggagatgcttcgtgtcctgggagctgttatgaggtcacctttgccacttaccacttggcctttccgttttagatgttgacgatgagtatgaggacgaggaccagtgggaggatggagcagaggacattctagagaaaggtgtgtgtgagccctgcctccacaagactactgggaagagggtggctgagagggtcttcagagcccattcccccgacccccgcatcccctgtacaccccaactcccaccgtcctcaccttgcttctttctgtccttcccagagagaccagctccctgctttttccttttaggcccatgagtggggggtggggccctggggtggggatgttgtggggagaggactctgggatcccagggcccagtgaatcccttctggggttgtagggtgggcgagctctgtcccaagataccccccacttcctgggccagtgcccccctttccccgttattttccgttctgtgcgcctcatacatttcggcttctccccaaccacctggtgcctggcctttacttttggttttcaacctttctgtgtccctcccttcccctcccccaacccattggttgattttgctgctataatttggctcatactttgtctgccctcgcccaccaccaccaccaccaccaccaccaccaccaccaccaccacctcctcttcctccaagtagaagagattgaaggtaagaatatgaaaagtgtgattccctgaccttcctcccatatcctgacatttcctccttcctgaggcacctgccctcaccggtagcctccccaccagccccggtctggccctgagggctctgacccatgtaggatccagagtcagggagttctggggccaggtataccccagttgttgacctgggaaagcacggatgtgtctgtctgggactgagcatttgtgggtggtagcgatgtgtggggtggggtgcagtccagggtgtgcctggactttgagatgggaacagctggaagccccccaacttgctgggccccatccccagtctttttgacaagaagcaggatgctgagtaggacagagtaggggatgaggggttgggatttcctctgtgagatgtcatcttcctgccccagggccaaaccctggccctcttagctgcacgctcctattttctccaggcccctgccctccacctgcccttgctcacgccctctgcccattatttttcagcctccaatatcgataatgttgtcctggatgaagatcgttctggggctcgccgcctgcaaaacctctggaggtgggcaaggaagggaaacgtggtgggattggctcctgtggggagatttgggagtaggtcagcccacctgctgtcctcaaccttcaattcgtgtttgcttccccactcgtgctccagggaccagcgagaagaagaactgggcgagtattacatgaagaaatacgccaagtcatctgtgggagagacgtaagggcatggtgggggcaggtgggggcagggagcaggtggtccctaagcgggaaggggcggggatctgacagagcttcaccccttcctgactgccctcctcccttcagggtgtatggaggatctgatgagctctcagacgacatcacccagcagcagctgctcccaggagtcaagtaagggggttgggatggtgggggccgtgctggggtgcgaatcttgtatggggtgatggtgcctagacaggtggctccctgaaataagtcagggcagagtcacacaggcagtgtggtggatggcaggggtagggagggcaaggtggcactttctctttcctcttgctcctgggtagaagcgtggggaagtcagtgagtgtgagggaacctggatgtgaaaccagaggaagggggtggccctgggggttcgtctgtttgttactgaagatccagcttcactgaaggccttccttttcctctgctgcttagggatcccaatctgtggactgtcaaatgtaaggtatgtgctctgatctcggggcttggaggaggtgggagaatgagggaggctgctttgtgggggagaagtgtctgtctgtcccgggtctccgtggcctgccagtcacttggtccttctgtctccatccctcactccacgttactgactggctatctcccacctccatcttcctggctgtccatccttctttctctctcctctcttggtcctactttatttttcttgctgctgtctccttccccctttcctgtgtcctttcctccatcctgtcatctctctcaaatctgcctctcatcttccagattggggaggaacgggccacggccatttccttgatgcgcaagttcattgcctaccagttcacagacacggtaagtcgggtagacaggcggcttggtggggagacatggcaacacccagagggaagaacattgtcaacttcaggggtaccaggtgcctctgttgtgagcagagctgcctgctgagtgagctgcttgagctg

SEQ ID NO: 91717 - DNA, 1035 bp, Homo sapiens
gggaatagcctggagggggccatgggcaagagcgtggagaccagggaggaggctgctgctgtagcacatcccacccagatggcagtgctggtgggataggaccaagaccctaatacacgttgagtgtctctaacctgaattcttgagaccacaggtgtttttcagatttcagattttttcagcttttggaatatttgcattatacttaccggttgagcatcccaaatctgaaaatccaagagtgagcatttccttcgagcatcatgttggtgctcacagggtttcctatttttgagcattttgggtttttggatttggaatgctgagactgcagtggaggaggggaagaggtcaggtattttgaaggcagagctgatggaatttgccaacgggtcgggtgtgggtgtaagagaaacaaaggagtcaagagtggctcccaggttgtgtgcctgagcagagggaagaatggagtgggaggcggcaggtttgggggaatcagcggtttggctgcggtcgtcctggatttgagggacctttagacatccaggtggagataccaagcaggcagtggctactcagtgccagagttgaggggacagacaagctagcgtgggacttttgggagtggtcagcagcctggtttcttccccaccatcctgcgtcccttctccttcctagcatctcctgacccttcttgtgtctggggtcagggaggagagtggggccctgctgaccttctgctcgccctgctcaggtggactacgtggagcccagccagaacaccatctccctgaagatgatcccacgcatcgactacgatcgcatcaaggcccgcatgagcttggtactcaggggaatctgtggcctgggggggagggagtgtgctcgatcccactggtggccaagccccctccctcacccttcccacccatgcccctttcctccatagaaagactggtttgccaaaaggaagaagtttaagcggcctccacagaggctgtttgatgctgagaagatcaggtgcgtgtccttggg

SEQ ID NO: 91718 - DNA, 1078 bp, Homo sapiens
accactggtttcgactcacctgaacctctctttgcaaagaacaaaccctagtgctcccttaccccccagcaagccagctgaccaagtaccccagcatgcccagcagagcatgctggcccctctcccagattcaccatgggagaaggcgattgcatgagcgcaggaggaacttgacctgctcctccatgaaggaggctccttccccaccccggagactcggaacaggcactaagcggccgccactccacatttggggccgggagctgcaggcttgggagtcccacctgcctgcttttgaatcctgtcaagactgtggcttggcacccttgggcatgtgatgtgaccttcctgagcctgcattccctcacctggaaatgatgagcagttactgatgccacagatttggggaagagcctgtgaggtcatgagtgtgcaggccaggctgagcgctctgcgaatattcactggtatcattgtctgaaactgttattttgttcagctaatgtttactgcatactttctgtgtactgggcactattcttggtgaaatttagtgaatgttacatccctgaccttctggagctgacatgctagttagggggacaggtcaaacactagattgtcagatggtgatcggtgctcaaagataaatcagggaatgggtggaggagtgcagggaggtgggaggcgggcctttggggtttgtgagaagtcactgctgccaagagggtgtgtgctgggatgggatgggtcagtctgcctgtggtcctctccttctgttgccagctgagaagactgaggtacagcaagattttcttcttgactctcccttctaatcttctctcccccatcaaattccaggtccctggggggtgatgttgcctctgatggtgacttcctcatctttgaggggaaccgttacagccggaagggctttctgttcaagagcttcgccatgtctgctgtggtgagggtcccagaggggtgttggtaatgggggtggtgtgagtgttctcctgcaggtgatgccctgggctgtgggttatctggttctgtcccactcctcaagttaggagtg

SEQ ID NO: 91719 - DNA, 1902 bp, Homo sapiens
acgagagcagcgtctactttgttcatagtgaatgattccctgaggttagatctgtaccctggtggctgttgctcgctcaaggatggagtgccacatgtgccctcctgcctttgctccttcctcatggatgtgggagtcatggagcacagtacttaggatcctggactccacatccacatcttggctttgttgctcctgtgctgtctgaccctgggctagtgactcaccctctctgagcctgagtttccctctgtaagatggaaatcatgacagaatccacctcagaggaagttttgaggcttcagtgaaatcttacggggcctgacacagaatgatggatgaacaatgttgctatcagccccttcttccatctctcaggtccctgttgcccaatcgggggtggagtctccttccaaagggtgttttagaatgactgggaacatttttggttgacccagtacctaaagggtggcactctgcctgcctgccccgcagccagggaattgagatgccttgtggagcttgggactgtctcccacaaggaaggattatcccactttagggaacccctgccccgtgtctccccttcccattctcacccccacagcctccctgctctccctctgtaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcagtgagtacaagttcctgcttttgagctgcatctgaaagaatttggttggttgggggtgagggggacatggtcaagagagtgacccttctctccccggctagggccgagaaggggagattcgccatctcttccgaagcttcgccttcctacattgcaagaaactggtggagaacgggggcatgtttgtctgcaagacccgccacctggtgctggctgggggctcaaaggtgaggtgggcatggcaggaccctgtgcgttgggtacctggctcagctctccaagcctcctctggccccagaagtgataagattgggcttgtgagggattaggagagcagtgtcattgtcaggtccttggcaaagagtgagaaggtttatttgggattctgagctgttcaccaagttattttaagttatttattcatttcattttactgagcacctgttaggtgccagacactggagaaccagtggtgaacaagacaaaaatactctgctctcacagagctgatactctagaggtggacagacagataaacccatcgtacagcttgaggtgatagcaagcgctgtgaagaaaacagaatgggctcaggagacagggagtgaccagggctgctgttttagacagaggagggtaaaaaaggcctcagtgggaggcagtattggagcagagacctgaatgaagggatggagagtgagcattttgggggaacagcaagtgcaaaggccctgaggtggggcttgtaggaaagtgtgcaggaccagctgtcacagaggaattcaggcctggggtgtgggtggctgggtggtctcctcagggccctgcacgtgggatgatgagttcctgtggtttgtggttcccccatcccctgcctgccagttcactccttgcttctatcctagccccgtgatgtgaccaacttcaccgtgggtggctttgcgcctatgagtccccggatcagcagccccatgcaccccagtgctggaggtgagaggggttcagggtcaggggatgtggtgggtagaaggggctggaaggaacttggttgttcagcctacactcactgagtgcctgtgctgggctgggcactgctattaggggttcaccacccacaggagggtag

SEQ ID NO: 91720 - DNA, 1119 bp, Homo sapiens
cccaagtagggaggagtcaagcaagtgaaggggacgttctgatggtgcccttgctgtgggcacagccgtgggggaccagtgacattctccccaatccccaggtcagcgtggcggctttggtagcccaggtggcggcagtggtggcatgagcaggggccggggccggagggacaacgaactcatcggccagaccgtgcgcatctcccaggggccctacaaaggtgacctgcgaggcctgtggaggcctggggaggggcatggtgaaggagagcctgcccagcctgacctcctgtccccctgcaggctacatcggtgtggtgaaagatgccacagagtccacggcccgtgtggagctgcactccacctgccagaccatctctgtggaccgtcagcggctcaccacggtgtacgggcggggcctggggagggccagggtggggcttgctaggcagtgagaggggtctgctcaccccatttgttctctgcgtccccaggggctcacggcgcccgggcggcatgacctcgacctatgggaggacgcccatgtatggctcccagacgcccatgtatggctctggctcccgaacacccatgtacggctcacagacacccctccaggatggtgagtgcccgcaggggacagggaagaggggctagggggacctagagaagggacaggacagacacactcatttcccccattccaggtagccgcaccccacactacggctcacagacgcccctgcatgatggcagccgcactcctgcccagagtggggcctgggaccccaacaaccccaacacgccgtcacggtgagtccagggttccccaggttctggtgtgtgctggtgtgtgtgagggatgatgctgggtgtctggggcattggaggggtttgtggggcccacccagcattctctgctcctagcctcaggctggtccctttgaaggaggaggcatagcatggcggggcgggggcaaagcggcctcctctccatccccaacctcagtagtgattgtggttacccttgggcctggagaaagactgcctgggtggagtgaccttgggagggcaccctcatctctgtcaaccacagtgtcagctgtggaagggaaataa

SEQ ID NO: 91721 - DNA, 1112 bp, Homo sapiens
aacccacaatacaacccgcagacgccagggacgccggccatgtgagtccactggggcctgccctcgtctacccctgcccaaaccctcctactgccaccacctcttttcccctccctcctccaacaaatgcccccttctctcctgtctctgcaggtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggtaatggtctgcctgcctgccctgaagggtggtgggctagggtgactttgggcatatagggtcggccaggccagatgactattcccaatgacacttcctctttcccctgcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggtacgtggggcccagggtggtgggtgagcaggcatcctctccttggtaccccctaaactggagacagacctgtccccagatggtgacagcccagagtgggcagagctgggattgaggaagcctagagggcaaggggagctatgtgaacccaaaggaggcatcttacctgatttagcggggaatcagggagggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcactctgggaggccgaggtgggcagatcacctgaggtcaggagttcaagaccagcctggtc

SEQ ID NO: 91722 - DNA, 1577 bp, Homo sapiens
tgcagtggcgcgatcttggttcactgcaacctccccctcccaggttcaagcgattctctttcctcagcctcccgagtagctgggactacaagcacacaccaccacacccagctaattttttgtatttttagtagagacagagtttcgccatgttgcccaggctggttttgaactcctgagctcaggcaatctgcccaccttggcctcccaaaattctgggagtacggtcgtgagccaccgcacccggccattttttgtatttagtagatacggggtttcaccattttagccaggctggtcttgaactcctgacctcaggtgatccgcccgcctcggcctcccaaagtgctgggattacaggcgtgagccaccatgcctggccctctgtgggggtcgatgccatcatccaaagccggtctttgagaggccctgccattgtgatcccagtatgtgtgatgctgtgtatgtatgtatgttttgtgtgttttgggtcttcttgatggggggagagttgggcacagatgttgacctgatctgtcactcacttccaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagagtaaggctgacccctgatcccttggcctctgaccccagagcccctgactctgaagaggaaggataaatgcatgattcatggctgggcgactgaggtgcaagaggtgcctgagcaccttggagtctttaggagcttcttaggatgttcatggaatgtttgggggatacttggggatgttcaggggagccctttcagagcgttcagaagcattccaggtagcactgactgcccccgtgccccagtgcgggacgttcccctcatgggccctgcctccctctggcctttagaagcctggctgaccaccccctgttgtgcccacagccattgcactgaatggtgtggaggacgtgcgaaccgtgctggagcactatgccctggaggatgacccgctggcggctttcaaacagcggcaaagccggctagagcaggttggtgctcagatgcccagagtggaggatcggctctgaggctcctgaaggaggagcctggggcagtccatctccacactcttggtttggctgtgtgaccctgagcagatacctcctctctgcctcagtctctgtaaccagggggatataacacagcctgtcctgtagggctgccagaatgaggggatgcattgattctgcagcctgctctgagaacaggaaacaggagaggatttgagattaggctgggagaggggttgcccttgatggtcttgagtaggtctgggggcaccttgtggaggtggattgtgggttttagatcaggcctggaaagaggctccctgggcacgtggcccaaggctgtggggagagatgtgatagtcttggtgggaccctggtaatttggaagtgggactgagagtatggattgcgtctgggtaa

SEQ ID NO: 91723 - DNA, 1173 bp, Homo sapiens
cagcctgggcgagagagtgagactttgtctaaaaaaaagagtatgaacagagagtttatggaaaagggaatatatatgactcttaaaagatatttaactggctgggtgcggttgctcacgcctataatcccaccactttgggaggccgaagtaggtggatcacctgaggtcaggagttcaaaaccagcctggccagcatagtgaaaccccatctctactaaaaatacaaattagccaggtgtgttggtgcatgcctgtaatcccagctcttgggaggctgaggcaggagaatcccttgagcctgggaggtggaggttgcagtgagccaagatcgcacaattgcactccagcctggacaacaagagtgaaactcccatctcaaaaaaaaaaaaaaatttaacttcgctcatcataaaagcgaattaaaactgatataccatttttcaactatcagattcgcaaaagccagatattattgatgatttagtgtgttggctgggctgtaacgaaacatctatgatcattaattgctggtgggagtgcaaagcaggacacatatagaatgctgcatagcaatattcataaaatctcaaaggagtaactttggcccagaattctcatttctggggcatcagcctacagatattacatgtaaaaaggaatctaggtagctattgatcatgagacacatcattagggctgggcgcggtggctcacacctgtaatcccagcactttgggaggccaaggtgggcagatcacaaggtcaagagatcaagaccatcctggccaacatggtgaaaccccgtctctactaaaaatacaaaaattgaccaggtgttgtggtgggcgcctgcagtcccagctactcaggaggctgaggcaggagaatcacttgaacctgggaggcggaggttgcagtgagccgagattgcgccactgcactccagcctggcgacagagtgagactccctcttaaaaaaaaaaaatcactagtttcgtgaaaacccaaggaaaaaatgatctattacagcatcaaatataagatgcacccacatttcagagatgttcaaatatgaagtgaattttgaattgaagcaatactatatttgtgcacatgccacatgatatacaagatgaactactctagcaattgtacaagatgaactactct

SEQ ID NO: 91724 - DNA, 1073 bp, Homo sapiens
agctgaggcgatgtgatctaccacggtaagagggttcctctggctcccatgtggctactagggtggaagcaggatgccagtgaggaggccactgtgcagtccagctgagatgatagtggcttggccagggtgctaacggggcggtggggagatgtggtcagattttgcatataatttgaagggagaatcaggtatgtagggtaagaaagaagagtcaaggaccacactatggcgtttagtctgcacagaggaaggagggagtgccattaactgtatggacaagactgagagagagtgtgggcgtgtttagcctctgactggacccactggccaaacaggagcttatacaagactggcattgaagggtgagatctgggctgggagtagttggcatatttatggtattaaagcccaggatgggatcactaagggagggtgtatagatggaagtgtgggctgagaatgagagcagggaggcccgtgaggaggttgctgcaataatctaggtgagatgacagtggcctgtaccagggcaggggcagaatgagtagtcattggagtctgggtgcattttgaaggcagaactcactgtgattggttgtgggtagtgatggaaagaacctgacaagggcttcatgagaacagaatagaagcagaagtgagacagtggtgtgacattcctcctttccactgggccctgtggtctctgcttctctttgcattggctgcttcctgttctcaggcagctgggttggtcctgggtggactcttgcccccactctatgtgatcttccagctcagttacccgcagcccctcagtcttcattccgaatttcccagataggaatgggatttccagggtcgggtatccaaccctgctcaactcactggagctggagggttcctatagtgatgactgtctgctcagaagggctgtggactgggcaggccccccaaacattcacagtcaccatgtgtttctgacacttggtgtacagggcggacatgtgggtgggcaggtgtggcaggggttggagatgatttgaccctcttttggctgatgggtgagacag

SEQ ID NO: 91725 - DNA, 1053 bp, Homo sapiens
gacccttacctctaggagactgttgacttcatcagggaaggggcttttgtctacttcctccgttatctccaacacatagaaaagtgcttggcacacagttagggctcagtaactacttatcaaataaactattgaagagcacatatctggatcccagcatggcggggactctgccgatcccctttctacagaactccaaggagctgccttaaagttttctgagggctcaagatattcaacaagtatttcaccttgcctcttctttctcctcagcattgggaacacagaagagaacaaaatattcccctacccctatagaacctacagtaatagggacagtaatttagactatcaaataatcacacgtgtgaaattaccaagaaaggtagagagtgttataagaatacttgataggaaatcaaatccggatcctaggaaatgaggtttgaggtgatgaaggagtaggcattaactcctttaagagataagagtttgggatggttggagcctagaggctgatgcagagcaagaggtcagaccttgtgtatgccataaggagtttgggtgtttaccccacatgtagtgggaagttgtagaattttaagctggggacaggagcgtggtcaggtgtttgtgtgtgtgtgtatgtgtgtgtgtgtgtttccttctaaaattcttcacactaaagtgtactttaaaagactcctctggcttctgtgtggggaattgactataaggcattaaggattaaagtagggagaccagtgacaaggctgttactgtggaattaaaatagctgtgattgaagacagccacacattctttgctgtttttcctatcaagaggtggagtctccttccttctccttatatctgagctggccctgagatttgttttgaccaatagaatacaatgaaagcaggctgggtgcggtggctcatgcctgtaatcccagcactttgggaggctgaggcaggtgaatcacttgaggaaaggagttcgagaccagcctgaccaacatggagaaaccctatctctactaaaaatacaaaa

SEQ ID NO: 91726 - DNA, 1073 bp, Homo sapiens
gggcgtccgcagacttagcacaagagtggctcctcatgccaagcaggcgtccagtagcagctgagtacacttaggaggctttgttggtgccatctggggaacaggcagacaataggtacagactctgtccccacgtgtactgtccagctctttggaatcatcgcgaaacaaagagttttgagattctgagacaaaaagattttcccggggttccaggtaagtggtcctgtttccacggtaatttggaaatgtacgtctcccaaccggccaatcaagagcccagttcaaagggtaccgtctgccaccactggggctcggcgctttgtgggaaatgaagttctacttagcaatcgctttctgcggtgttcgttggggaactacagcaaccagagttcttttctctcaggcttgggggcgggttttcaggcagccaatgagcagtctgaggtcccggggcctggatgttcatggtgtttaggagagggagagaaggctgtgactgggtggctttggcgcaggtgttgaggtctccgaggtgtgcagaaggtgggtgcggcgccgtcccgggagagagtgccggttgtcgctcacagttccagagcgggcagtagacgccgaggcctgaagaggccccagcacgcggacatcactggccgctgtgcctggcccggcttgcgggaagccccgctcagtgggagagacaggcaagaccccgttgcggacctatgtatgttcactaatggaggcggcatggaacgcggtgggaacccgaggagaccttggtaggaagatcatcccggaagactaggagctgtctgagctgagacctgaagacggaaggatgttttgggggtcgggggcggtgtggtggaatggtttgcgcaaaggcagagagaaacagcctgttgtgtgaacatggactgcaggcgatctggtgttggtgatcatactgaaaattctgtatgaatgagatgtggaagattttcttgatcatttagggaccttggattttgtcctgagagcaatgaagagccatgggaggatttttagtagggaaggggtacggcccagtt

SEQ ID NO: 91727 - DNA, 1182 bp, Homo sapiens
ttttgctgtagctgacaactctgggaggagagaaccctatgtgataacttggggatttgactttgaggccctctaggagtggacacagttgtggaatgaccctggtataaagaggggtgcctggagaaaggtctgtggtaggaatattagggtgtgtgtgtgtgtgtaggggggcaaggaagcagtgtaggggagaaaaggatgatcactctaaactgtgggaagagacacctcctccttctcccatcaggaggagtgggccttgattgggatgggatattggagtaatatggggaagaaccctgttgtggtagggggaattgggatatggtacagggagactacctggaaggctggttcctaatatggaggacctgaaatagggaagcggtcttggcatgatatggagagggtcccctaggaaaatcgtgccctggtggatgagaatgctgtagagataggactctgttctatagaggttctcagataactttggtgtggttgggaggtccccaaggacgctgatgtggttttagggctgcagaggactctgctgtggtttgggaggggaagactcatgtggtttgggaatcctagagttctctgggttgagggaatctactgagaaggatagatcttaaagtattggccctggctgtgctacgggctgagatcctgatgttcagggaagactacagaaagtggcatcttgtgttaggggccctggggagggccacgagtagtgagaaaagaatgaagcctactcctctgcatactgtctgtggtttcttttttcttttcctcctctgaattattggtgtcttcctgtcctcctttccctgtgatggctcatatcgacccctgcttggcccccaatcattgtcttttatgtgttctctttgtgctgccttaatcatttacttgatcattatttgtcgagggactgctgtgccatccccccccacctggctaccacttctctgccccttctcttcattgctatctgctgctccgttgtgcccttttcctcttctctctgtgccctgtctttctcatgtccactcttccccgcctggcactattcacatatccccttgttccatgttgttttcccacttcctgtctgctctcaggtctcagcggcggtggcagccgaggtgcaggatgcaagaaggcgccccc

SEQ ID NO: 91728 - DNA, 2213 bp, Homo sapiens
ggatcacctgaggtcaggagttcgagaccagcctgaccaatatggtaaaaccccatctctactaaaaatacaaaaattagctgggtgtggtgacgtgtgcctgtagtcccacctacttgggaggctgagacaggagaattgcttgaacccaggaggcggacgttgcactaagctgagatcgcacaactgcactccatcctgggcaacagagtgagactcaaaaaaaaaaaaaaaaaaaacctcaggctttaatcaggcaagttacctaacccatccaagcctcagtttacctgtctggaacatagacttgtgaagattaaatgagttaatttctgaaaggtgcttagagcagtggttggcccattgttacatcatctctgtgccttggcttcctggttttaagcctctgttgggaacctgggctctcaggcagatgggattgggtacttttgctacttgctgaataactcttggccagtgactttatgtctggacctcagtttattcatgtgaaaaatggacatgatagcaatagtcattagatggtagggttttgatttgggggttggaagagatgctgtgtatagtgtatgggcctaaagtaggcactccatgcatgagaactagcatcactgttcattaatttttaatttattttaggatggtctagtctatgcagtcgagttctcccaccgctctggccgtgacctcattaacttggccaagaagaggaccaacatcattcctgtgatcgaggatgctcgacacccacacaaataccgcatgctcatcggtgaggggtctgggggtggccccggtggggtaggacaggccaccgcaggcttctggaagaagccagtggatctctgattcggatggagttggagtggatgagcagacctcttgagtctgcaggaatagaaaggggtaaggggagctaggtgaggttgtggaggtggcagcttggcttcagagtcttggaagccacccttggagggccaacctcttctccttcagtctcctccccatctcctaggtctcctgtacttcctgcctcttgtatttattacactacccctccataaaaagcctccttttgggggtcctaatcattgtctggtgagagcatatcccagaaaactaagcatggcttgatctggaggggcccactgtgaatattaattactttgtttaaaaaaacattcaaagatataatataaaagttgaaaagccttataaaccaccgccagaagtaactgatgagaacaatttgatgtctgcttttcccaggttttaaataatcagttttcattataccaccttttcattttttgaaaagtcacactggcttaaaaacattatttttcattctgctcctttttctttctgtgttttatttttcccatgcactcataccatcccctttgttctgcaacttgttttcatttcacagtcctgcggacactcttgcctataagtgctcactcactcttacttgtctttttgatgacgtgtctgtctccccaccagacctgggagcgtctcgagggcagggtccgggtctgactcgtctctatgtcccccacgcccggcccagggctggccacagagtaggtggcaaccatggtttacaagaagagtggatgaatgatgtgactgtgggttttggactcatcttgggacactggagggagggggaccagtggaggtggggagtgaaactggaggcagggagaatctcccaggaacctgctggtgatgggcataggccccatgggaggatctggggtgatccctgtgactccaacttttaactgctgctcctttctccttagcaatggtggatgtgatctttgctgatgtggcccagccagaccagacccggattgtggccctgaatgcccacaccttcctgcgtaatggaggacactttgtgatttccattaaggtgcggggtttggaagagtctaagatggggtggcagtgttctagggaggtatcttctctatctgtatctgtcaaatagccacccaaaacagaggggccaagtctgcaaaactatagctttggatttaaagaggcaggagagtgcagcggtcaagtgcaaaattgagtctgaccatctgagtttaatcccagcctgctgtgtgactgagcaagttacttaacctatatgcctcagtttcctcacttatgaaatagaaatattgtct

SEQ ID NO: 91729 - DNA, 1100 bp, Homo sapiens
ttaatattgacatggaatgaattctgtgaatctgctatgcaaccaaggaaaccaggatattaacagtaacctacatctattcatgtactcctcccctatcccaaccccatattaatatctccttcccattcaccaatatcatgagttttacatttctcattcccttgctccttttcttgggcagtatgattgtggctgggtgtggtgcctgacacctgtaatcccagcacttcaggaggccaaggcaggaggatcacttgagccaggagctggagactagcctgggcaacatagtgagacccccatctctacactatgggagtagtggcacacacctgtaatctagctacttcagagaccgaggcaggagaattgcttgagcccaggagttcgaggctgcggtgagctgtgattgtgccattgctctccaacctgggcggcacagcaagaccctgtctcaaaaaaaaagcactaagcaaaaaaaattattatgattttaacatttattagtctgttgtgtataactgaaggtcattttcatgatcttgattgtgaatgtcttctattttatttgcccattctattgatggacatttgggttagtcttcacttttcttttgctgtggacattcttggaaatgtgtcctgctgtacacgggcacatgtatttcaggtttctcacctgagaggtattgctgggtacaaggtggtttaaccttttaagcttcattgccctgactcctgttttgtttcccccacaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtaagattggctaggggttacagaggaggccttcctgaggtggggagtggggagggcggagattcaggatctttctctcctgttgtacctctcctttataggtggaggcttccattctggtggcaaccggggtcgtggtcggggaggaaaaagaggaaaccagtcggg

SEQ ID NO: 91730 - DNA, 1031 bp, Homo sapiens
ttagaatccttctcggtggtgcctgagcacttcctccatctggcctgcccaacccgcactcatctgtgtgagaacttgcttcattgagtttggagaatttccaccatggcccaaagggtctgttttcctagtacaggctttctttttcttttgtgtgtgtgtttgtgtggagagatgggggtcacctggcaggagatttgtggatctgtgcccttctcccaagttccctttctcttccgtgtttggggatctcttgatgaagtggggtgggggattgtaggccaggtatgctgagatcctggcttgcctgcaggcattctggtctgtgattccctcataaatggaggatacccgttcttccaaccttcctccatgtgtggtagaatgtgaagttgtaaaagttgtcaggtgttagctctttagtaaggattttagcctgagtgagaaaagaaccctttgggagatttttgagcaggggcgtggtgcagtctgacatttttaaaagggattctttttgcttcgatgtgtgaaagacctcagggtggcaaaagtggaagcaggcacattggtgggaagcttgttgctgtaatctaggagatggtgtggtggaccaggatgggagcagtggacatgctgacagttttacatgcttttgaagacagaaccaacagattgtatgtgggtgtgtgatcggagtcaaggataaccaagggtttgggggtgtgtaactggaaggatggaattgccatttttgagatggagaaggctgtggaaggagagcagattttaaatcagggggtttatggacccccctccccccaaaaaaagaacttactggaaaagtttgtgtgaacatgtgttttttctgaggactgggtacttttggtacattttcccccaaaagctccaggacctgaaacggattgagatgttttgagtatctgggattgaaagtttacactcatgcccactccgccccaagcacatgccagtacttcctttctgttaggcctgggttgagactttcataa

SEQ ID NO: 91731 - DNA, 1058 bp, Homo sapiens
aaaaagatgaactccaggagagtggagatttttatgtctcgtacaccgctgtattcccagctcctagaacagcacctggtacacacgaggtgcactgtaaatgtttttcggatgtttgaatggaagcccagagtcggtcactgttcttggggctggaaatgtattggggaagcctttttgggtgtacaggggccagagggatttagctaggaatacaaaagagggcacagcccgtgcgaaggctatgagccctgattattggggtgctcgcattggggaagaggaaaccggaagcgagtttagggcgaccgctgcacaggcaaaggctgggaaggcagagagcgagggcagcgggttgcgtgtcgacaggctcgagaatccaggctcactgcgcgtgcgccgagctccgggcggggaaggggcccgggggcgggactacggggtggcgtcacgcagcgcacgtcgccgcgcgcctgcgctcttttccacgtgcgaaagccccggactcgtggagttgtgaacgccgcggactccggagccgcacaaaccagggctcgccatgaagccaggtcaggctggggtgagggtccggggtcagggacggaggccgggcgggaatccgggtgccaggccagaatcggaggggtggggccttggcctgggggcaggggttctgagcacgggttccagtctcctgtgggaagggggattctgattccagcaggtctaggggtttgtgactggcttcagaggtcacggtcgtgagtcgaagaaggccgtgggcctggcattgggggtgttgacgtggggttcgtctcattgaggccgtctaatagggattttggatattgggcaggaggcggcactcaagggtcttgggctagagtttggattcaggcatctggagtcttggatcgctgggcgtgttttgggaatcaggcttgggtcggagatggagagttcctgaccttgggtcctggagctgtgtgtgggaagcccccatttgccttccctgtcgctgccaccaccaccatccccttatcccgcatcccagcttt

SEQ ID NO: 91732 - DNA, 1095 bp, Homo sapiens
cacaccattttctcaattcacccatccatctcttcatccatccatgcaatcatccatccatcctcccagcccccaataaatattcatcacgtgccagattccccaggcacctgatacctgctgtgcaggaggaaagtcagggatgagaaggcatgagacagacacaatgacatgcagcttagcttaagatatttattcaatgctctcacatttggcctctgtgacccagaaaagcggtagagcagggtaggagcacatgatgcatccttcagccactgcaacctccagagggaccaggtcttcttcaggaaatcttcgttcctggtggatgactgatcagccataactgcaagacacagacatttagcacctccgcttgcagactaaacacccaccctgactgccctcatcccatgaggatccaggtgcctttgccccaagaagcctggtttccatactacatccctcaccatggggagaagtcctgcgctctccatttctccatcgctggcttctcctgggagtcatgccaatcattggtctggtccccgtcaaagtttccacaggccccacacagtttcccagcatggtcattgctgacaatcacagccaccttcccattggctccaagccacacctggacccctgccttctggcggactagcagggagccatcaggtgtacgactcacggacacagatgctaacttctcagctgggagatccactcggagaccattcacctggtgggggatgcccagcaaacacagaggtgaggccacagccccagaatagctgggtgttaccaggatggaggatggagaccccaaacaagataagttcatggagctaaatcaaagaggcaggtgctgaaagagatgaagacctggatgtttgcactatttggagcaatggatacatgagaagatagctagagatctggatagacggataaaaggatggagagtggagggatggagagacgtacccatggatctacacaacaccccaaagtcggtgggggaagcattttgtaccagacagataagcaaacagacagacaaacaatcaaaccccagggtcatccttatggttc

SEQ ID NO: 91733 - DNA, 1046 bp, Homo sapiens
ttgcttatctgtctggtacaaaatgcttcccccaccgactttggggtgttgtgtagatccatgggtacgtctctccatccctccactctccatccttttatccgtctatccagatctctagctatcttctcatgtatccattgctccaaatagtgcaaacatccaggtcttcatctctttcagcacctgcctctttgatttagctccatgaacttatcttgtttggggtctccatcctccatcctggtaacacccagctattctggggctgtggcctcacctctgtgtttgctgggcatcccccaccaggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatggtgagggatgtagtatggaaaccaggcttcttggggcaaaggcacctggatcctcatgggatgagggcagtcagggtgggtgtttagtctgcaagcggaggtgctaaatgtctgtgtcttgcagttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgcatgtcattgtgtctgtctcatgccttctcatccctgactttcctcctgcacagcaggtatcaggtgcctggggaatctggcacgtgatgaatatttattgggggctgggaggatggatggatgattgcatggatggatgaagagatggatgggtgaattgagaaaatg

SEQ ID NO: 91734 - DNA, 1496 bp, Homo sapiens
ttgatttcgaaccctggccggtagtgcttagtgaggtcggtggcccggcgttgggattgggtcaggcggtgagtgatatatgggatcccgccgtgcggccgagtgatccccgggtctgggctgcggggctgactgatgttcagggctttgctgatgggggtaatggggcgggtagttaagtattatctgtggcttgcctgagtgatatttaggtctaaggtgagttaggagactgtgacataagggatctttgaggggaaactggggaatgttgggactcgttgaaggcgcagtcactttaacagcctatctaggagagccatgtgacattaggaacctcttgaaggggattgggtggcatttgggtctgataaggagttgatgtgacgtttagatcctagttgggggttgtgtgacactggggacatgttatgagtggtatatgataacataagatctgtttgaggggcaagttgacataaagagcttgtttaggtggccaaaaggtttccaggatctatttagagggtcttaagatatcaggggtctgttaggggctaagtgacatcagggtgaagtggggaggggaacaaacattagtgaagttgggaagctttcatgagaggactgtcttcttccaatgtgagttatcccctttcgtctaggatgagatcccagcactgtccgtgtcccggccccagaccggcctgtccttcctgggccctgagcctgaggacctggaggacctgtacagccgctacaaggtacattcgacccccaacccagaccttgcacaggacctgacatctcatactcttccccactttccaccactctctggatcagcaagtctggagccatccccttctgtcccctctctgctcgcagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggtgtgctaaggacacctcattcattcatctgtccacttaacaactatttcctaccatgtgctaggcagcagcaaacaaggcagggcagtgcagtgcaatgttcttcagagtattttgactgatcgaaaggtagaaatacatacatatatatatatatacacatatatatatgtatatctatgttttttttgtttgtttgttttttgttttgagacagagttttgctcttgtccaggctggagtgcaatggcatgatctcggctcactgcaacctccacctcccaggttcacacgattctcctgtctcagcctcccaagtagctgggattacaggcatggaccaccaagtctggctaatttttgtattattagtagagacagggtttcaccatgttggccagtctggtcttgaactcctgac

SEQ ID NO: 91735 - DNA, 1050 bp, Homo sapiens
tctcgttttcctctctcccttctcgcaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcaggtaaagggggagcctgcagctgggagggccccatggggaccttgaggacctggccaggagccccagctctgctctcccaccagaccagaagccagatgtgatgtacgcggacatcggaggcatggacatccagaagcaggaggtgcgggaggccgtggagctcccgctcacgcatttcgagctctacaagcaggtgaggcggtgcaggtggcagggaagggagaggccccattgggtctggggttggaggtggaacccctgactcccacttctcttccttcctctgggtttcagatcggcatcgatcccccccgaggcgtcctcatgtatggcccacctggctgtgggaagaccatgttggcaaaggcggtggcacatcacacaacaggtgagccctttcgcccctgccccgagctctcatcttctggcctcttcgccttgctccctgctcgctcactggcactgcacagtaattagaaacagactctggggtcatagcccacgtgtgcatgttactggctgtgctgacttcacctccttgggcctctcctagtagttgaagactcatttcacccggtgatagtgagcagttaatgaaataatgcagtgttttcctacaatgggttgtgacctattagtaattatgaatttcaatttgtgggttgcagccagtattttgaaacatgaaatagaacagaaagcgccagagaacatccacatggtatttataccatggtacaagtatatatggtgcaagttcatctgtttcgtgaaacttgtttcatacagatgtgcacactcatgtatacttgtggttcttcaaaaatatatatatatattttaattcttaaatttttttgtagagatagggtctc

SEQ ID NO: 91736 - DNA, 1050 bp, Homo sapiens
gctggaaggagagtcctgggggtatgcttcatacaacacaaagcatctgatccttaagaaacaagtgtaactttaagaaacaaggccagggtcaagcatggggtggctcatgtctataatcccagcactttggaaggctaagccaggaggatcgcttgaggccaggagtttgagaccagcctgagcaatatagcaagaccccatctcctcaaaaattttaaaaagctaggtgtggggacatgcctatagtcctagctactcgggaggctgaagagggaggattgcttgagcccaggagattgaggctgcagtaagctatgatgataccactgtactccaagtccaaagggagggcccagaacaaatctgtcttcaaccccattgccaattgtcagttatatcagaacatgcccgtggtccctgatctttttcaggaaattaaaaagctggtccttatagcaaacaggaactcagagctcttggcgaggcagtatgatgtcttagtgtatgggcagcatgcctgttttcttgctgattttgcaagtgctccagaaatgtagactggtttttttctttcttattttagtatttcatatcctgatttttaaatgttgggccaaaaaaatgacacatctggctggacatggtggctcatgcctgtaatcccagaactttgggaggctaaggcgggcagatcacttgaggtcaagagttcaagaccagcttggccaacatggtgaaacctcgtctctactaaaaatacaaaaattagcttggcatggcagtgcacgcctgtaattccagctactcgggaggctgaagcaggagaatcacttgaaccctgaaggcagaagttgtggtgagccgagattgtgctactgcactccagcctgggcgacagagcaagactctgtctccaaaaaaaaaaaaaaagtgacacatttgtaaggatgattcatgatttaggccactgggtcactgtggggtacaagtagatggctattcctcagggctggatgtggggctcacccttgggcatgagggaatgac

SEQ ID NO: 91737 - DNA, 1744 bp, Homo sapiens
aaagttgggggctggcacctaaggggtggttatcgtgacaggaaggaggtaggagtgcagagatctgagctggcctgccccccaatgtcaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactgtatcctgctccagaagtcagggaggggccctagttgggaacggggattagatcttcagctcaacttctgccagcaccacagcccagactgtgcaggtgggaccaaggtccagggaggaggggaggtgacagagatggccaaagatgacttccagccccaggcatttaccccatcacacagggaatagtttccttaactcgctgcagatgtggcccggccagataagatttcaggagctgatattaactccatctgtcaggaggtaagtggtggtttctctctggatccaggcagcgggtgtgtgaggacccttcttctctgaaccactctgctgcagtcctgtcccctcatggctgccctgggtcgtgggcgccatctctctcttcctctaccatcactaggggtggatagtacaggggtagtgtttttgtgttttgctttgagacagggactcactctgtcgcccaggctggagtgcagtggggcaatcatgactcactgcagtgatcctcccacctcagcctcccaagtagctgggattacaggcgcccaccaccagtctggctaatttttgtattttttgtagagacagggtttcaccatgttgcccaggctggtctcgaactcttgggctcaagtgatctgtatacctcagcctcccaaagtgtcgggattacaggtgtgagccactgtgccctgccacaggaagtagattttaactctcatccttcaacagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaatttcttcttagaagtttaactcctttggagaatgtgggccttgaataggatcctctgggtccctcttaatctgacagatgagcagacgaggtgcatggcctgggttgcagcttgagagaaccaaaatattcaaaccagatgacttccaaaatgtggggaaagggatggaaaatgaacctgagatggagtccttaatcacgggataaagccctgtgcatctccctcatttcctacaggtaaaagacagtaaagaaattcaggtcacaggccttgggagttcataggaaggagatgtccagtgctgtccagtagaactttgcacaatgatggatatgttctgtgttctccagtatggtagctgctcgccacatgtggctaataagtacctgaaatatggctagcatgactgagaaactgaactttttttttttttttttttttttttttttttgagatggagtcttgctctgtcacccaggctggagtgcagtg

SEQ ID NO: 91738 - DNA, 2973 bp, Homo sapiens
aacactttttgaaatttaaatttcagtgtccataagtcaagtgttattataacacagccacacttattatcatctgtggctacttttgtgctgtaataacagagctaagtaattgtgacagagaccatatgcctcccaaggcctaacaccttcactatctggtcttttaaagaagaagtttgttgaatcctgctctaaaccatttatttctaatgtatgttatttctgtttatcttttatttctactatgaggtacaacccccatccctgccccaacacagaaaaatagcattatagcatttgtttactctttgcttttttttttttttttttttgcagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcaga

SEQ ID NO: 91739 - DNA, 1430 bp, Homo sapiens
attcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaagaatgtgggatattttatagccacactaaatgccttagagttcagagaagataattttggtgagaaagttactgatgtgaggaatgtagagtagctgccatgttcacagtttactgcccgtgaaatattttactggatacaggcgtaccttgcttaattgtgcattgcagttactgcattttatacacactgaaggtttgcagcaaccttgcagtgaataagtctatcagcaccattttccaaacagcatatgcacatttcatgtctttgtgtcacactttgctagttttcataatatttcaaactttttcattgttaaatctgttatggtgatctgtgaccagtgttttttgattactagtgtaattgttactagtgtaattgtttggggataccacaaatcctgcccataaaagatggtgaacctagttgataattgttgtgggttttgaaagaatagtaaaatatatacacatatcccccccacctagattcaaaattgttaacaatttgccacatttattttttgtatatttgttgtaccattgagaataagttt

SEQ ID NO: 91740 - DNA, 2330 bp, Homo sapiens
cacttgaacccaggaggtagagggtgcagtgagctgagattgtgccattgcactgcagcctgggcgacaagagtgaaacttcgtcttaaaaaaaaaaaaaaagctttcttcactaaaaattctgattctgtacatctgagttgcttgaatatcaatatatttaatcttaccaaatggttttgattcacacctaaatttgacaaagttaacctgttcccttatgcacaccaccatcttacataaattcattattggcacccttttcctttttcagatcccttccctgaaagtattatattttatacttaggccatttgtttaatggattttgtatgcatgtatgttataggaaaataaaataggtttgccttcttcatttctttcagatttggagtcaaaatatggacctgagaaaatatctccagaaaatgatatttttgaaataaatttacccaaacatgttataaagcaaataagtaaaacacttggcctcgaggccttttattttagaaatgactcagaatatagaagtagatttgagggacgacagggacatcaagaaggatatatcaaccagaagatcatcagctatgaagaaatgcctgcttatactcatgcttctcctattcataatacacataaaccatatgaatgtaaggaatgtgggaaatactttagttgtggttcaaatcttattcagcatcagagtattcatactggagagaaaccctataaatgcaaagaatgtgggaaagcctttcaacttcacatacaacttactcgacatcagaaatttcatactggtgagaaaacttttgaatgtaaggaatgtggaaaagcctttaatcttcccacccagcttaatcgccataagaacattcacacagttaagaaactgtttgaatgtaaggaatgtgggaagtcttttaatcgtagctcaaaccttactcagcatcaaagtattcatgctggtgtaaaaccatatcaatgtaaggagtgtgggaaagcctttaatcgtggttcaaatcttattcagcatcaaaaaattcattccaatgagaaaccctttgtatgtagggaatgtgagatggcctttcgatatcattaccaactcattgaacattgccgaattcatactggcgagaaaccctttgaatgtaaagaatgcagaaaggcctttactcttctgacaaagcttgttcgacatcagaagattcatatgggtgagaagccctttgaatgcagggaatgcgggaaggcctttagtctcctcaatcagcttaatcgccataagaatattcacacaggtgaaaaaccatttgaatgtaaagaatgtgggaagtcctttaatcgtagttcaaaccttattcaacaccagagtattcatgctgatgtaaaaccatatgaatgtaaggagtgtgggaaaggctttaatcgtggtgcaaatcttattcagcatcaaaaaattcattccaatgagaaaccctttgtatgtagggaatgtgagatggcctttcgatatcattaccaacttattcaacattgccaaattcatactggtgggaaaccctttgaatgtaaagaatgtggaaaggcctttagtcttctgacacagcttgctcgacataagaacattcatactggtgagaaaccatttgaatgtaaagactgtgggaaggccttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttg

SEQ ID NO: 91741 - DNA, 1048 bp, Homo sapiens
ggatgagagcgttattgttgcacacttaagtcaagggtgagtttgtgctttgtatttgttcaagaaatgcgtttttgattttagaatatagaggttcctgtaaatttttagtgaatttcaggagaatatgcaaattgattcttgccccctcccattgtgccgcctcccagcgagccgttccccaccccgcccgctccccaccttgccatttaatattcacagagccatttggcaaatcgttcacaccttcctgtacgctctcttcttctaagctggtataaaaatagtcctccagaggtttatattaaagctttattttagactctgctttgaaaagaagattagtttgtggaatcacacgccaggtttctgactctttacaggcctccttttccaagtagggaagaatggagatggttgggtgatttccattcgtctgtgaggctttcaggaatcggaaagtgattgcacagaaattggtatcaaccagagtcaggatttttcgggagagtccatgagatgataattgtaatacttgccagatctctgtgagattcggcagttccggttgcattttgggctatttgtgtgaactgtgagaggcagtacgctgttgcggttaagaataggggagtggatccagagtatctgggttggaatgtttgttctgtccgtttctggtcttctcaggcttgtaatgaacattagaatgaattaatactctaaaacctcttagagcagtgctaggcatataataataaatgtttaatgttttagcttttgttttcgtgtggtcattttaggtcatttcccttgactttctataggacaggagcattgggaatatgtgattcattgtgattgctgcttgcatagtaagaaaatgagtgagttgctcaaatgatctaggacagaagttctttttaaattgacagataaaattgtatgtatttatcgtgtgcaacatgatgttttatagtatatgtacattgtggaatgactaaatctagctaattagcaatgcattacctcacatagttatcatttt

SEQ ID NO: 91742 - DNA, 3067 bp, Homo sapiens
aaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccc

SEQ ID NO: 91743 - DNA, 1063 bp, Homo sapiens
caaaataaatgacaataataaacaataattcttgactttgtgctactgtacatcaggcaatgttagaagtattttgcatatatataacttattttgtcttagtatcaatcctataaaataggtattgtatcatccccattttagagttgggaaaactgaaggacagagtttaagtgacttacctgaggtcatactgctagtgagtagcagagataggatttgaacctggcagtctggattgaagtttcctgctctcaaccattcagttatacctcttttcaagggataagattctgagtttaaatgaaaggaagtccttttctaacatagttagaaaagagttctcttactcaacctctcactcttatctgaagtctcttttcaatattgttttgacttgtaatttattgtaagtttaagcaggtcacaaagatttgaaaaaaaaaaatctgtattaaaaaaattctacatgtgtcgtttcttttaagcaggaagttccatttctaaaccagatgtaattacgttactagagcaagagaaagagccctggatggttgtaaggaaagaaacaagcagacggtatccaggtaagtgagggtaaagcaggcggggggaagccatcattgtcctggacatgtgctcagaaaggagtcatacacttgagatgtggtttgaaaagctttcttcagtgacccaagtcctgttggataaaaatgcccaagacctgggaaggaaataaagattacagcagaagccatcaccaaggaacttcatcatttactaatcacctaatttctgttctcttatttccttccccttttagtggagtaagttccctctttttttcccagggtaaactttttttttttttttaaggtggaatcttgctctgtcctgcagtgtggagtgcagtaatctgatcttggctcactgcaacctctgtctgttgggttcaagcaattctcatgcctcagcttctcaagtagctgggatgacgggtgcccacctccacacctggctaatttttgtatttttagtagagatggggtttcaccatgttggc

SEQ ID NO: 91744 - DNA, 1042 bp, Homo sapiens
ttttcagtgaaactagggggatatgcaaattgattcgtgccccctccttcacctttccacttaatagtcacaaaacaatttggcaaatcgttcacaccttcctgtgcgctctctttttcgaagctggtatagaaatacacctccagtagttaatattaaagctccattttagacccatatttgggaaggaggagattagtgtttaggtggaatcacacactagacatcagttggtctttacagacctccttttcaaaacagggaagaatggagatggttggatgatctccattgcctgtgaggcattcggtagtggaaaagtgaccgcacagaaattggtatcaacaagagccaggatttttccagggagtccatgagatgatatttgtaatacttgccagatctctctgaggtttggcagctccagttgtgttttaggcgtgtgtgtgtgagtgtgtgtgtgtgtgtgtgtgtgtgtactgtgagaggcagtacactgttgtggttaagaataggggagtggatccagagtatctgggttggaatattggttctgtcattagaatgaattaatatcgtaaagccccttagagcagtgctaggcatataataatgtttaatatgttttaactgttgttttttgtgtagtcattttaagtcattccccttgactctctacagaacaggagcattgggaatatgtgattcattgcgactgctggttgtatattaagaaaatgagtgaggggctcaaatgatctaggacagaaattctttctttttaaatcgacagatataattgtatgtatttatcatgtgcaacatgaagttttatggtatgtatacattgtggaatgactaaatctagctaattaacaatgcattacctcacatagttatcatttttgtggtgagaacacttaatatccaccctcctagcatttttcaagactacagaatattgttattaattggagataccctgttgtgtaatagatctcctgaacttatttctcttatcttcctgaaattttgtatcctt

SEQ ID NO: 91745 - DNA, 1030 bp, Homo sapiens
acatggggatccttgctcatggcaacaacctgtgcaccccgcgggctggaactcccacgaatccactaggctcggctcccttaggggtcagcccccatagtatgctgggatcaacctgaacggatcacagctcaaggcttctgaggctttttctgttcgggactgtatttcccagcggccaccgcgccagtccacttccggtctccggggtcgacgacatagcggggtaaggtcttcacgtctgaggaagagatctgtggctgcgggagatctctgcggattggggctccagcctgactgacccgacagtgcgggtggcctagggggaggcgctcagagtaggaacccgggggtgcagacgggatctgccggatccccaggcgtgtgtgtgcgcgggtatcagaggagggggattgtgagatcatgagtgacggaggggactgtgagtgtgtgcgtgaggttctatgcacaggcccgggagggcgtgtggacgcagcgcactttgctgagtgacactgtgccggtgcccctaggctcctgctgcttcctccctctttccgcttcacagctgcggggactgcagcagaggaatggccccagtagggaggtcagatattgagccgagaatgaagctttacacaagaaagcgcagaagtgcccccgagtgttccccaggggggcagctacatgttgagaaccacagcgtcctcagagctctgtccccagaaaccagctccaaactggttgtactggttgaatcgattcctcttccttttacttccttcctatttcgtgtgaagtgagggaaattgtggctatggagggagggtgttttcaaacttagtctgcgctccaagaaatgcctggagtctcacgcttgccgtatccttctccagtcgtatttttatccaaaagaaggacctggaggaggatgagagcgttactgctgcacacctaaagtcaagggtgagtttgtgctttgtatttgttcaagacatgcgtttttgattttagaatattgagatttccc

SEQ ID NO: 91746 - DNA, 1011 bp, Homo sapiens
tcgcttgaacctgggatagagaggttgcagtgagccaagatcacaccattgccctccagcctgggcaacagagtgagactctgacttaaaaataaaataaaatgaaatgaaatgaaataatgaaatgaaatgaaatgaaatgaaatgaaatgaaatgaaataaactggcctgcttggagatttggctatcatctccctctctctctctctctctctctctctctctctctctctctctctctcgaattattggaagatcagataaataacctagtttcagcttggtggcatggaacttcagcaggagtaactccatttttgtttggtctgttgagcctcatgcaggggctcagcccaaaccaatggctaaaccattggctaaactgtaaagtttatttaacaaaggggagctttccatggtcctgaaacaaactaccctgagctcctcattgcagcaacctatgcaactacaactatcattggttctgtaattgtttctttgatgtctggattcccccacagactttaaggaagtagatacctttctgtttactactgaataggagtgacacagggaaggtacttcttcacagtatgagatgagtggatgaatgactagagtataaaacgctgtcagcaactgggtaggctctacaacttcctcagcaggaggaccagaggctggaaacatgggtgtcactttttaagagcaaaagggggctgatggttggaaaaccagatactagaagaatgctggttttcataagccacacctgtggattgtcaaaaagaaaaagcacacatttcaaaagcagaagagaaagaaaaaaataaggcaaaagtgctcacaagtatcagaatagattttgtggctctggtctctggggatatttgcgagcactgtttagtgccatgaatgtatcagacttgccacttgtaccggtgagggaaaaaatatcttggagccactggccccatgccatgattcccaagcaaaaaacatcaatacag

SEQ ID NO: 91747 - DNA, 1041 bp, Homo sapiens
ccggtggagctgcgcggggtgagcggcgcggggaacggggactgcctgccgccctcgccctcgtcccccaccggcggaccccggcgggcattcgagagccgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatc

SEQ ID NO: 91748 - DNA, 1023 bp, Homo sapiens
cttggaagggacagatgtccacagtcggggctatatggcagagacacggtcatcggagtttcctggtgggttgaagggtgaaaggctagctcccaagttccaacacctcattcaccccagcactgtccccacccacagcccccctgccctctgtctgggcacctgctttgtaccaggcccaggaggtcagtcctgcaggggacacagagacaaatacccataccatggcagcaaacactggcaccagataggtccagagcattgcaggtacagagatgaaggcagctgacccccagggaactaactacccagagctggagaccagaagcgcaggcagcccgccagaatgaatggtgaagggttaggctgtgaagaggaggggaggctggaggagttggcagggaaccgctcatggccttcagtgccaggcggaggagctggaaccttgtcctgacagcagtagggggctatggggagatatatagcagggagggtcatgactggagttcaaaagagcccttggactcccaggcggagggtgggcctgagctgggggcactggaggctgggagcccagtggggacagatcctccacccagtaaccaagtggcttctctggacccagtgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggtgaggtgtggtgtggtcatgcccaccctgtgcccaagccccagctcccaggctccaggccacaggactgaggtctccatctctccctggaccccgcaggctgaaggggctgggggaaggaagcaaacagtggtcatcaagtgcccccaacctgggcaagtcccccaaacacacacccatcgcccctggctttgccagcctcaatgagatgggtaagagcctgggt

SEQ ID NO: 91749 - DNA, 1048 bp, Homo sapiens
agatttccccaagtctgctctcaggcccttttgctgttggtcctctttggacctggtgaggccaccaggagccattgactgcagcacgttctggagctcagtcggggggctcagggcaggaggcagcccggtccctgagcctggctgggttcactgctttacagctgtttgggttcttactctgaactcagcccagggctgggctatgctggggacacagcactgattgagccagccctgggccctgccctggaaagctcccagcccaggtagggtgggcggcctggagtggtcagggctagggcgtgggaggccagggactggggaatcccagaggaaatatccgacctggcctgcagttagggagggctttctagaggaggaagcaaacgtgtcagctggccggaggaatgacgtgtgggatgccagcaatgggagaagcatggcatagctaaggaccggcagcagccagggagatggtggtgagaagagagggcatggggctggagtgcaagggtctgggggccactgggaggggtggggactgcttgcatggcgggagccagccatggaagggtttcatacagagagggacagggttaaagcaggcctttagaaagcccccctggctgcccgtggagaatggatgggagggtgcgagaggcaggccaggacagggctctgggctggactctggcatggtggtgtgtggggcagagagaaggtgggaggctcagaaggccctgccagctgtggggcgcatgggcaagggcacaggaaactcccagaggaggccgcccggggctcaggtttggggagtgggtccgtggctgagggcctccattgcggagggatgggcctttcctgtcctgtcctgtgggcagcccccgccagctggggccgtttccccagggagtctgggcaggtgtcccaggccctctcctgactggtcctccccatccacctctgccgcccacagatgacagcctgggcttactggagctggaccagcggacccacttcccccagttctcctactcggccagca

SEQ ID NO: 91750 - DNA, 1005 bp, Homo sapiens
aagtgcctgggcacttcttgtgtccctggcctctgtcggtgggcagatgagcctctctgtgcttcggtcttgtcattttagcatgaagtgaatggcagtacctactacacagggttgctgggagggcgacaggagtcctccaccataacgcacagtggtaccagcctctgcaagtggaaggtgttcttgggactgctgttgagtggcaggggtgggggcccctctctgaaaagcgggtgcagatcatggcttacgaggagagttcttcctttgcttttcccgtgggctccctggctgggtgtcccatgagccttccctagagagggtccctgctttaccctcctgagtctcgtgtagctttcagcgcttcactgaggctcagggacaggcgggtggtgctaaggaggagtaggctgtgcacaggtgagtgccagctctgccacatccctgctgtgtgaccttcacaggtgactccacctccatgtgcctcagtccccacagcagaaatgctggctcttgagaattgcagtgctcttgagaatcaagcgaggtggtgtctggagctagccactcagtgctgttatttttacagtcgtggtttacccaggggctctcctctgggggctagaagatacttgaggcccagcttcatggggagctcccctttgccccagacgccatgttgcaaacccttgagaaggatcctggacagaggcccttgcttttcatctggaattctgagtgctgcaaccttgcaactttggtccagttagaattggatcggaagctagtcaggcagcaggcgagccccagttactcccagataacctcctgcattgctgtggtttctggagctttctgtagggtgggcagtgggagccagggtaggtggggtaggcccgcccctgcgagtgtcttcggcaccctcccttccaccccgccctgcgcgcggtgctctgcgccgacagcccgccaacctcttagccccaggcccaggccctggtg

SEQ ID NO: 91751 - DNA, 1023 bp, Homo sapiens
ggcgtgtgccaccatgcccggcttagtttttgtatttttagtagaaaaggggcttctccatattagccaggctggtctcaaactcctgacctcaggtgatccgcctgcctcggcctcccaaaatgctgggattacaggtgcaagccaccacacctgaccccctttttttttttttttgagacagagtcttgctctgttgcccaggctggagtgtagtggtgccatctcagtttactgcaacctccgcctcccgggttcaagtgattctcctgcctcagcctcccaagtagctgggattacaggcacgtgccaccacatctggctaatttttgtatttttagtagagacaggatttcgccatgttggccacactggtctcgaacttttggccttaggtgatctccctcggcctccaaagtgctgagattacaggtgtgagccaccctgcccggcaggacctacattcttaatgagcatctctattgattttgaggcaggtggtccagagagtcattttaaaaagatcaatttagtaatcagaagagatgataaagactcatctatttcaaaattgaaacagtataaggaggtgtctagtgggagcttcccctaccctgccctttccatccacctccctgccccccagttaatcactgttcttaggtgccctcaaagagcagagggagacctttgtgcctggctgcctttttttttttttttttaaatacaaaaggtagcattgtacatgcttctggacttgctttttcccttagtgtaccttggggaatttgccttgatatatggagagatgcagctgctttgtttcatgttttgcttttttttttggacagttggacatgcgtgtcccaagtgtgtttatttagccgttctttattgtgatgactggggttgtttccagcctttggctcattataaggaatgctgcagtgaaatagccgtgtctgtctcgtttgatgtgtgcacaggtagacctgtgtgacgagtgcttagatgcaggattgc

SEQ ID NO: 91752 - DNA, 1049 bp, Homo sapiens
cacagaagtgttttggcattggagctacctgcacagctgtattggtgaatcccagcccatgggatttggccttacagggccacagggcatgtgtgtttggaagcctgggcctcccctgggactaggccaggagctggcacagacagcttgctccttgccacacgctgaggcaactggtgccccagggcactgctgctggcaccttcctgccaggcatgacctgtggatcacccgggctcagcccagtgccccagcctgcgtcagcaggggccacctggagggctcctctgggagaggcattctcgtgtgtcccccgcacctccccgccccgtggtaccccttgtgagtcaccgtcacactgggcctcctgccgcctacctgggacatcactcaaccttgtcctaacctctctccctcccttcctgcctcatttcaggtgaatacatcaagacctggaggccacggtacttcctgctgaagagcgacggctccttcattgggtacaaggagaggcccgaggcccctgatcagactctaccccccttaaacaacttctccgtagcaggtgtgtcttgggatgagtgggtcagtgttctggtgctcacaggatggctggcacgtcttaggggcttgtgggacttggtcattgagccatgggcctgtcctgggcctgcttgcccttggatctgttttcacccttcccctgctctccctccttgttagctggccaggcggggctgtcctgcggggagatgcagagtgggagggagggagaagccagggcatttgcccacacccagccccatgcatcgcctccttgtggttccagcttctgtcagccaggccttggagtccccaactggtggcaggtgcctcccatcctgtgctttggtaacagcctccatcctctgtccctcggacgtagaggggtcacagcttcccactcagctggtcacagggctggcctcgcgtcctctgtccctctgtaatacccaaagggatgtcttccagccagaccctggcagtgaagtttcacaagccccaagctc

SEQ ID NO: 91753 - DNA, 1007 bp, Homo sapiens
tcccagtgcccatctttctgagtagcagctggcagaggtgggcaaggtgaggtgggccctgctgactactgctgttttgggacctgtaccaccccaccgacccccttggtggttaaaataatggcagtgctggtttactgagcacttactgtgtgccagacacctgtctctgctctaggcaagcctgattttgttgaatttttatagatgccctgtggagcacatgccaccttacagactggaaagctaaggttcagtaggaagagtgacttgcttgaggtttcagcaaggagtgggtagagctgaggttggactcaggccctctgactcctgaactagtgctctcaaggcctggcccacgtgctgcctctcacccagcaagctgtgcttaaggccaagggtgtagtaatagcacatctaatcagagtcactcatgccatgtgctggtcccacttctgacacagctgcagcacaccaccattagcagagcacctgccctctgccacgccccatgctgggctccatctgccggtttagaggcagacggtatagtagtcaagatgtgggctgtgctttccaattctggctctcccaggtaacagctgggaaggttgggcaaactaataggacctctctgtgactcagtttccccatccgcaaaataggaatacaattgtgaggatatttttccttctacctgttttttgtctttttttttttttcatagatatatggtcttgctatattgcccaggtgggtcttgaactcctagcctcaagtgagtctcctgtcttggcctcccaaagtgctgggattacagttgtgagccactgcgttcagcttttaggtttcttttcttagcttgttaccaaagtatgaaaggccacagataaatgcctggataataaactcgccccaatcccagtgtacagttcaagaaatagaataagacggtccccggaagctctcccaagtgctcctcccaagcagttaccgctctcctaacc

SEQ ID NO: 91754 - DNA, 1051 bp, Homo sapiens
atgggagcttccagccgcactgggatgatctggctcctcttgggcctgtgagagtcacatccctgcctcctgcctttaagctcccggtgcttaattagcaggaattctatagaattgcactccagaatggtagctactagccatgtatggacttttttttttttttttgagacggagtcttgctctgtcacccaggctggagtgcagtggtgtgatcttgtctcactacaaccgccgcctcccgggttcaagcgattctctgcctcagcctcccgagtagctgggattacaggcgcctaccaccacgcctggctaatttttgtatttttagtagagacagggtttcaccatcttggccaggctggtcttgaactcctgaccttgtgatcgccccccgcccaccccccccccccccagcctcccaaagtgctgggattacaggcgtgagtcatcgtgcccggactcacatatggctttttaagttttaattaattacaattaaagaaaagtaaaaagtcagttctttagttgcactagccatcattcaaacatttagtaaccacatttctgtcgttatggaaaggtctgtgggctagttctgctctggttgcggtccctctcctgcacctactcgctgtgactgtgtgcatgtggctctctccctgggcctcagttttcccatgtgaggaacggggatagtaacacaggctggctgtgaagatgaacattaatccatgcctggtgctttgtgagtgctcactgagtattagccttgatgcagacccactggtttctccttttgccactgggccctgccctggagctcccagggaggtggtggcgatgcagagcgacgtgggtcagggattccccatgcagtccaactggagggctcccgtgcatgcgtgcacatcaggggcggtaaggaagggctggccggggtgtgggaggaggcgacacaagatgggaggtggccctgtctcttgggagcaaaggcagaaggaggtggaggcagctcagggctcggaggagaggggtccgggctccttgg

SEQ ID NO: 91755 - DNA, 1013 bp, Homo sapiens
gtcgcccgggccggagtgcaatggcatgatctcggctcactgaaacctctgcctcccgggttcacgcgattctcctgcctcaagcctcccaagtagttgggattacaggcacacaccgacatgcccggcttttttttttttttttgtattttgagtagagacggggtttcactatgttggccaggctgtctcgaactcctgacctcatgatccgtctgccttggcctccccaagtgctaggattacaggagtgagccaccgcgcccggccgcagggtgattttaaggcctttatgggcccaagttgcattataaaatgttatatcccagattcactggaatatgtacgatgagagcaggtggcattaatatcttgcagtaatgaactaattggtaaaaaccgttttgtttacattaaaatggttcaaaagccagcgacacagcgatgattgtttccatttagcagatgtggatactgaggcacagaaaacggtcaagccttctgcccacagtcaccagaaaggaggaaattcaagtctggggttgtgtggcttcagagcctgagctcaaccatgacgagcacactgaaaaggaaacccctcctaactaactcccgctccggggtcctttaagagcgtcagaacccagaactgagtaaaacaagatcaaagcgtatgtaaatacggactaggggctgccgggaaataatcactacggctaggccctagggaaagcagacgtcggagtcctagtgcgcctgcgtagccccatctcgcctttccgccccacggcctagcgaggcccatctctaacccacacaggcccaaagttgtctaatgtgcgcaggcgccctgctgtgagcccgcctccttctctgccctgctcttgcgctctcgctctctcagagttcgtctctggctctttgtacgtcacttcctgtttgtggcgcgagagggcggtatttccgtccagagggtgggagggggcggtaagcgggggctggggggagggggc

SEQ ID NO: 91756 - DNA, 1832 bp, Homo sapiens
aacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctgagccaggcctgtcctaggagctggtagcaggtagtgagcagggcctctccagggatggggtgtaggtaaagcggtggtgctggccaaggaatctgaggagtgggagaaagtggccagggccgcttcagtggttgtggataggaaggccttgcagaaggggtgacatggaggccaagttgggaatgtggcttcatgaagttcaggaggagagctttcagacagagggacagccaggggcagaggtgctgaggtgggacaaggaacaggaagaaggctggtggctgtgggtgagggtgggccctgcctccagcatgaggcagaggtgggtgggcaggggctaggtggctgggggtgttg

SEQ ID NO: 91757 - DNA, 1138 bp, Homo sapiens
gagttgccatcagagaggaggcctgaatgatgagacgcagcaattccgctgtgcttggggaactgcatgccaggcagaaggaacagcagggaccctgaggaagcgcctacttgctaggtgaggaagatcctggagaccagcatggctgaagcagctccgggaggggcgaagcgaactcagcacgaggctgggtgactgatgggtgaggtgtgatcagaactagtgtggtctagagcctcaggaaaggctcccaggatagggagggatgggctagttcctggggagatgcagcccaccctgcccccaagcatccccatcacgagtaccatgcagttacagggtgatacccgctgaccttctcattcagtctcaagcctcaccttctccatcctgaccctgagactgctggattgaggcctgtcttccaggaccccacccgaccggactctccttttctccccacagctgcctcccgaatgatcaccaacagcctgaaccatgactctccacccagcacaccccccaggcgcccggacaccagcacctccaagatctcggtcactgtgtccaacaagatggcagcaaagagtgccaaggccactggtgagggaacatgggcaggtggtaggaggagctggaggggaacgtgggttggtaggaggtgttgggggtcatgcttccaatattgtaaggtgctttgaaggccacaaggtatacaaaacatttgaacctgaatcacctctgtaaacttggtcaaggtgccatacgtctgtgggcctcactttcttcatctgtagcatggggggtggcgataccccacccaggaggatggacagaagcacctgagttggtgtgttgaggcatgtgtgcattgccttctcactcaggggttcacgctttgtgaacaggtcttcaccgagccccctacttgtgcacagctctgtgcttgatgcctggggtcataggttaagaacctcttgcctcctcttagcagccaagggatccatccttgaaaaccttcagtctgatcctgtaaccccctgggctgtaactctccggggctccccattattccagtaataaaggccatcttccccacatggtctgtagggccctgcatcatgtagattcatctctt

SEQ ID NO: 91758 - DNA, 1024 bp, Homo sapiens
ttgcccaggctggagtacagtggcacgatctcagctcactgcaacctccacctcccgggttcaagcgatcctcctgcctcagcctcctaagtagctgggattacaggcacctgtcaccacacccggctaatttttgtatttttagtagagacggggtttcaccatcttggccaggctggtctcgaactcctgacttcaagtgatctgcctgcttcggcctcccaaagtgctgggattataggcgtgagccactgctcccgtccagggggctattttaaacagcaaaatcaccaacaaaaatgtgaaaaatgttcacattcatgacatcaagtagactgggcaaaggatgcttgtttacagagcgggacctgaaataagagggtgagaatgccttctttgtcctcatttgggaacgtgtctggagcaactcaaaatgttctctgtgtgtgtctgtgaatgacagtgaaagcactgctgtattgattttggggttacaaatacatttgaatgagtaggcaagtttgcaaatatggaatctatgaatgatgagtattgactgtatttatattttttctttttcttttttttttttgagatggagtctccctctgttgcccaggctggagtacagtggcgcgaccttggctcagtgcaacctccgcctcccgggttcaagcagttctcctgcctcagcctcccgagtagctgggattacaggtgcctgccaccacgcctggctaatttttgtatttttagtagacagaatttcaccctgttggccaggctggttttgaacacctcaggtgatccacccgcctcagcctcccaaagtgctggggttataggcgtgagccaccactgcacctgacctttttttttttcccttgagatagtctcgctgtgttgcctacgttggagtgcgatggcacgcttagctaactgcaaactctgcctcccaggttaagtgattcttgtgcctcagtcacccaagtatctgggattacatgtgtgtgccaccatgccc

SEQ ID NO: 91759 - DNA, 1050 bp, Homo sapiens
gcccaggctagaatgcagtggtacaatcacagcttactgcagcctcaaactcctgggctcaagcaatcctaccacctcagcccctgaataattgggactacaggtgtgtgacaccatgcttggctagttttttaattttttctagagataagcgtcccactgtgttggccaggctggtctcaaactcctgacctcaggtgatccacccgcttcggcctcccgaagtgctgggattacaggcgtgaaccaccgcacctggcctattttttcaataggtgaggaggctgaacttcagatatatatatctgaatatactggtcagatattttatagagtgtccctcagtttggaggtatctgatgctttcttatggttaggagtgaaatgtgttagaatcttctctagcagtcaggtgttgatccttgtggtgttgcttagatctctaggttgatgcatgattcttctgtggtgacccaggtgcctgttcttttttcacaggacatgtgcaaagctgccactgagtcagtaccctgcagccctagcccccttgcaggcgaaattcgccgtggcaccagtggtgagtcctaactattcaggcctcttttccttgatttttataccctgtcagtgaaggggacacgtctggccatcccatccccgcctgtaattttcaaaggtagaaacaaagccattggaggaattcttactcttcttttaggggaaaaaataaactgggtagtgaatggctgtacacacagtcaattgtcatctgtggtcattaagttctgtaaagttaatatgtacacttagtgaattcttagctcctagaagaaatacagagcaatggagaatccgttgctcctatgggaaatactaggttaggttcctgcaagcctgtcgtcaaatatatagctttattttatgtgtgtctccttttaaaggcactgtagttaatacataatgttgatttcattaaccgggaactcatagccaacaacactgtaactcattcctgcacaatgcttatctcacacacacatttttttgatc

SEQ ID NO: 91760 - DNA, 1237 bp, Homo sapiens
gccacctgaggatcctatcatcctctgggcctaggctggctgatggggactagggcagagaacccagagtcccagttaccctaaatcagtcatgggcccagcatgtgtagtgatgcagagagcaagcactggggcggggtggagctgtaaggagaaaggctgtggtaaaggtttgggagctctgccccttgtttagcattgtggcttggggtgggttgcccaacctttccctatctcattttcctcatcggcaactcaggcgaatcttaatactgcttaactcacagggtcaggaaggctcagttccatcatgtgtgtgtggagcactccatgcagggcctggcatatgatgagcatttaatttgtgggagctgctgtgattgtggttttgctaatgctattctctaaagaggacagtgtgagtaatgagccctgtccaaccccacagccacttccgagtggatccagttctttaaggaagccggcattcctccaggacctgccgtcaattatgccgtgatgtttgtggataataggtgaggaggctgaacttggggatggggtggtggggagctggctggcccacccactctggcccacctggggcctcaccactgacctttccctgcaggattcagaagagcatgctgctggatctcaataaggagataatgaatgagctgggcgtgaccgtggtgggtgacatcatcgccattctcaagcatgccaaagtggtgcaccgtcaggtgggtgctgtgcccagcccctctgtctctgggtttggcatggaggtggagggtcagttgcagagccaatgggaggcctggcagcagaggcaggccgacccaggttccagggctggttcagccatttgctgtgtgacgctgggcacattgcccaacctctctgagctgtattttctgcatctgtgaaagagaggcaaacctggccgggtgcggtggctcacgcctgtaatctcagcactttgggaggccgaggtggtcggatcacgaagtcaggagattgagaccatcctggctaacacggtgaaaccccgtctgtactaaaaatacaaaaaattagccgagcgtggtggcgggcacctgtagtcccagctacttgggaggctgaggcaggagaatgacgtgaacgtgggtggcggagcttgcagtgagccgagatcgcaccactgcactccagcctgggcgacagagcgagactctctcaagaaaaaaaa

SEQ ID NO: 91761 - DNA, 1019 bp, Homo sapiens
gagtccagacacccggacgccacccgtccctaccgcaaccggcccagtcccaccacccccggcccgcgcctcacctggcccaccgggcccgcgcccactcgcgccgcccgccctccctcccggcggcgccaactgtcagacactcctcccccggcccgggctgcccgccccggaagcatcctctcaccgccggaagctgaactgactcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtgcgtgtggggctgggtctcggagtgggagacgtggagtgcaggtactgtgcgatctgggggcgcggcgcctcggctaccctcctcgtgttgtcttccacgctataatgcatggaatataatatatattatatggaatataatatatggaatataatatatataattatagcgttgtcttccacgctataatttatgtcgtcctcggtctctttatgtcaccattcctctccttctgtctcatcccacttaaatcctcacaactccttctgtcgccatcaccctctttaaatcctcacaactcctcttgttgtcatcaacgcccttaactcgctttcgttccctgtaagccctctttgccaccataggtcgtaatcgctccctttaaattcgtcatcgccatatgttacctgcatcctgcttttgttgccatttctcctttataaaatcctcatttctctttaaaccctcatcatacccccaagtcaccttcgcatggctactgtccccatcgctcttcttaaatcgcgctaatgcaactctt

SEQ ID NO: 91762 - DNA, 1024 bp, Homo sapiens
acgaggtttcaccatgttggccaggctggtctcgaactcctgacctcaggtgatccacccatcttggcctcccaaagtgctgggattacaggcatgagccaccgtgcccagccgcctagccaattttttaagtttttgtagagatggggtcacaccttgttgccccaactggtctcaaactcctgagctcaagccatcctcccgccttggcctcccaaagtgctgggattataggcataagccactgcgccctgccaatatggctaatactggtttatagatgaggccagcagggctcagaagtaaagccccatgctcagcatcactcagcaagaaagtggcagaggtgtgatctgaaccatgagctctccaatttaaagggctgctgtagaggaggaatcaaatctcccactgccaccctcccctgggggtggggtgttcagggatctgtgacccagtgggttttacttcctcctttttgcgggctatggtgtcatactccaaggggggcaggaccacaaggcaaggggactagggggtattctgtgggctgggagagagcacgcttcctggcagtgccctctcccagatgagacctgatctcttttttgttttttgttttttgttttgagacagagttttgctcttcttgcccaggctggagtacaatggcgcaatcttggctcactgcaacctccgcctcccaggttcaagcgattctcctgcctcagcctcctgagtagctgggattacaggcatgcgccaccacgcccggctaattttgtatttttagtagagacggggtttcaccatgttggtcaggctggtcttgaactcccgacctcaggtgatttgcccacctcagcctcccaaagtgctggattacaggtgtgagccactgcgcccgaccgagacctgatttcatctcatgtcataccagcaaggaggcagagcataagtaccaacctggatggggcgcgctgggagccccatggaggttctagggtcctgagaatacaggcat

SEQ ID NO: 91763 - DNA, 1074 bp, Homo sapiens
tggtggcacgtgcctgtagtcccagctgcttgggaggctgaggcaggaggattgcttgagcctgggaagttgaggccgcagtgagctatgatcatgctgctgcactccagcctagggaacagaactctggcactaaaaaaagaaaagaaaagaaaagaaaataggcttacaataaaaagcaatcttgacctaccccaaaatcccactcccttgaagacaaccacttctgccctgttgcttctctcagtaatactccttttctgcagttatctcttgacttcctgccatgtgtgtttgggggagcttgagggaagagggtgtccctgtctcattgagagaggtgccaccctgccgtgaaaagaggtgccaccctctgtcaattaggagaggagggatgagagaggaaaggggtctccagtgtatttctccagccggggccttaaatccctcttgggagatatgggatggggtggatcggaaaataaatttttttaaatccctaccaaaatatcagctggctttttttaaaaaatcaaataccaaaatctaaatagactccaacagaaaattcaccatctcctctgaccttttcttcccatctcatgctgtgaactgtcttctgttgactttatcgctacctttcttcattctgttattcaaccatgatctctccgtttcattttataagcgttttattaatttcatttatgtatttatttttgactaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcaga

SEQ ID NO: 91764 - DNA, 1050 bp, Homo sapiens
ctaatcactcttctgtgatgtctgtccctggaaagcgtagaacaccccacacagtgcccacttttgttctgccagtttggagaccctgacacacccaccttctcacctgggctctgcgtatcccccagccttgagggaagatgaagcctaaactgatgtaccaggaggtaggtggattggggggctcagcagggtggaactgggtacagtgggggtgggggttcccaagagccacctgtcacccccgttgttgtccccatccccagctgaaggtgcctgcagaggagcccgccaatgagctgcccatgaatgagattgaggcgtggaaggctgcggaaaaggtaggagccctccgccaccctcgctctgtctcagagacaggctgggctgcccccctcgggctggctgaccacctcctcctccccacagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgagtaagtggggggtgctgcagttggtgggggaggggcctgccagaccaggtacacttaagcacacactaaacagggcctgcactcagccctacccagcgcttgcgacaagtgaggaggttgcaggctcccaagtgctcgcccgccccctcctcctccacacacatagtttctatggcagccacagcgtcatcttctgtcaggcctgtgaacagacacagcatcttccacccacatctgtggacccacacacacatctcaatacacgaccttccttccacacctctagacagacacgcagaggatcatgagtccaggcacgcattcaaatacacacagttttaaaaaattttttttaaaagaaaagaaaaactcaaatacagtttagctgggcttggtggctcacgcctgtaattgcaacactttgcggggctgaggcgggaggattgcttgagcccaggagttccagaccagcctgggc

SEQ ID NO: 91765 - DNA, 1277 bp, Homo sapiens
agttcgctgagaagaggcctagaacagggcctggcacacagtaggttccagggcatccttgactgttgctgttgttggcatcatcgtgcctcacccgataccttccaggaccccctgcctgagcctcgcccccaccatactgggagatgcctggaggccctgccttgatgctgaattttgagaaagtccctggaggggcaggaggggtcaggaggacttggagggggatcacagggcaactaattattaaagcagataaagatgtttaaaacagataaggaagtcttttaatattttaatctgtaaagtctttaatctatgcaggctaatgtaaagtctgtttactcctaatcatgtctcaaaataactccaccgggcattaccttgtggggttggagagctggctggtccagcccctcagaagctctcccctccccgcagggtgaggaggtcctccggcagctgcagaccctggcaccaaagggcgtgaacgtccgcatcgctgtgagcaagcccagcgggccccagccacaggcggacctgcaggctctgctgcagagcggtgagctggggcccaactggggctggtctgggcctgggggtacccagcctggcccctgatctctgcccctgctggtcacaggtgcccaggtccgcatggtggacatgcagaagctgacccatggcgtcctgcataccaagttctgggtggtggaccagacccacttctacctgggcagtgccaacatggactggcgttcactgacccaggtctgtctgcaccctgtctaccttccttccaggccactccctgccccacagggcacccagcctccgactgcatccctcactcaatccagagtcctctccacccattctctgtaatggcttccttcttgcctcctaccaggcctccctaatccaagccatgcacggtggctcacacctataatctcaacactttgggaggccaaggtgggaggattgcttgagcccaggagttggagaccagcctgggcaacatagtgagaccccatctctaccaaaaaaaaaaaaataagcccggtgtggtggcacacacctctggtcccagctccttgggagactgaggtgggaggatcacttgagcccaggagtttgaggctacagtgggttgtattcatgccactgcactccagcctgagtgacagagtgagaccctgttacaaaacaaagaatccctaaatggagccctctactgccctccccctgctcctggaagcctggggctccctctg

SEQ ID NO: 91766 - DNA, 1050 bp, Homo sapiens
cctaacctttaatctcagcaattatgcagggagatgctgtagatatagctgtgactgagacatccctagtgcctgtcctcccagcccaatgggaagaccagtttgtcaccagaaagaatgaggagggaatcccaagggactgtgagagcccagaggaatgcctggtgcaggctgggtagtcatgggaggcttcctgaaggaggcaacatgtcagcctagacctaagaatgagtagaagctagctcagtggagggtagaagcaacagcagattgcaaacgttcaggaaacctggagctttggaataactgattttcatcaaaacttaagttgataatcattctaggactttagctattggagctggggtggagggggtactgtgggacagggggaaagacagagaccagactggggagtgtccctgtcatctgtgagcactaggccgctatcgctgagctcagcactgccctcctacaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcggtgagtctggggcaagtggggcctgtcatgtcccagccccatgccgtcactcacagcctccatctgtccctgtttggtgatgacagggagggcgtatcctgaccatcagttctcaccccagctcattctgcttggtcaggggcctggagtagttcccaacatccctcggcctctatttcagttagaaaatgggtattgtttccaacctgttagggctgctgggagaggtaccctgggttcatgcacaccaaacctttggtgctctatatcatccagtatagccacaggtggctctttcagtttaagttaattaaatgcaattaacaattcaggccaagtggggtggcttatgcctgtaatcccaatacttt

SEQ ID NO: 91767 - DNA, 1023 bp, Homo sapiens
agcgcatgcctgtaatcctagctacccgggaggctgaggcaggagaatcgcttgaacccaggaggcagaggttgcagtgagccgagattgtgccattgcactccagcgtgggcaacaagagcgaaattccacctcaaaaaaaaaaagaaagaataaaagaggatgacaacactgggttttggggagcaggaatgggagccacagccaggaagaggaaatagggatgtgggatttatggagacaggaacagggtctgggagccagcgatgaggaagtcctctcaatagctaaagcagggcccaggcttggttccccaaagctgagggcaaagcctgtggacacagccgccctctgcatcctgccccacctcctatacacccgtcctcaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtggtaagtactgccccaagccaccccttggcccctgtgtggggcagtcctagggacacagccctcatgggactcgtctgtcaatgacaagggcagcccagagtgagccctgtcactgtggggaaaccatgggtcagggccagggtcatggggcacagggagaggggccaggaccgggatgagggggcacaggcagaggggttgggaccgggatgggggtgcagagagaggtgttgggaccaggaatggggacatgggcaggtagaggggtcagggctgggattgggagcacaggcagaggggtcagggctgggatggggaggcacaggcagaagggtcggggccgggttggagggcacagagagaggggttagggccagggttgggggcacaggcagaggggtcggggccaggatggaggaggcccaggcagaggggtgagggctggggtggggggcacagagagagggtt

SEQ ID NO: 91768 - DNA, 1040 bp, Homo sapiens
aggcccaggctcgaatcccatatgcccgtgtcaaccacaacaagtacatggtgactgaacgcgccacctacatcggtgagtgtcttgagcaccacggggcgctgaagaagagggggttcagacaccaggggcggccccccgagggtgcccttatgctccacccattcctctctaggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacagcctgtgcctgactgagtggtgtgagatggggtgcaggggtaggggacagctggcatgggcctctggtggggacatctttttgtgctgagccctcaacatgtcactggcatgtgctgagccctcagtgtgtgaccagtgtgggttagcatgtactgagccctcagcatgtgctggcatgggttggcatgtgctgagcccttaacatgtagtgtacatgggctgacctgtgctgagcatgcagcgtgccaccctgtggcccggcatggacttagcactcatgtagccagcatgggtatgtgctgcagagaagcatgttcccagattgatcagcagggaccaaaccattgccacatcccaagggtga

SEQ ID NO: 91769 - DNA, 1103 bp, Homo sapiens
tactaagcatcaactgtaggtatgccagcaaaaatgtttgaaggccacggcgcagtggctcatggggaggctgaggcaggcagatcacctgagcccaggagttcaagaccagcctgggcaacatggcaaaaccccttctctacaaaagattgcaaaattagctgggtgtggtggtgcacactgtggtcccagctacttggggtgctgagatgggaggatcagttgaaccccggaggttgaggctgcagtgagctgtgactgcaccattgcacagcagcctgggcaagtgagcaagaccctgtctcaaaaacaaaacaaacaaaaagaaaaaaccaaaaatgtttgaagaccacttccccagaacagaggaggggatggatttgagagttcatggtggcttctaggacccagctcctggagcccaagagtgccagcccactgaccaggctctctgctcctctttgcccacaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtactgagccccccctctgcccacggccctcccctacacctcggcccccagcgccacccccgcccccggccccgcccctgccacccctgccgccgccgccgcccaccagtgacagccactctctgtcccctctaaggtcccacgacagtgatgtccgagggcgcccggaacattgtggcagccatgaaggctcatggtgtggacaaggtcgtggcctgcacctcgggtgggtggtgggatcatggaggtggggctgaactggggggtactggggaggcagcccaggggcctctgaaaggtgacgctgaagccattccatgttactgtgcatttactgaacaccagctgtgtgcctgaaccttactgggtgatgctggggacacagtggtgacctgtacagccctgggccctgctcacacaaggctcacagagagaggtggtaaacagatccatgatcaaactgacat

SEQ ID NO: 91770 - DNA, 1035 bp, Homo sapiens
taactttctccccttgctggttctgggaggccctggggcttagagtgcgccccagatccgctccaggctccgggagagggggcgtgagctacgagaggccgtgggtgaggctcgcctggccccgcccctctccgggaggtggagcgcggaggcagggcgctgagtgacaagttatctcggctccgtccactctatttgttgctatgtggaggcgtggccttctgtggccccgccttccagtctaagtggcgcgcagagagggcggtgctggacggtgagcgaatgcaagctgacgcctgccccgcccatccgcgttaggccccgccccttgacctgagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggcatgagccggggcgggcggggcatgtcacgggacagacgggcagaactttaggaaggggcaccatggggtcgggccgaggctgattggggccatgagcgccccagccaggtgtatgaggactcaggggccaaagcaagtggccacgggggcagaaatggggaaagatgtgagatccaagtttatgtgagtccaagccagagaggaattggccccgggagccccgggaggactccactggcacagtcgtgtgtaagtccagggctcttatgcaatgcggttgtcattattgtggttgtggtggtggttgttcgcactcccagagaggatttactaagccaagcttgctctgtcgtctcttcacatgagagctttcaaaatggggtgggaactagtatcaccctacttgacagatgagaaaactgagacccagagagtgacttgcccaatatcacacagctgttaactga

SEQ ID NO: 91771 - DNA, 1043 bp, Homo sapiens
aacaacggggcggagctggctcgaagggccacgcctcagactctccgcccgcggctcaggtcaaggggcggggcctaacgcggatgggcggggcaggcgtcagcttgcattcgctcaccgtccagcaccgccctctctgcgcgccacttagactggaaggcggggccacagaaggccacgcctccacatagcaacaaatagagtggacggagccgagataacttgtcactcagcgccctgcctccgcgctccacctcccggagaggggcggggccaggcgagcctcacccacggcctctcgtagctcacgccccctctcccggagcctggagcggatctggggcgcactctaagccccagggcctcccagaaccagcaaggggagaaagttaggaggacagagtgtgtgtgtgcacttggatgtaagacactgtgtcacggcgtacctatgcacttatatgaccctgtgtgactcagtgacccggagggcaagcaggactgtgggtgacaccttgtgtcatcctctgagtgtgatcccgtgttacagtgtgactacacgtgcgtgacaccacgtgtggcaggcattgattctgttcttttgtgaccttgtggtgacaccgtgggtgacactgcgtcagcctgtacgatagggtgtgggacgtgtgaggtgtgctacatggaagcgtgagactaattagactgtgacagtgtgtgacaccacatgtctcgtgtaaggatgtgtgacaccgggaccccattcgagtgtgtggctgtgggtgtctgtgttgagctgctcattgtgaccccctgtgactatgatgtgtgaggtgcggcggtgcagcatgtgcggggcgactgctatgaaggttcgagtgtgtagagtgtgtgacactgtggctgtgaagctgtgcgtgatgtgtgggcctatgacactgtttgtgactgccggggagtgtgcggctgtgtgtgacaggtgcatttgtgtgtgacgccgcgtgggcggtggttaccctattggatttgtgtggtggtgggtgacaccg

SEQ ID NO: 91772 - DNA, 1362 bp, Homo sapiens
agaggctgggcgtggtggctcacgcctgtaatcccagtactttgggaggccaaggcaggtggatcatataagatcaggagttggagaccagcctggctaacatggtgaaatcccgtttctactaaaaatagaaaagttagctgggcgtggtggcgcatgcttgtaatcccagctacatgggaggctgagacatgagaatcgcttgaatccgggaggcagaggttgcagtgagccacaatcgcgccactgcactccagcctgggtgacagagcgagactctgtctcaatacatacatacataaattaattaaattaaattaaataagttaaattaaattaaataaaataagcagcaagtagaagagaaggagcccacaaaggaggctgaaaagaagggtggattgagaattaggagtagaaccagtagaaggtatttcataaaaccaaggtccgcagggttcgggtgtctgagcatctccatcctcctgcagattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtaggagggcctggggctgggagtccctcccatccttcccttccacactcacacagccatggacagcaagatgtgcaatctcaaacccctggaatcataatggccacccgataaatcaacaaaatgttgaccaaaaatcataatccctgatactggtgatgacgtggtaaaattaaaacaacatttcagttggctgttcatttatttgtccagaaagaatgtattggatatctacaatctgccaggagtattcccaagcactttatatacctttctaaagtatcccaacattcttccgggcacagtggctcatactgtaatcccagcacttcaggaggctgagatgggtggatcacttgagctcatgaattcaagaccagcctgggcaacatggtgaaaccccgtctctctctctacgtgcgcgcacacacacacacacacacacacacacaaaatatatatatacacacacatatatatacacacatatatacgtatatatacacatatatacgtatatatacacatatatacgtatatatacacatatatacgtatatatacacacatatacgtatatatacacatatatatgtatatatatatacacactatatatatgtatatatatatacaaaatttagccaagcatggtggtgcacatttgtagtcccagctacatgggaggctgagttgggaggatgccttgagcccaggaggtagagattgcagt

SEQ ID NO: 91773 - DNA, 1059 bp, Homo sapiens
tcattctctccctgcctctctggctccctctatctttctttcctgtctgtctatccctctatccttgtctttcttacggtcctctccccatgtttctgattttctgtgcctgtctctctgttgatcactctgtgactgtttgtctctccctgactccttcccatgtctctgtgtccatctgtctctccctgtatctttctgtctccctcccctcacttctgtctgtctgtctctctcttcttgtctctcttccttggttccttccatttctgggcctatctctgcatccacccctcatgtctctctctccctatgtgtctcccactccctgcctctgattctcttttcacatccttccctgtgtcctgtcactctcccacacttctctgattctccccaccatctatctatcttctccatctcctgccatccacccacttggggcaggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcaggtatggtcttcctggcccagatgagggctccctatgccacatgggggccaggtcagggtccaaccccactcaaggtatgtcaagtggaggggatttaatacagggatttatttcaaacttgtagaagatgagaaagggaatattgaagcaatccagctagtaataactgttggaagcagccaccactccctaaggtatggagtacaaagggaaaaggaaggatctagagccacaaagcagtaggtaaatgactagcatgctaaaggtttcacaggaccctgacactcatttcctggatggagaaaccaaggctcaggggtatgggaatggctttgcatggaataacaa

SEQ ID NO: 91774 - DNA, 1050 bp, Homo sapiens
ggcccatcttgggtcggcaagcggcttggctcagagcacagtctctggaaccagcctcctgtgttcaaatcctgtcactccttactggctgcttgttcttgggcgccgtacttcgcccctctgtgcctgttttcccacctgcagcaagcatagggttatgatgagtgagggagtatcagcaaaatgtttacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcggagggcctgggggcgctggagccgggggccgccgctgccgcctcatcgtgggcgctttgtgcccccaggacgaacagagcaccctgcagctgctcaagaaacacctgcagctggagcaaggcgtggagaactacgaggaaagcatcgcgcagctgtcgcgccagtgccgggcgctgctggagatggggcacccggacaggtgggcgggcgcgtggccagttcacaggaatggtccagcaggacctgaagcttcgctgttgggagttggcgcagcgctggaattggacgttgggtgggagaggtcctccttgctgtgtgctggagccctcgaatttggcaagtgggcgggccggaatggggggacacggctcagggatggttgagagggtggggccaggagcacctggatttgagtgta

SEQ ID NO: 91775 - DNA, 1027 bp, Homo sapiens
cgagatcgccccactgcactccagcctgggccatagggtgagactttatctcaaaaaaaaaaagaaaagaaaagaaaagaaaagaaagtaagtgtcttgaggtggtatgggatgtcagcctcaaggatttggggtcaccaggagccacatgtatggggcaggctgaggaggctccctgtggctcagatccctgcctgccacccactgcagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgaggtggggagcagggagggggtccccctctgccacccgggcacattggggtggaagccattccacaccctgacttccctcccacccacctgccactcccagatccaggcacagctggacaagctgggaaccaggaaggaggaggtgtcggaaaagtgggaccgccattgggagtggctgcagcagagtgagtgggggcccaggcacacgtggttcaagggcacagggacatgctccagcctgtccagccaaggcccagagggtgacaggagcatgctttgcaccctacccatgggtctccagaagcaaacataagggcctggaagggtggacaagggggctgccttgccattgaatacccacccttgaaaaaaaagtcttaaagtcctgggtggggggacattaaggaaggaggaatgggagtcagaaaggaggaatgatgcccactgaaatagccccagcctctgccattcctgcagagcccaggatggtcagggctcgggtatggaaagccggaggggtgtggaaggccaggggaacagccattgcccccaggaagggccccagatgccccagaatccttaccctgcatgcccctcctcagtgctggaggtgcaccagtttgcccaggaggcggtggtggctgatgcctggctgacagcccaggagccgctcctgcag

SEQ ID NO: 91776 - DNA, 1068 bp, Homo sapiens
cttggcagagagcaaagcatcgcacaggcctggacaccttgctttttcaaggaactggtcaattgagtgatgaggcagaaaaacccaggccgcctccccggacctcccccttaccccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccagaaagtgaggggaggggaaagcggagagctcctagaacccctcaggcccagtgaaagggcttcagggctcagaacttcccaaagaaggagatatcgccgcggtacccattttgcagaggtgtaaactgaagctgcaagataatcgatgtgcccattgttacacagaaaggggagcccttcctgttgaaagaaaaggcagactgcctttctccagacgtaggttctcggcccctgggttgtgactcctgcatcaagtctccc

SEQ ID NO: 91777 - DNA, 1053 bp, Homo sapiens
aacctaacctcttagcaaccaacccaggagttgatcagctaaatagcaaagagggaggcatctagttgagaaggtttcaatggcttgtcgtggagcttggagaggtcactcaaccaatgagtggggtgggtctacccttgaagtttcaaattgggggagggtccgaaaacgggcagagcccaaactaatgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgttttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtga

SEQ ID NO: 91778 - DNA, 1073 bp, Homo sapiens
gacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcct

SEQ ID NO: 91779 - DNA, 2024 bp, Homo sapiens
gagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgc

SEQ ID NO: 91780 - DNA, 1078 bp, Homo sapiens
atgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgctt

SEQ ID NO: 91781 - DNA, 1418 bp, Homo sapiens
cgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattccca

SEQ ID NO: 91782 - DNA, 1028 bp, Homo sapiens
caaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctaggcatgatggtgcatgcctgtagtcccagctgctctagaa

SEQ ID NO: 91783 - DNA, 1069 bp, Homo sapiens
ttttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgacggggaaagcccaggggggttttggaggaggcgcctggcccagcatgagaagaggattagggagttcttcctgtaggagacgacatctgaactgagagctgtgggatga

SEQ ID NO: 91784 - DNA, 1477 bp, Homo sapiens
tccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagc

SEQ ID NO: 91785 - DNA, 1057 bp, Homo sapiens
ttattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttctccaagtctaccccagtttgtgctttgagtcactaaatgacattcccttcccttctgacccctagtttcgtctgtctctctgcctctcttggtctctgtcttccttctctctctgtctctgtcgttctatctcatctctgtctctttctgatttgttttctctgcctaacctctacatcctgtcttttcatttctgtttctgcatgcgtctttctcttttcccttctctttgtttggttctttcatctcgagagcaatcttgcctctggattttttttttttttttttttttttttttgagatggagtctcactctgtcacccaggctggagtgcactggcgccatctccatccactgcaacc

SEQ ID NO: 91786 - DNA, 1006 bp, Homo sapiens
ttccccaccagcagccagtgaacccatgtggtctggcccactctcttgctcctggatgccaaatctgcatcgcctacccgttatgtcctcggggattgatgtgggagggtgttgagctgtatccaggaggctgggctgctccaaaaggtaaccggtgagcagatgccaacccttgttgagagtgacgcacgctccctccatgcctgcagcattcctgggccatcacacaccctcacatttgctgtccttaacgcagcctgacatcaggcacactccccaggctgtcacacgtgctcctgagaggtggcaggagctccaggctttatttggaagcctcacactcctgtggccagctgcacgcttatttggatgtgacttgccacacagaaatttcacatactcacatagacattgcacccccccacacacatgtcacacatgctcagaagtcacaaactcacagtcaggtatactctcaagtcacacacactccaaaatcacagagtcagaagtcacacatggccagacgtggtggctcacacctgtaatcccagcactttgggaggctgaggcaggaggatcacttgagctcaggagtttgagaccagcctgggcaccacagcaagatctcatctccacaaaaaaattttaaaaattaacctttattgttaaccaggtgcagtggcatgcacctgtagtcccagctactcaggaagattgcttgagcctgggaggcggaggttgcagtgaactaagattgtgccactacactccagcctgggcaacagagcgagaccctgtgtcaaaaataaataaataaatatttttaaaaaagaaacacactcagatttacacaccttcacagaccacacacccagatttatgcaaactccaaagccacatgtgcagatccatgcacacctgcaaacacactcatacatcacacggcagatgcactcacacctgggagtcacgcatcaggacgccacacacccggaccccagtc

SEQ ID NO: 91787 - DNA, 1029 bp, Homo sapiens
ctttcccctgggaaactcgaggcaacagtcatcccacctgcagatgagggagctggggctcaggtaccctaactcccttcagtcattgtggggactggcccaggctctttctagctgctttagggtaggcaaagcagctttgcatggcctgtggccagtcctcacgcacagagatgcaaatactagctctcgggaggaccacggtgccgggttagggcccaggggtatagctagactggaatcactactacgtgctgtgcttcagtttccccatctgcatgtctagaccaggaatggggtctccaccttgtagagttgagatgcagaataaatgattgcatacacatcatgtgcttaaaatattgtctactgcatggcagatgctcagtggacactgagaatgagtgattactgtgctgtttcatgtccccccccccattccctccaacccaagtacctgggtcacgtggaggtagaggagtcccggggaatgcacgtgtgtgaagatgcggtgaagaagctgaaggcggtgagtgagggggctgccatgagggagggggcaaggtcagacagggagaggcaccctgacccggctcctttgtccccttgcctccctccagatgggccgaaagtccgtgaagtctgtcctgtgggtgtcagccgatgggctccgagtggtggacgacaaaaccaaggtaggaggcctgtgggggtggacgccagggggcctgtctgctcaccctgctggaatcagggcggaggacaccttcccgcctcctctgcacatccctccctcagggaccttctagacgatgccgtgtgctccctctgtcgtcataactcaggaataaatgctgtgattatttgggaactggcataggctgtgggtgagagagactggagcagctgcctcagctccgatcccagcttagggaccctgggcatgagatttaacctctctgagtctcagttgtgtcatctgaaaaatgcagattataggccgggagtggtggctcacgcctgtaatcc

SEQ ID NO: 91788 - DNA, 1984 bp, Homo sapiens
ggcagaggttgctgtgagctgagatcatgccattgcactccagccttcattcgcaacaagagcaaaatttcgtctcaaaaaaaaaaaaaagagacacactcttgcacagtctgacaacacacacagacccacatttctacagacgacagccacactttcacagacagcacccgcgggcccaggctctcacagggagctacggttgtgtacaaacatgcacacagtctcacaaagaacacccagcactctctcaggcaacagtcacacccttacaaataaccctcatgaaaacactctcaaagacaacctcatgttcccacacaccctaacggatgcaccactgcacacagatacaccctctgtgcaatacccacacacccacactctaaggcaacagccacagtcacacaggctcaccgccaacagctgcactcttggacacagacagtcttgtagatccctcagatgcactctccgaggcaatgtcatcacagacaatagccacaccttcacacagagacatagctacatggataacagccatggacacaccctttgaaagacgacagcctcatctcaaacacagacacaccctcacaggcaacaggcactgagccacaagttctcatagacaacaacggcactctcggatatagacagcagacacacactcacaaccactctcagacatcgatgcccttcagcaacaaccttcagggcctcagactcacagacaacaaccacacttttggatgcatccctcacggacagcattcacagatgcacactatcctacaccattctcagacatgcgttcttccagacagccttcagaaacacactcacagacattacttgcctgctcagatatagagcccctcatagacagcgttccagaacataccattgcacacttgcttacacacacacacacacacacatccccctctgctgttggtgctcccagtcctgggactgtcaggatggctgatcagtgaagactgtcctagtggctggccacctccacacccactccacacacccacagccctgcctctgacagtcatcagtgcaaggccccagaagccttgcctggggactagacacagttgtcacagaatggctgtgtctcagagttccagagacaagccaccatcccccataccccatgcacctgactcctgcacccctgacccatgcaattcccaactcctctgctgccctctgatcaccccactgcctgactctcatacccctaaaacccctgaccgtgcggcccctgacttctatgccctctagcccccatgccctcctacgtctgatttcccaccctttgtgtcctcacggccctgggaatgaggaagcatccaccacatggacaagaagccctccaatgccctgaagcctgtgccccataccccccaccccagacctccagccccttagccccatggttctgaatccccagtgcccaactttcgcactcccctggcttctgttggctcctttcctcactgtcccctgacttgagctgctgatcccatgtgcgctgccaactgaccctgtaaccccgcttccagttatcttgttatctgaccccatgctccctgagcactggtccctccccgttgagctccataccttctgacccccacccttgacccacatcactgtcctgtgtcaccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcagggtgagtgggcgcggcagggtgcggcggggcgagggggacgggggccgctgtgctgtgctgtgcgggtgcgcggcctggctgggacaccagcccaagtcgtttgaagttggtgttaaaaagcgtgaggccggcagtcctggctatcacggtgaaaccc

SEQ ID NO: 91789 - DNA, 1038 bp, Homo sapiens
tgaccagatttgagcacctatgactgagtatgtgtgaccacgtgacagtgtgtggccaaaaacagtgtgttggtgtgactggtctggttgaggctgcatgtggtctccgtgggaccaaatgtgtgtctgtccgtgtgcatctgtgaccagatgtcagtgtgcagcagtggagatacgtgtaacaagtgtatatagctgcgattgtgtcgtgtgggactgggtcagcaaatgggtgaactctgggtgtgattctatctgggtgggcctgtgacgtcagtatcttgggcgggtgcctgaggaaacatagctgtcactgggtgtggccacgcatgtgcggctctagtgggttgtctgggccccgttctttgtatgtggctgagaatgtggaagtgaccaaatttcagtgggtggtgtgaccaggtgtctgcggtgggaactgagtgggccaggacatgctgcatgtatgtggacaaatgtctgtagtagagactgtgtgtgtccgaacatgaatatgcggccagatgtttacagtggcagctttctgggtttgggactgtttctgtgtatctgcgatctgaggtgtgtagctgtgattgcgtctatgtgtaaccaagtgtgtaaagctgtggccagatgctagggacacctgtagatatgagttggctgcgtatgtgtgtagccctgcacatgcatctggagggcaaggccactctcacagcatccccttgggcagtgaggctctcctgaggccagcacatccccaacatatgccccccaaacatacctactccttcctgggcccttggaaccaggtggctgatctccctggtaacagttgctaggacaactaggactctcatcagggagcccaagatggagggggctggccgaagtccaaagtcggggtgaagtatcagactgagccccaacccagacaaacttctcaccttctcctcccctactcgggcagggcggaccccggaggcctgagcggcacctgcccccagccccctgtggggccccggggcccccagaaac

SEQ ID NO: 91790 - DNA, 1593 bp, Homo sapiens
gtacggtctcgaggatggggtcactgggtacagcgttcccaccacgccaaggcctagggggactccaagcacagcctgcccccaggtctcagaggcaccctgggcacagcatccccccaatccttgggcggagtcccaggcacagccacttctcaaaacaaggtccctgtgcctgggactccaccccaccccagcctgaataaaataaggacaatttcaggcaacccccaatccctccaccccctggcttggtcatgggtcccagggcacaggatccctaggccaccccctttgtccccagggctgcccagctgtccaagagtggccccacccgcagacaatgcaccgcttccccctcctggacctggccctcaggctccaggatacaggctgggctgggggcggctccccagggaccgggtgcagccctgtctgtctgcagtgtctgcggtgacggtgacggcggctttgtgtgtggtacctggggggaaggggggaagcaagcgatggggaggtggctaggagtgtgccctgtgtttgtgtgactgtggctgtgtatgtgtgtgtgtgtgtgcacgcgtacgctgcagctggtgactgaggaatcctgtgtcgtgtgtgtgtgcttgtggtggtgtctatgattgtgtctgtgaccctagtatctgtgtgactgtgtatgtgtgtgtgacagctgctcactgtgcagaatcctgtactttttagtctgtctgtgtttggaggtgtgcatggttgtgactgtggttgtctgtgattgtgtcttttgtgaccctgtgtttgtatgcctcggtaactataactgggtatgtgacagtatgtgttgagtctgggggtgggcatgcgtgtgactgacaggacgtgggtggagttgtgactgtgtgtgagtggagttgtctatggctccatgtgcatgtgtgaccctcccagtgactgacaatgtttatagttgtgtctctacctgattttatatacgtgagtgacacacacctgtctgtgcaactctgcctgtgtgactgccattgtgtctgaagtcacattgtatctgtgtgactggggttgtgtgacagtattgtgtatgacagtggttgcgtatgcagaaccatgtctgagtgtgtgactgaggttgtattaatataaatgactgtatctagcagtgtgtgtgataacgagtgattgtgtgtatttctagccttgcatgtgtgatttgggttatgtatttgacttggtgtctgaaaccctggctatttagagggattatttgtgtgtgactaaagctgtggatgtgtctccgtgctggtgccaggaaattatgtttgtaggggtgtgtatatgattatggcttccatattattgtgtttgacctgcatgtctgaccctgggtgactatagatgtctgtgtctatgtcatcatctgtgagagtgtggggtctgtagctgtgtgcctgtttttgtctctgtgtgtatgtgctggactacctgtgttagaatgtgtgatttggtgatgagattggcccctgactgtgcacatggctccgtcaggacctgtgtcttctgtgtaaacccagctataaa

SEQ ID NO: 91791 - DNA, 1050 bp, Homo sapiens
tgggtcacaggcctagagtaggagctgtgagggacagcgcgggagacaggagagagagggttggcaggagaaggcatccaccagtgggcgctcggggcccttccctggctgacacacctcccccacaggcctgtttgccgagcagagcctgcaggccttgcagcaggagctggcttgggagtgtgactaccgtcgtgaggcggcttgtgcccagaatttcaggtgagctgagtgccctgagcttccctccttccctccctcccaggctgggtgggaagtagctgccccctcagcttctggcagctggagctgtggggtagggcaaactctctctttctttcaatcattgttcatccatccttccactcatccatcacttcgcttaccccctttgtcctctgtgagcttgggcaggtcacttcccaagcggcagtcttctcctgtgtcagatgggccgcatatccactgtggtccgacacaggcacttaattaattacacaatgacacactcttacctctgctggactgacggagagcaaggagcccacagcactgggaggtagagagagtgggctccacagcatcccttctgcactgcaggttgtgggagaaggtggtagaagcattttgagaacaggttggcatcatcacataagcccttatattcaagaactctgcaagccaacgattgccctccctgctgaacactctagggacccttttgccagtatccatcatcagactgttctagaacgcttgtctgcaacagccccaaactggaaacaacccatatccatcaagtttatccagcagggtggacaaataagcaacggtatattcatctgtggaatattacgtagcagtgaaaatgcatgaactatggctacgtggaacaatgtggttatatcttggaagcatcctgatgtgtagcaattaatggcacctcagtggggtcctccacagtgtggctcacacatttattgacagcctaaaacgtgccaagctctgtagacagagagtgaaagctcagtagaaggcagtggttagagg

SEQ ID NO: 91792 - DNA, 1491 bp, Homo sapiens
tgcctatactcccagctactcaggaagccgaggcaggaggaataacttgaccctgggaggtcgaggctgcagtgagctttgattgcatcattgcattccatcctgggcaacagagcaagaaaaagagttggagatagagataccactttgagaaatttcctcagataaacctggttgcaaagtgccaccctttgctcctcacccttcaataactgagagagcgagcagggagcaggcaggcagaaggaccattcccacaaaccagatgaggaaactgaagcttggggaggggaagtcagtgactgaaccaggagccgccttcagccttaggacagccaggcccatattcccttcatcatccctggatacgaccactcccagccagacctcagggtagggggtgcttcagagctggctccctggtgactgagcacggctctgcttcaggttccgaggtgacctgcggtggatcctcttctgtgcagacctgccgtccctcatccaagaaggccctcagtatgtgccctgatgcgggaaccccagcccatctgctgcctttactctgcccttgctgggcttcttaaggactgatctggagaagaggagtggattgtccctgctgggaggaggagggaaggaaagggggaactttccactcaggcttctgagtgcctgcatagtaaacatagttgggacatgcgaggaatgaacgaatgagcctggtccatctctctaactccaccttggttcctcctcccaggaagctcaggtgacctctcccccgccttccacccccagccctccagccctgggctctcccctgaaggggagtcaggtctccctcgctggcctgggagaggggagggggactcctccagggcagcaaacctgttccccaactccagcttccaggtaagggggctgtgacataggattgacaggctgggcctctctgtccccagatgcgggctggtggccttgtggatggcaggtactctcctgtcgccccccagtggcgtccccctggagagactcatacgggtggccacggaaagaggctacacggcccagggagagatgttctcaggtgagctgggtgactgcatgctccatcatctcttcatgaggctgggaccagagaggctgggtgggatgctggcagccgtgtgtcagggtgtctcattccattctttgggcccttcccactgcccagtagagcagagaggttacaagatggacttgagctggctgcctaggttgcaaacccagctctgccacctcttcgctggggccatggacaagccactcacgctctttgtgcctcattttctgcatttgtaccaaggggtggaaggtcatggtgagggttggaagcatcgcccactgtgagccctcagcacggtgctgggcacatgcagcaagccccctctgtgtgctctcaccctgcagtggccgatatgggcaggctggcccaggaggtgctgggctgcc

SEQ ID NO: 91793 - DNA, 1066 bp, Homo sapiens
aaacaggctgactacttaggtcccccacctagatctcttccatggtggtgtgcctccagcaatgaagaaagctgtcctcacaagtgcccagtccagtccgggtgctttggctcatgcatgtaatcccagcactttgggaggccgaggcgggtggatcacctgaggtcaggagttggagacctgcctgaccaatatggtgaaaccgcatctctattaaaaatacaaaaattagccaggtgtggtggcatgcaactgtagtcccagctactcgggaggctgaggcgggagaatcgcttgaaccctggaggcagaggttgcagtgagccaaaattgcgccactgcactccagcctggaagacagagcaagactctgtctcaaaaaaaaaaaaaaaaaaaaaaaagagcaaatgcccagtctagtgagagagacagatccctccacctttccagacagtgacaacccagagtggtcagggctgtcatgacaaagcccagaggggtgtctgacccaggctggggagtcagggggagcttcttggagaaggggaaccctgagtgctgttgagcaagtcgtgcaaatgctgtgtgatgagagtatacagcttgcgcaggggcctggagtgaaatgaggacatgttctattcaaggaactgcaaatatgtccttaacttgccgggggaagtggcaaacatggggctgtgaaagcggcagagccagcccacgcaggacagagcgggtcgtgcaaagggactgagactttcctgagggcacgggggagccctggagaggctctgtgcagaaaaggaggctgcctgtggaagtggtacttaggagccttgaggaaactgggacatccagggacccaggtgggaggggaaaggagagtgccagacctaggctggggccctgaggctgaggtttagtgattgcctggctgaagaaaagagggagaagcgacttgccaggactcacattgaaactccaagctttccagacactttttttttttaatggagtttccctctttcatccaggctggagtgaactggcgcccaccaccacgccc

SEQ ID NO: 91794 - DNA, 1024 bp, Homo sapiens
tcgtgaccttcactgattggtccgtagacccgggcgccacggaaggaggtgggctttcagggagtggggcggggtttttctacctaggcgggaacccaaatatcgttttgattggcaacagctgagcccagaaacgagacttgctctgattggtcaagctactgcgtttccgcgcggcgattggctggcagaaaggcagaggcggggccaggagagaaagctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttgcccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatggtgagttctcgggatagtccggagtccagactgtcccgcacgggctggcccctcttccgtcccctgcacccgcctctctttctaagtgtttgtccagccaaacttcgagttaactccttggcctttacacaaactacttcctgtcttcaacactccattagttcatcttacactctgccctttaacgtggtcactg

SEQ ID NO: 91795 - DNA, 1024 bp, Homo sapiens
ctcagcctcccaaagtgttgggcttacaggcctgaaccaccacgcccggccaaaaattgggttcctaagcagaattctatacgggtggcctcaaccactttacttgctatgtgaccctgggcaagtcacatcacccctgtctcagtttctttttcttttctttcttttttttttgagacggagtttcgctcttgttgcccaggctgtagttcaatggcgcaatctcggctcactgcaacctccgtctcctgggttcaagcaattctcctgcctcagcctcccgagtagctgggattataggcatgcgccaccatgcccggctaattttgtattttcagtagagaaagggtttctccatgtcggtcaggctggtctcgaactcccgacctcaggtgatccgcccgcctcggcctcccaaagtgctgggattgattacaggggtgagccaccgcgcccggccccagtttcttagttgacgaatgggaataacaatagccttcttcctacaagattgttgtgagaattaaatgttatcaagatttatatgaaagcacacagaccagcccatgatacagagcgttagccaccattatggtacatgttcattgtgggctgatcactgaaaaagccggtgaccaagaaagccccagtccttgccctcacggagttcaaaggccactgggaggagagagagccccacgacagctcagaggaatcagggcttgatgggagatggtctcagcgtacggcaagtcagcggcagccacgtgaagggacaaggcaaggcttcctggaggaagggtcctgtgacctcaaaccttgtaagatgagcagcagtgaccacgttaaagggcagagtgtaagatgaactaatggagtgttgaagacaggaagtagtttgtgtaaaggccaaggagttaactcgaagtttggctggacaaacacttagaaagagaggcgggtgcaggggacggaagaggggccagcccgtgcgggacagtctggactccggactatcccgaga

SEQ ID NO: 91796 - DNA, 1776 bp, Homo sapiens
ggattacaggcacgtgccaccatacctggctgatttttttatttttagtagagacggggtttcgccatgttgcccaggctggtctcaaactcctgagctcaagtgatctgcctgcctcagcctcccaaagtgctaggattacaggcgtgagctactgtgccacactaagaatctttaacataccttcccctactgaataagcaccatgaaagaggggtttttgtctattttgttcattgctttattcccagagccttgaatggcgcctggcatctggcaggttctccttaaacagctaagtgagtgagattgaacctggaagactgaagtattcttgtgtgacaggaaatccccctgcactgcactcctctcctagcattgtctcctcggtcctttggcctgatgtttattgctgttccagcttcccttaaaaataccaacagcctttctactgaacacttgcttactgtgtgtcaggtactgttccaagcactttaactcatttagtcctcacaacagtcctttgaagtgggaagtatcataatccccatttttcagacaaggaagttaaggccaagatatttctgtgtttctcagtaagctcctgataaggtctgaatttttttttgtttgtttgttttttgttttttgttttttgctctgttgcctgggctggagtgcagtggtgccatctcagctgactgcaaccttcgcctcctgggttcaagcgattcttctgcctcagcctcttgagtagctgggactacaggtgcgcaccaccatgcccagctaatttttgtatttttggtagaaatggggtttcctggccaggcgcagtggctcatgcctgtaatcccagcactttcggaggccgaggtgggtggatcacctgaggtcaggagttcgagaccagcctggccaacatggtgaaaccctgtctctactaaaagcacaaaaattagccaggcgtggtggtgggcgcctgtaatcccagctagtagggaggctgaggcagaattgcttgaacccgggaggcagaggttgcagtcagctgagatctcatcactgcactctagcctgggtgacagagcaagacaatgtctcaaaaaaaaaaaaaaaagaaaagaaacaaagaaatggggttttgccatgttggccaagctggtctccacctcctggcctcaagtgatctgctcgctttagcctcccaaagggctgggattacaggcatgagccgcagcacctggcccctgataaaggtccaattttgaatcttggcaattgggctctgaatccacgctcttaacccgttctgctctctgtttggtagcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccggtaagccaggtcccggagaccaaccctcccactgccagaccttcctcagccacatggactggctttgggacagggtggggagagttctccccttggggcttcagacccctcctttccatttctttatagagatgtgtttctctctctcttttggggggtattgagcacctagatgatgctatctcctttcgaaactcttgttccctccttgtgactgtttctcaaggtctttcttcatggctatgacttggtttcgctctctccgt

SEQ ID NO: 91797 - DNA, 1035 bp, Homo sapiens
ggatggaggaagtggcagtactatgggtctcccactggactcagggctcttgtgctcaccgactcccctatacccccgcagctttctgagaatccaccgaatcacatcttgttcctcaccaacctgccagaggagaccaacgagctcatgctgtccatgcttttcaatcagtaagtggggcctgtggctgggtggtccctggagggtgatggccaggaggcatctccatggaaacaggcctcagaactctgccagcagagctctgagccaagtagggctttgcagaagggacagcgaccaaagatgtgaaaggaggaggctgtggctgggcccacggcctgtgggggacatgggggtgaggctggaaaggtctccatggccagggcttgccggcttttttcagccttgtttgagggctgagggagtccaggctctgggcctcattttcccagcccctaaaatgggggcatgcaaggcaaggtatgtgtaaaactgcattgagatgtccttgaacattggctaagactggcagaagtcagcgtgctcagaaacagcaagtgtgggagatggggatgcgtgaaactcttgtgcctggcgtcagggtggaggccggtgcagccgatgtgtagaggggctgttcaccattgttgagtgaagtcgtgggtgtgggtgagttcatctggtggttctgtttcaggggctgtgagtggggcattcgtcagtgtttgtggtggggagttggagggtgtctgggagaagggatggctacatgcagcatctcaccatgctgcactgcgtggcacttagaagaacagaaagcgcaactttataatagtgccgagagaagattgtgagaacctgaaaaatacagaaaaacaataccacatgtgcagcctgtccacaaagctgtatattttgtgagaatgccgatggaaaaaaggatacctagtaaacatgaggatggctgcttaatggagaaagaagtatggaatgagaagagggaaattagagaaacagcatatcagaaaagtgagg

SEQ ID NO: 91798 - DNA, 2367 bp, Homo sapiens
tccacctgcagccccaggccagcttcctgccctagaccttgaccctcccattcatagttctccagcgatttattgagcgcctgctgtgtgccaggccctgctcaaggcactggggatatggcagggagtacaacagactcccatcctcatggtgctgacattctctttgggggagacaggtgataaacaagagatgtaagtcgactgggcgcagtggctcacacctgtaatcccagcactttggcagggtgagatgggaagatcactttgagaccaggctgggcaacaaagcaaccttatctccacaaaaagttttttaaaattagcgaggcgtggtggtgtgcacctggagtcccagctacttgggaggctgaggtgggaggatggcttgagtccaggtgttcgaggctgcagtgagctgtgaccatgcgccactgcattccagcctgggtgacagagcgagactcttaaaaaaaaaaaaaaaaaaaaaagtaaagtatgtagtagtgagggaggtaagaactatggggaaaaataaaacaggcacagatgagtggatagggtggaggagtgtacttttttttttttctttgagatggggtattgctctgttacccaggatggagtgctgtggcgtgatctcggctcactgaaacctccgcctcctgggttcaagtgattctcctgcctcagcctcccgagtagctgagattacaggcgactaccaccatgcctggctaattttttttaatttttatagagacagggtttctttttttttttttttttttttttgagatggagtcttgctctgttgcccaggctagagtgcagtggcacgatcttggttcactgcaacttctgcctcctgagttcaagttgcctcagcctcctgagtagctggaactacaggcgcccgccaccacgcctggctaatttttatgtatttagtagagatggggttttaccatattggccaggctggtctcgatctcttgaccttgtgatctgcccgcctcggcctctcaaagtgccgggattacagtgtgagccaccgcacctggccgacacagggtttcatcatgttggccaggctggtatcaaactcctgacctcaagtgatccacccactcttggcctactaaaatgttgagattacaggcgtgagccactgcgcccggccaagaatgtacttttttttttttctgagatggagtttcactcttgttgcccaggctggagtgcaatggcgcgatctcagctcaccgcaacctctgcctcctaggttcaagcaattctcctgcctcagtctcctgagtagctgggattacaggcatgtgccaccacacccagctaattttgtatttttagtagagacggggtttctccgtgttggtcaggctggtctggaactcccgacctcaggtgatctgcccgcctcagcctcccaaagtgctgggattacaggcgggagccaccacgcccagcctttttttttttttttttttttgagacagagtctcactctgtcgccatgctagagtgcagtggcacgatctcggctcactgcaacctctgcctcctgggttcaagcaattctcctgcctcagtctcccgagtagctgggactataggtgcgtgccaccatgcccagctaatttttgtatttttagtagagacatttcaccatgttggccaggttggtctcgatctcttgacctcgtgatccgcccacctcagcctcccaaagtgctgggattacaggcgtcagccaccgcacctggccaagagtgtacatttaaacaagatgaggagggaagcctcgctgagaagatgacatttgagtgaaggaagggagatagggaggcctgtggggatctggggcaagagcactgctggagagcacagcaacgcttctagcgaggggtatgcctggtgtcggtgagggtgaccaaagcagccagtgtggtcatcatggaggacctgtgtgtgttttgtgggtacagcatgagatggggtcaggggttggaggaagcagatcagttagggcctgtgggccctggggaggcctctggcttataccctgtgtgggagccatgggaggcttctgaacagaggaaggacaggatcagattcaggggtgcagagagttcctctggctgcataaagggaaggggctgtgagggacagaggaggtcaccaggacaccagagaggaagctgctgcaaagtccagggaagatggtggaggacaggacaagggggcgggaagaggagtggctgagaagggaatagggttcatgtcctccctagactctctgtcttccagtcttggcctctctcttttttttttttttggttcctgtct

SEQ ID NO: 91799 - DNA, 2367 bp, Homo sapiens; identical to SEQ ID NO: 91798

SEQ ID NO: 91800 - DNA, 2367 bp, Homo sapiens; identical to SEQ ID NO: 91798

SEQ ID NO: 91801 - DNA, 1096 bp, Homo sapiens
cttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaaccccctcctttcccactcctccacaccacccttttctactccagccctccttcttctgtctttggttaccgcgtcccacaacctgcaccacagtcctctgtcttagggtcatctacccagcccctggcctccagcctctccctatcactgcctcttatctgtcagcggactcccgcacctccagattctcagggtcctctccccgacttggcctcaggttttggggggcctctatagtcaagtctgtcctggtcgtcttccccactcctgcccataccatcccggctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggca

SEQ ID NO: 91802 - DNA, 1654 bp, Homo sapiens
tggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggctcagggaccagggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccactttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggcc

SEQ ID NO: 91803 - DNA, 1654 bp, Homo sapiens; identical to SEQ ID NO: 91802

SEQ ID NO: 91804 - DNA, 1654 bp, Homo sapiens; identical to SEQ ID NO: 91802

SEQ ID NO: 91805 - DNA, 1031 bp, Homo sapiens
ctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatcccc

SEQ ID NO: 91806 - DNA, 1021 bp, Homo sapiens
gggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtac

SEQ ID NO: 91807 - DNA, 1022 bp, Homo sapiens
aatcccagcactttgggaggctgaagcaggtggatcacttgaggtcaggagtttgagaccagcctggccaacatggcgaaaccctgtctctactgaaaaatgcaaaaattagcgggaagtgtaggcacacgcctgtggtcccagctacttgggaggctgaggcacgataatcacttgaacccgggagatggaggctacagtgagctgagatcgcatcactgcactccagcctgggtgacagagtgagatcctgttttcaaaaaaaagaatgagggcaagggggtgtgtggaatgaatggaaggcagaaggtagctgcccaaggcatgctcagcaaatgttagcacagagggcaggcagggcttgaggctgagatggtgcttgctcaactgctggttgagtagggggttccacatggtttttccctgccctcacctactccccctcccccccagagaagtgtttgaaccaacagtggaaagaggtgaactggtagtcaggtaccgcgtgcgcaagtcctacagtcgtcggaccactgaagctacctgtaagtgaaccctatgccccactgccctggcctggatctaaaggctgtagagaatctggcctgctgggcttctgtacatgtgtgagccaaaagtttctaaaggccttgggatactagaatgtcagaaccacagaccctagaaataacagatttgtggaaccacaaagaactttcaaggaatagaatcttagacacagtaaatcttagaaacaccaaggctgggtgtggtggctcatgcctgtaatcctagcgcttcggggggccgaggtgggaggatcacttgagcccaggagttcgagaacagcctgggcagcatggtgaaaccctgtctctacaaaaaaaaaaaattagccaggtatggtggtgtgcccctgtactccctgctactcgggaggctgaggtaggaggatcacctgagcccagggaggtcaaggctgcagtaagccgtgatcacaccactgcactccagcctgggtg

SEQ ID NO: 91808 - DNA, 1041 bp, Homo sapiens
gggtgcagtggctcacgcctgtaatctcaacactttgggaggcccaggcgggcagacacttgaggtcaggagttcgagaccagcctggccaacatggcgagaccctgtctctactaaaaatacaaaaattagccagatgtaatctgtaatcccagctacttgggaggctgaggcaggagaatctcttgaacctgggaggcggaggttgcagtgagccgagatcgtgccactgcacttcagcctgggtgatagagcaagacaccgtctcaaaaaaaaaaaaaaaaaaaaggaatctcatctttccagttagggaaactgaaatccagaaagaaaatggaagagctaggtctcttcctagcatacagcgagaaagccgccagggccccagggggatgtttggaaagggctgggaaagacatttatttaagaagagaaggaagaagcaacgatgtcccagtgatttaactgagtaacatacagcatccattctcagggtgtgagcctggtcccctgtggtccctgagacctttgcagggggcccataaggtcaaatctattttcatactattaccaagacattatttgcccttttgctttctcattctctcattagcattcagcgcagttttccagaggctccctgacgtgggatgatgtcatccaacactctgacagctgatggaccttgtgcttgtatattcttgttttaaaaatttatcaggctgggcatagtggcacatgcctgtaatcccaccactttgggaggccaaggtgggcaaattgcttgaggtcaggagtttgagaccagcctgaccaacatggtgaaaccccatttctactaaaatacaaaaattagctgggtgtggtggtgcatgcctgtaatcctagctacttgggaggctgaggaaagagaatcgcttgaacccgggaggcggatgttgcagcaagctgaggttgtaccactggacttcagcctgggcaacagagtgagactgtctcaaaaaaaaaaaaaattaaataaacctgataggttttcttttg

SEQ ID NO: 91809 - DNA, 1024 bp, Homo sapiens
ctggtacagcagggcactgacccatcagggtgcccactggagcaagagcgtggccaggctttaccccttgagttccctttgagggaaggttcagggggtccagaggaggagctggggtggaagtagaggggtgctcagggcagttgctaattttaaatcagtgcagaagtatgtcagtgtttcaacaatggatctatccctactggtgggtgaatgtcacctgaatgtcagccctgctccatgactctgtccaccccaaccttgcatgcagtgaacagcctgggcatcagtgaagagctgaaggagaagctgcgggatgtgatggtggaccggcacaaggtggccctggggaagactctgggagagggtgagtcccccggcagcatacacacatccttctgaacttctgagatcctgcacttccacactcccacccaactataggaaatacagtccccacgggccctctgaggtcagtgtctccctctggccccccacaggagagtttggagctgtgatggaaggccagctcaaccaggacgactccatcctcaaggtggctgtgaagacgatgaagagtgagttacgtgcacatgtgtaggacccccagctccttccctatgcccctgagacagaagagagcaagcaagttagccatagcttagaacttctggtgtttccagataggcaatggagcccctgccaggtacctcaatagaaggaattgaatatggggagattagtacaaaggtgggagacgggttgaaggaacaactgggggcagggagggaaaccagagatgagcagcagcaggaagtcacttcccccgctaggcctgaagggtagagggagcaagtggtgttaccagaatccacagctagggacaccaggcaggagctggtatcacagagttagaggctgctctgtgggagctaaaaacccagaatagcactttgggaggccgaggcagcagatcgcttgagtccaggagtttgagaccagcctaggcaatatggtgaaacca

SEQ ID NO: 91810 - DNA, 1006 bp, Homo sapiens
tttgggaggccgaggcgggcagatcgtgaggtcaggagatcgaaaccatcctggctaacaaggtgaaaccccgtctctactaaaaatacaaaaaattagccgggtgtggtggcacacgcctgtagtcccagctactcaggaggctgaggcaggagaattgcttgaacccgagaggcggaggttgcagtgacccgagatcaaaccactgcactccagcctggacaacagagtgagactccatctaaaaaaaaaaaaaaaaagaaaatatatattttatatatatatatatattatatacacacacacagacacacacacatacacatatcacatataaagtgctgagtatggtgcctggtacttactaatcatgtttgatgaagatgagtgatgatgatgatgatgatgatgatggagtggaggtggagggagagtcctccctctcctcccctcctcctcacgacctttctctctccctcaagttgccatctgcacgaggtcagagctggaggatttcctgagtgaagcggtctgcatgaaggaatttgaccatcccaacgtcatgaggctcatcggtgagagaggggcagattcaaggggtctacaagccccatgggggccatagcagagggaagagccctgcttctggccctgggaagatcaaacttccaggcttcctgctccccgctccttcagggtcagcaggcttccccctcctagtctccctcagcttggaatgtgacctctgatcattcccagaaatagctgaggtccccaggagggctccggaaacgtccctgggaactctgctggaaacagcttctctgcagcttggtccttgccactgccactacccccaaacaatatggtggccagattggatgggtagtgagaaggagaggctggaggctggctggtggggggcttggcttccccttctgcccagcaggagtgacagggctacctggggggctcaggtgtctgtttccagggttctgaacgagag

SEQ ID NO: 91811 - DNA, 1050 bp, Homo sapiens
ttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctat

SEQ ID NO: 91812 - DNA, 1058 bp, Homo sapiens
cgtgtgggctggggggtggggagccgtgtttccagggtggggaaggaatgtccaggtgtgcggggctgcgagagttctgaggaaggaggatcctggaatatgccgctggatgcgatcctgggcgttctcctatttgggtacgggggtgggtgggagaggtggaggcgctggtgtctgtggctggggagggtcctaatggactcagtgctttggagtttggctagtgagcatttaggggctgcgggagattgaactagggggcacccccatctctcttccggggctggaaggccacccttgaagcaggcacagcctggacattaggtgctgggagatctggggactttctggttggcttctagaagaggtatagggagccctggtgtccagaggctggcgggggagaggatgctttcctggacaaaggatctgggggtctagagctaagaaaactgagggcaaataactcttgaggctgctgctgactggtctggagctaactgtggggtttttggagaacagagggtagctgggggtgggatgggggcagatgagttggtaacattccaagtggatgaaatatgtggcgggagacagaggatcctgtgtccagcacaggagtacgtatctggcttagcgaatatggggaggggggaggccgtagggagcaaagagaaagaaacctgttgacttcactggaggcctcagagtggagtgtggggaatgtttctggacctgagcgtctccaggagaaatctcgacggttcccagaagcagttatttgtgtacccagggagtgggggccctcggggagcagcacggaactcttcatcagccaggagctgtgactctgggaatgggttcgggtagacctgcggttgtctgaggagaggaaaacctgatatgggacggcgtgaatcttcagttagaaaaaaagcagctttcgggccgagtgcagtggctcacgcctgttattccagcactttgggaggccgaggcgggcggatcacgaggtcaggagttcaagaccagtctggccagcatagtgaaaccctgtc

SEQ ID NO: 91813 - DNA, 2244 bp, Homo sapiens
gtgatctcacctcggcctcctgaagtgctgggattacaggcgtgaatcactgcaccaggcctcagggcagctttctagtaggactgggaaatggggggactggaaaggttaaggagtaagtagaagggattctggcgtaagagtttgtggagtttttctgaaaagagggcaccctgggacttggggctaaggggataaggagagaaatgaggtaacagaagagacaggatttggggttggaattggatacttgttcataagagaatttcccggagggaggagtgtggatttggggtaggcagtggcctagagattatcgaggacccaggtgctggaaagaggacttcccattgcagagacttgtgaagaaaggagtgggcctgtgtgtgtgtctagagcaggagggatcgtggcaggaatgcctagcaagaaagggtagtgggttagtagtgacctggtggtctgggcagagagtcatctctgagaggaaagcgaattaggtgctttggagcgtagactctagactaagacagacttcgtttcaaatctggcttaaagatattggcaagtcacttcacctctgtgggcctggtttccttaatgtgtaaaatggggttaatcaacaaatagtgtgttcacagcccctccaacccctgaggggtgttatgaatgagatcacatgtgaagggcttatcactgggcctgccttttatgagaagagggatgttttagagaatggagaaggaccctagaattatagcttctccaggaggggctgcctctgtgaacacaggagagagatgctggggaaaagaggctttgtgggaagaggagcattgtgcttggagcctggaagcagcagaatagtttgaaagggccccatattccaattaaggagataatgctatttcttcctctctcccttacttgctacaacaaagtcctttgagcccccttcatgcctcccttaagccctccttcaaccttggtaaacagaccggtagcaaaccacatgacctgtgactttcctccctttgggctgcacctggtttgtgcccagatgtatttatcctctgagaaggaatccgatcagttagcaagtggcagaatagtctctccttccctttggttctggctcacggctcctggcatagccactggtagggcccttggggccctaactgagagctagcccctggggaggagagcctgtatgctgcccatcctagctttctaaagttctctctgggtttggctgcaaggttcttgagggaatttctggttttagttccacctctgagctttcacacgtgttatcccaaccccagtaacattctccattctcatcactgagtcattacctgtgtatcctttgaatcaaggcttatctgttattttccaggtccctttcttcattcctggtactactttgtagccttcaacacaatcatattaaatttttgtgtgtctttaagatttgtctgtctcactaaactgaaggcttcagtggggcaagcttgtcttcagctgtatcccaggctctggagtatagtatgcatgccatgaatagttaatattattattcttaccactcttagttgagctcctggacctgcagatgccttctggatgctttggtccagggttcttcatgaaccgcccctctaattggccatttttaattttgttttaagatgccatggacaatattaccaggcagaaccaattctacgatacccaagtcatcaaacaagaaaacgagtcaggctacgagaggagaccactggaaatggagcagcagcaggcctatcgtccaggtaggaaaatacacatggttcatctctttggatggaaacaatctacatggagcctttaccccctgcttagagcgggtcttcccagagaaactgtgcatcttttttcttgggcagttcatctaaacattgtcactctggcaagaattgtttaaaggaaagatctcagtcctatttccaagtgttgggagaggggaggttccatggtatctgtaaaaaagtgatgttagtatcagccgggtgtggtggctccctcctgtaatcccagcactttgggaggccgaggcaggtggatcacctgaggtctggagttcgagaccagcctggccaatatggtgaaacccgtctctactaaaaatacaaaaattagccaggcatggtggcaggcacctgtaatcccagctacttgggaggctgaggcaggagaatc

SEQ ID NO: 91814 - DNA, 1020 bp, Homo sapiens
atacccgtaatgaaagaaatatctgtttcctaacactactcccaaatacacatcctcttcccattcatccactcattcagtcagttctcacagtgctgtcacgaagtgcccactcttgggctggacactagcaacatacagatggacagtgggttttgccttctgttgttccagtgtggggactcagacacatacactagtaagccacaacctctgaggtgagtagtcaggatgcaggtgagtttcaggagttcagaagagggagcagcctctgctttggtcatttcccttccctaacaagcccttccctcctttccctccagaccaagtccttcccttccctccttccttccttcagttcctgtctgaagccttttgcaattatgaaaactaggaatggccactgtactcatctggactagtcatctgacattctatttcctatctggcggagtccaccttctaactagcttgttactgtctgagacagggcctggatctcacaggctatgatttaagttaggacatggatcccacctcatatggggttcttccactgcctcccacagagcagaagcctggaagctacttactgatggagagcaaaggaagaacactcgctctgatcctgggctggcagggaaagtttcctagaatggacttaacatgtgatgagcacagctcatccatgttagccctggcctggcgaggccagaggggccctccaccagagggaagcctgctgctgggagagtcagcagccaaatgggcatgggctccccatctgtgcatgcagtgcactgcgaccacccagactgtccaggcaggaccctgagtgttagattctacctttctacccttcttcctcgttcctgtacagcagaaaccaacagtgttaagtcccttttttagcgttttggtaggaaaatgaatatcgtttataatttaggacactgaaaaaaatgggtcatctcaaattcttacagatgtaggattttaagaagcctggtacatggatag

SEQ ID NO: 91815 - DNA, 1613 bp, Homo sapiens
ggagagaggttgaggggtgtgctggttccttttgaaactgcccccatgatgtgttcactgtgtactcctggtcagcacttggggaagttccctctgcctgcttctttcttaggacttctaaaacatcagccaggccgggcgtggtggctcacgcctgtaatcccagcagtttgggaggccgaggcaggtggatcacctgaggtcgggagttcgagaccagcctggccaacatggagaaaccctatctctactaaaaaatacaaaattagtcaggtgtggtggtgcatgcctgtaatcccagctactcaggaagctgaggcaagagaatcacttgaacccgggaggcggaggttgcggtgagccaagatcgcaccattgcactccagcctgggcaaaaagagtgaaactccgtctcaagaaaacaaaacaaaataaaaacatcagccaactgtgggcattttccttcacagataactgcgacctccacttcaaggtggcccgagatcggagtagtggctatccgctcacaattgagggctttgcatacctgtggtcaggagcccgtgccagctatggggtcagaaggggccgtgtatgcttcgagatgaaggtgagtaggagcaagagaaggggaagggacagagaagtccatccattgtaatatcctgataccagccaccttggtcagagctgcaactgcaaaagagattggattgtgcaataccatgtccaagcagacaaaactgtgatgaactcaagacaactacatcattgctaaatatcatatcagaaaagcaggccaaccatgcattgcttcatcaagcagatatttccttggtgagatttgacccaggtattatgtagtcaaccagtgtagtgatgacatgtttgtagaactgagaaaagaagttgtttggaagaaaagtgatctagaaagaatagactcagatgtcacttattaaagggaggccagagggagaacagggcaaagaactgccagcttaggccagcctctgctgtcatctctccacagttccatgtcaagttatgtttatgaaaataatagatgctcatgtttaacaaaagttcagacagcacagaaaagtacaggataaaacaggttattctcgccaggtgtggtggcttttgcctgtaatcccagcacttttgggaggccaaggcaggtggatcacaaggtcaggagttcaataccaaactggccaagatggtgaaaccctgtctactaaaaatacaaaaaaattagccgggcatggtggcgggtgcctgcaatcctagctattcaggaggctgaggcagagaattgcttgaacccaagaggcagaggttgcagtgagccgagatcacgccactgcactccagcctgggtgacagagtgagactctgtctcaaaaaaaaaaaacaaaaaaacaaaaacaaaaaaaacaaaacaggttattctcatgtcctctcagttcccatcctaccatcctactccctggagggaacttctgtgttaacaatttcttacctgtggtttgtgtatccaaacttactgatgatagctaataagtatagagctctttgcatgcacaagatacagcaccaagctcttt

SEQ ID NO: 91816 - DNA, 1875 bp, Homo sapiens
ccaggggtcagtcctcatggtctccaggagcaaaatccagccccttcactgatttctaccacaagtagactggactgaatattgggtgtcacaaggaagggttgcatctcagcatacagccattctcctccatcccaactcctgtcttccttcctccctttcttttcaaattctcccctctgtgcagagttattcagttgagctcctactcccagactggacaatgaaacccatcaagccctccaagttctacatcattaagggcttcctttcacccttccccacccctattttaaaaaggcatctgattaataaaactagtaaagaaaatgatttttttcttcaaaaataaaagtatgtggcagccattgaggctgttatgaccatcgcaggtttaacctgcctttgcctatttcttccgtcaggcgaagagcctttctcctatggctatggaggcactgggaagaagtccaccaatagccggtttgaaaactacggagacaagtttgcagagaacgatgtgattggctgctttgcggtgagtgctagcagcctgtgggagttggcagaaccagatgttgggctacagacttctttttcaggatacctctatccattgtctgccccatatccagccactctcgccatacttctttgtctctgcttgacagactggaatgtttactgtcattttgtgggaaattctgtcattccatctcctctggtcttgtgtgcaaagttttcagatgacaccctgaagaggtttggggacttcaggtgtgcatagccttcctccgttcctaggtaccagagtaacattttctaaacaaacctaggaatttcttatctttcattgctaggaaatagcctgtctgctcctgaaggcagtggtattggctcttgccccatgttggcatcatcttatcccaaaacttctccctttcttcatctcacattggttgagccaggcttcctacaatgcactgccttctggaagagtagagatgatgcaaaacagaacagctgttgctgccatacttcagtctttgagaacagtgaccagcagtcaccttgctgtgcagtatggctgtcagctctgggctggactccctggacccagttatgttcttccattcaagccctgggcaatttacccttcttgtttttcagttccctctaaatgagaatctttgcacctacctcagaattttgtgtggagtcattaagttaatccattaaaagcacttataataatgcctgacacacagtaagtgctcagtaaataccacttaatactgttaacattaggagttataagagatgtttgtaaaatgtgccgtaaggccccagaggaagtgaccacctggatggattcatcctctgaagcttattcttttgccttccttcatatttgtacacatgtactcttccttcttcttttttatttatttatttatttttgagatgagttttttgctcttgttgcccaggctggagagcaatggtgcgatctcggctcaccacaatctccgcctcctgggttcaagcgattctcctgcctcagccccctgagtagctgggattgcaggcatgcaccactacacccaactaattttgtatttttagtagagacggggtttctccatgttggtcaggctggtctcgaactcccgacctcagatgatctgctcgcctcggccttgcaaagtactgggattacaggtgtgaaccaccacgcctggccccttcttctttttttaactttgagataaattcaaactcggaaaagcttgagaataaagaattctcacagggccttatccagattctaacatttgccacatttgctttaccattttcatgtttatggtgtac

SEQ ID NO: 91817 - DNA, 1045 bp, Homo sapiens
gccccacatatggatctcctgtgcaatttagccactcctacttccccattggagcacattttccgtgctggcatgagcattttgcacatagaattttgcattcttgtgggaatgtagttgtattccttcttgaaagttagattctaagtcaaaggtatatttttaaattttcatagctaccaccaagactacactccaaacaggttgcagtaatttaacttgtcactgtgtgacagtgtttgccaaagtctgttctttcagagtatgaggttcttttggtatgtggcagtatggaactctaggccttgactcttgcttcaaccagaacatctctgcatccagtcttaagattccttatatagttttctttgttcagaagataccacaactttaaaaaggctcagggtgaggagttggtgggggtgtaaaaatcattggtctcctggaacaagaggggaggacattggtgtcaaatatcaagtcctcaatttgcaaaacaaaaaggtaaaacagccttccaagtggagaacagaataacccatttcagcaaaccataaagagtatgatacttagagcctagggacaacagaaagaggtgtgagacaccaggctataaaaatggcaggctctgaattatgccaggcttcaggagtttgggtctttaggcctgggactgacacaggagtgtttcagcaggaacaacaacacaactccacttgccttttggacagatggctctgttggtggtagatgggttggttgagggcgccggtttctgtgcattatgggaagttcctatagtgaagctggtggccataaggaaggctaactaacaccaacagtcatacctgctctccatggtcttttttttttttttttttttgagaaggagtcttgctgttgcccggctggagtgctgtgacatgatctcggctcactgcaacctccaactccctagttcaagtgattctcctgcctcagcctcctgagtagctgggattacaggcactcgccaccatgaccagctaatttttgtatgtttagt

SEQ ID NO: 91818 - DNA, 1111 bp, Homo sapiens
cctgggattataggcgtgagctaccgtgcctggccagcacttgacttaatgctcaccctgtcccaggcactgtgctcagagtctgacaagcctgatctttttgaatcccgataccagtactgtgaggtagatggtattactgcttccgctttgtagaggcagccacagctcagaggtccagagtcacactcacagtcaccaccgagccaagtggtgccataccaccatgccgcaacaccttccctgtcttgttcttgtagattctgatgatggtgggcctgcctgctgctggcaagaccacatgggccatcaaacatgcagcctccaacccttccaagaagtacaacatcctgggtaccaatgccatcatggataagatgcgggtaaggccagccactggactctccttactcacctccaacctactgagtgctgccctgcaactaaaatcactcacccctcaccaattcctgcccgcaggtgatgggcctacgccggcagcggaactatgctggccgctgggatgtcctgatccagcaggccacccagtgcctcaaccgcctcatccagattgctgcccgcaagaaacgcaactatatcctagatcaggtacttaatgatgaccattgtgtcctcaggagaagggaggggaccccttgcatgcctgagaatctccctctggtccctttcttttttcccccgtaatgatgatggactgctgtgctagtcgggggggtcagaccttgtcatacatgatgacatggtactacacacagctgagcctggactgggatcatgatctaggcctacttactcagactcatcagcagccccaaagaacatcaggtaagaactgtttagcaaaatggaaggagtatggatttccaagcctgagagactggagcttgaatgccagctcggctactccctagctctgtgcctttgggcagctgactttattctctgaatctccatctcttggtttgtaaaacagggatctcaataccatctgcacccctaacgcaggacctggcacttagtagctggtgattattgttaaatactctacagaataggtagagtagctttcatgccaacagcagtgctgtaa

SEQ ID NO: 91819 - DNA, 2232 bp, Homo sapiens
cttccgtcattttctcttcacaaatacgtatgactggcaggtacatacctaagtcatattttctacctacacttcagttaatggtggagttcttaacatcagggaccttggaacctttgtatttgaacataaatattgtatgcagctgcaggtgtatcctttttatgaaaaagaagggaaaaaaaaacagttttttgtccctatctttcagcattctcaaaaggatgagtgacccaaaaatcattacagattcctgtctcagagtaatgagttccacatggttattgcctatgcaacgtcattgcctattgacatttgtcctgaaggctttcacaagtaacaaagggtgtctccttattttctatgtttggggatctgtgaatgagcctctgttcccttcagccttgcatttgtgctttcttaagaacctgtgagtgagcaaatatgtaaactaagtaacaccctgcccttgtagccttcctgaagtgccttccatacgtgtaggcctggatacttggtgaccatgagttcaaagggctcctgataagagtggaggtggggacagcgtttggctttgtcagaatggtagtttgcttgttagaaaggaatcgccagagaccgagttgccttcacataggaatgaggatcctacacaaaacagttgagcacaggatagtctaaaagccatccgtggttatccccccagctcatattgtgtacaatcagtgttctctccgctttgaagatttgtcttttaaacccttggcctcactttacctgatcctccttgtcggggcattcaagaatttttttagtctgtattgaccccagttggactcattgtcgtgaaagggagagcagtaataccattttaacactctgaggatacatacctcttttggataccctagccagtattcctccctgtctttttcttggtttgctggttaaatcagctgtgaaactcatttcaaatatgtggcctaggggagaatgattatagtctagagtggatcgtctaacatctctgtccaggatgctgaagtgggttttctctggaagccaggcccatgacagctttgcactctgaagacctactgtcagccttcttggctgctgctggcttgttcagggacagggtctagggctgtaccaggtatgcctgtggtcttcagggctaccagcctcctgcttaagggacatgtgggtcaggccaagagatcttggccaacaatgagacagagaacctaaactctgaaggctggggaggagggttctctggttaaccacagattggaggattgcctcggggcctgaagccataggctactcaggctgagggagggattgtaaagccagtggtttcacctgttttggcctaaaccccaaaagtgggttccagaaaactctgggtatgagaaagagggagggggaagttgtgtgtttgtgtatagagggttcagagcaggcccctggccaatcctggcacttccattccaccagctttggcggtgacaggtaagttgatgatgcatagctgtctcctgggctaggtggaatttccaaaggggaaacccatactacaggcaaaatccctgcagttcctggatctcagcccagaaccatcttttgcctttactggtttttcctgagtggtcagatctccccagatttggctcttccagcctcctgttatgtaggttggccttagaaatgctcatccttgagagggaaggagaggttgtctgcagaagccaggtgggcctttgtaagccaggattctgtgtttgtctggccaggactctaactcctaccctgggatgtatgtgattgggcacaaactctcaggtatatcggggctttgacctacattctgtgataacctgagtagccttttgagatgatgtgggcatcacagctgtggaacatcagaagaggaaaaagaggtagaccagagaggaagctgaagcctctgcagaggactataggactgctaagtcacgcactcagtgtactgatagatcacagctctgctgacttcccaaacagccatagtctagaatggttggggccatggtgggaatttggggaagctttctggaggtggaatgtctgagtcggggcacagaggatgattaaaagagttggggctttgtcctgaggagagtggggagtcatggttaggttttcatccggaggaatgtggataaatttgcctggctagtaaaaggc

SEQ ID NO: 91820 - DNA, 1399 bp, Homo sapiens
tcagaatacatttttttttttttggtccatttgtatatacccctttacagactgttttccccatctgtggcttctttcttgggtccctattagagccactaaaaaattgtttaaatgcagttaaaaactccttactccgtttctgctgagttcctgagtttccatagggagggtacctgtataggtgcctgggtcttacttctagaggttcaggctcaggaagtctcaaatgaagtttgagctgctcactttttaagtagtgtcctcgtgattcaagtatacaggctgagtctatggaaccctgaatccaacagaggtaggccccattcccaaagggcccgacatgaaggaggtgttcggtaaatggaagccgatgttgttactgctctcaaccacatatgtgctagagcaccgctctgccagcaccagcccaggacacacctgccatcacttagaggaagggaaggaaacattaggagcaaaactgcacttgcgaaaagcagagtctcctgatgtgtagagcttgctggttagaagcttgtgggtgaggctgatgtttcagagaaggactgagggaataaaagaaccaatgttaataagaacaaactacaaaactgtccaaaggagctggttaattagtagcatagctaatctataggtattacacagccattaaaaaagaatactgcacagaaaaacttcagagaaagtttcacgttacatgaaaaagcctcaggaggatgtgcataatacaattctttttgtgtaaaaaaatcacatagatatttctaaaagtgcacggaagaaattcattcttcattctctctgggaagtagggctggcactaagggaacacaggggtttttcctctaaactttatgccttatactgtgaatttttttaccaagagtatgtattagcttttagaatagggaaaagaaattgtaaggtccagtaccaagaacaaataggattaaaaagcaaagtcccaaccattaggaatcctttgccctgtgcctgtctgcagccacttacctaagtcaattcatttgctgagggtgactcaagaatcttctaagtaaagaagagctgtttcctgagtttctctgcttacaaggagcactgatatccttttctcagtccctggcctacataatacccctcagaggaaaaaaccaactcttaatgtaccatctcttgcctcttctgttaccttacccttagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaaggtagga

SEQ ID NO: 91821 - DNA, 3583 bp, Homo sapiens
ccagccccacaacatcctgtttctgtgagcttggacaaatagcttcccgtctctgggcctcattttcctcataaaggtgttagtagaagtcccttccaaggtttgttgtgaggaatgggtggcactatagctctgggactaggcagacctggggtcaagtcctttttccttggcccagaaatttcatcttgagcctcagtttctttctctttaaaatggggctagtgggacctacccctaggttctatatggagattatatgatgtaatgatccaacctgtacttgggaagcacttagtcaattgccactactgtttctcagcagatcttccagtaacaactaccaccacctgttgagtacccagtggtttatacacacaagcttattggatacccagggcaagctaaaggagttgttcttgttctattgtgattctcattttataaaaaagaaaactgagatttcaagaagtgccgtgtaccttgctccctgggggtctcagagctggggttagagtccacatcacagccctggggcttgcccttcatcctgccctaccatggcatggagctggctctcctccttctcagcccacaaacaatgtccactaggcaagggaagggcccctgtgggccaaccacttaaaaaggccctttttccatcccagcatttcacatctgcagatttcctctatttcacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcaggtaggtgccagactgggggccaactggatggagagacttccatgggcccctcctgggtgtgtattcccagacttaagtccctgcttatccctaaaaagacagcctgctggcctcggcctggcgttcatctggtgcagccattccatttggtcaacacttctgcactggttgctaggtaattggtatcctagccccctccacagtctagcaagtgaaggggaagggctggcctaagtaccaggggcctcagagtcctctttcagcaccatagacagggggctccaaatcctgctgcaggttggtgcccaggcccccatacctgttactaaatcttttgactatgatatctagctatacccaaaaggcactgggttgacaagctgagacctgggcttcagtccctaactgcctacctgtgtggtgtcaggtctttccaaggtgccttgatttctctgtcaggggacctgtgttcaactgttgtcactgcagctgtctctgccctaggtgagggtggggctggtggggaggctaaatgtgtggtggatgcaggacaacttggtgttcttggtttctttccccagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtctaaaatccctccaggagtttttgagtaaaggacatggaacaggcctctaggtggagggatgggtgggactgatggggcagagaccagggctggtttgtttggcatcatcactgggcatccacagaccacctgcctcaggcctggcctgtgtgcagcacggaggacagttcctgcctgttctgtgtttggggctcatggggattccaggagcttcatgtttcagccagtgtgtgtgagccacctgctgtgttcttcagctgtcctggacagtgctggggacatagtatggccacggcagtcctggaccccgttctcacagagctcccactccagagagaacaaagacctgccagcaccaagtggtcagctgtgagagcctggggtggtgtgcagggagggcttcctggaggagtgagccagggtaaaagactccagattgcatccccatggcccatcttccccttccttagcaaccttatgtcttcgttccctcatacatgctgtgttcctggctccttgtgagagacaatgctgggccacaggagaagccaattcagccccaatcttccctggtgggagctcagagccttgtgaaggggagatgggcaacaaaaacaaggga

SEQ ID NO: 91822 - DNA, 1035 bp, Homo sapiens
agtaacacttcagggtttcaaccctgcttccttcctgctaggaggtgccatgtcatttattcaaagaaaacaaaacgaaaccaaacaaaacagggcaaacacatttcttaataagtgcagtttgttaaaatcatgttaaaacatatgagtcaaggggaagtaaaaataaagggtatcactgtaggaaaagcttttgggtctggcacctgggagaccactggagaggaggcagtgggagaaacttcaagttctgaagggaaggagccccccaacctccccttcttccctctcacccactgaatcccaccagaaactaccaagacgcccggaataaaaggtttcaagttcaatagtcactctctccaaatacaaaaagcagttacaattcaactgaacacagaagcttgtgtgcaaagttatggggaactggggcatcgtataaaaagttgggttaaagatgattctgtggtttggttttgttgtgttttgttttgtggctcttcctcagtcacctgaactcaggaaagaaatgcttatcttgatgaaatatcaacagcccacccacagtaaaaagacaaattctaaaaattaaaaaaaagcgcataattaccaaaaaaaagtcactgcttcctccccctccccattttgctttttaaacttttttttttttaagttttgattttttttttaatcctgaaaagtagacagtaaaacagctcctgggagaatttacaaccaactgcatgagggtctgggaagctgaggggctggagcagggttgggagagtgaacaggaggggattctcccctcagtcactgtagcctcactgtatgatcaagggaggtggggattatttagtcaaaaaggaagaaggtaggaagaacaggaggtggaaggctggggaggtggggacaaacagaaaataaaaggtcattgttgcctgtttgaatccagaaaaaaatgcctggccctatggaggggaaggaagcccctcagaggggaggcagtgggctggagggaggcagccctgggat

SEQ ID NO: 91823 - DNA, 1044 bp, Homo sapiens
ccgtgccccccatctcctctgtctcccacactctgggaagcccggctgggatatccaggttggagcctcactggcggccactggaaacccagaatgaggggtcatcgcctctcgcccacccagaaagggcgcaggagggggcagcaaggttgcggggcctgtctggccagaaggaaatgtctgtgctgtggcctggtcacccccgcccccaggacctgctgggctgctgccgcccccggccggggctgaggccgagtaaacacagcaaacacagccgccggcagcctgggatatttataccgaggctgggcgtgggtccagtgcccaccacagcccctgccctgccctgccttgcctgctgccacagccagctccgagccagcgtggcaccagccggcaaggggacgcgccgcagacacagcctgcgctgggtatggaggccaacaggcactggccgctcatgatgcaggcggctccatggacgcaccctgtccccctcccctgaaaacaccagcacacaatgtggacccacactcgcagctgctcacaaacacacatccacccctgctgagaacgcgaaatcccctcaacgatgatgcaaaacagacccacacaactccacacactgcagtcaccagcctacatgtgggaacacagcatgcagacaccaccttagcacctgctcacagcacccacaggctgggaacaccagtccctgagatggacacacagccccgaagtacagccctccctcacacagacaaacactgagaaccacaggaagcatgctggatgcacaccacgtagacaaacatgctcagaataccagcgacacatgcactgatcacagtgcaacccagaaacaactcaactcatctgcctcatatgtaagaaacacacacggccgggcgcggtggctcatgcctgtgtctcagcactttgggagaccaaggtgggtggattacaaggtcaggagttcgagaccagcctggccaacatggtgaaatcccatctctactaaaaatacaaaaattagacgggtgt

SEQ ID NO: 91824 - DNA, 1369 bp, Homo sapiens
ctaaagctgtggtctttgtctggctgctaggcctggagaagaaacacattaggaaactgaggcagagccagctgactcccaacctgtgctctctttccactgtgagcttcctgcaggcagcagcgaggtggctcttcctccattgccctgccagctctgtcaccggggagtggctgctacccaagtttcgggcctggctttgccagtgcctccccctcgtgtctttggaaggtttcttcccctctctgaccctatttgccaacaaatgtgtggtacgtacttcagtacatacctattgaatattattatattccccatctaacagatgaggagattgagactcaaggagtaagtcacttgttcaaggtcacacagctgagcaaaactaggtctggaacccagggctacttgatccccggaccacttttaaccactctgccatactgcccttctgtgaccgattagtgatgtctgccataggcatcagcctggtggagggaggcatggatctgctctgctggccaggcctacagtagaaacttcttaggctgggcgtggtggctcatgcctgtaatcccagcactttgggaggccgaggcaggtggatcacctgaggtcaggagttttcagaccagcctggccaacatagtgaaaccccatctctactaaaaatacaaagattagccgggtgtggtggtgggtgcctgtaatcccagctactcaggaggctgaggcaggagaattgcttgaacccaggaggtggaggttgcagtgagccgagatcacaccattgcactccagcctgggcaacaagagcgaaactccatctccaaaaaaaaaaaaaagaaacttaaccatttcctgtggtgctcagctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggtaggtgtgaagaccagggtggctgaagggcagaggccagacagctgcccgtcccttcctccaggcctcgcttctctacagacagtcggctcatgccacctcaatcccacttagcaagggctgctctaatcatcatggttcatttagcagcaagtgctggaaacccagctcagacttgcttaattaggaaggaaatgtggggccgggagcggtggctcacgcctgtaatcccagcactttgggaggctgaggtgggtggatcacctgaggtcgggagttcgagatcagtctgaccaacatggagaaaccccatctctactaaaaatacaaaattagccaggtgtggtggcgcac

SEQ ID NO: 91825 - DNA, 1005 bp, Homo sapiens
agattcaagcaattcccctggctcagcctcccgagtcgctgggattacaggcacgtgccaccatgcccactaattttttgtatttttttagtagagatggggtttcaccatgttggccaggatggtcttgatctcctgacctcaagtgatccgcccgcctcagccccccaaagtgttgggattacaggcgcgagccactgtgcctggaccattaacctgtttttccacccttttaccctcatatccctcagtccccactgactggacctgctagggtgggagtgggcgtgggtagcagcacagacatggaactcccaggtcttcttcccttggatggttcccttggtggatgctggaggtagcaggggtcagtggatggcagtcaggccttgccttcttcccactggaatcttccatcatccctgcaggtaactgcaccatcccaggctgagaccgtgagccctttctgggaatttgggtgaggcgtatggaggaaggtgagtcaaatgaaggggaagaccctgaacctctcttcaatttccccaggtgttgcagagaagagccgggagcggctgatcaggaacacgtgcgaggcggtggtgctgggcacgttgcacccccgcacctccatcaccgtggtgctgcaggttgtcagcgatgccggctctgtatcctttctgccaggcctcctcctccaggaagtctcctgattgcttccctcctggcggatacatataccctcactgctagccagaaagccttcaaacacttgacaggtaccagctcactgaagaaggagagcaaacagcctgggtgcttacttatgtgccaggcactgttctgtgtgccttatgcacattaactcatgtaatatagcacatgcccttatgatccccgtggaagtggcagagccaagacttagacccagaccgtctagttctagagcccacggaccctggcagatgagtgttcttatgttcgcatgtttcaggtgacaaaactgag

SEQ ID NO: 91826 - DNA, 1281 bp, Homo sapiens
agacagcgtctcacgatgtcacccaggttggtcttgaactcctgggctcaagcaatcctcctcccaaagtgctcatacaggtatgagccaccacgcccagccccaatacattttaacaaaatttggctgctgtgttgattgtggggagtatgggggaaaacagggaggtgatggtggctccagccagagcaggagtagtggaggtgatgagattctggatgtagtttgaaagtaatacggacaaaacttacgtatagtttggtttgagtgcgaggaaaaagattcaggcataactaaggtttctgcccagatctgtacaagtctggaaatcagaagagagacccaagctggacataggcaatttggaactctctggctatatagatggtatttcaggctattgcctgaacgaagtgagtgtagatggaaaagagaagaggtcccaggaccaagccctaggccttccaacttgagcagtcagagacatgtgacaagctagcaaaggagactcagaaggaacgcccagagagttagggggaaaccaggagatggtggtgacctggggccaagaaaagagcatgtctgagatgtgagggctgaccagctgtttcagccttactgacagccgggtcatgggagggttgatcatttggaggtcagtggtgacgatgttgagctgccgcaatggagtggtggggtcacagaaaaggaagaagaggcagctgttcaggagttctgctgtaagaggatcagataagtggggcaggagttgtagattgttgtggggtcaacaggggagagaattgctggagccacgtcttcaagaaggtgagaggggagagactcttgtgctcgggcaaaacacaggcagttcatctggagccagaggcaagttctgttttggtaacttctccagtcctcagggcagtttctcctggaactaagcataccttccgtgtaagggcaaattgggcttcccaggaaatacggccttaaccaaggaccttcccaggccctccctcaggcttagcgcttatgctgaattgagatacctaaagtttcttcgaacgtaagaattaagaagaggccgggtgcagttgctcacagcggtaatcccagcactttgggaggcctctgaggtcaggagttctttttttttttttctttttttttttttgagatggagtctcgccctgtcgcccaggctggagtgcagtgaagtgatcgtggctcactgcaccctccacctcccgggttcaagcaattcttctgcctcagcct

SEQ ID NO: 91827 - DNA, 1049 bp, Homo sapiens
tgtctgctcacaaacatagccaacgtgtgcaccaggttccactgtgccaatgcttcacgttcatcatctaataaggaccctcattgtggccatggggacagaggttattatttgctcttgttcctgttttcaagagcaggatgcccgtgttttgtgtgtgtgtgagagacagcaagtgaatgggaaaaaaaaaagtgcaggagcctggccaacatggcaaagccctgtccctactaaacatacaaaaattagcttggcatggtggtgcacacctgtaatcctagctactcaggaggctgaagcaggaggattgcttgaacctgggaggcagagtttgcagtgagctgagatcgtgccattgcactctagccaaagtgagatcctgtctcaaaaaaaaaaaaaaggaaattgaagtcaaagagggaagtcactcgctaacggtcatgtggcacagagggagaggagcagggactcaagtcattgactgtgtacctccagagcctgggttcttggccctgacctttgtctgcctcagtcctcagagtcaagtaagcttccccaaagcttaccgtaggtgccctgaagtcccttcccttataagagcttttttgggaagcaaacccactgggtgccaggcctgcaccctcatagtgtggagaacaaggaatcggagccccttcctgtcctccggggcctgtagcctgatctagggttggtctgggccctggcttctttgccctagggcagctgagatgcatgagtttgtgtctctccaggcctcagcactgtgcccagcacagcaggaggctccacaccccttagctcatagtgttcttttgttgaggaacaagaagcagtttgagcctcttaggtgggaggtgggcagggaagctttctcagaggagggggcatttagggggcatttgagctaaaggtaatagggtttccacaaggctggggcgtggccctaaccttccctctgggtccctgctaagtcacttcaaatacacgaagttcctgccatgtgccggtgccactccaagtgcagg

SEQ ID NO: 91828 - DNA, 1026 bp, Homo sapiens
gtaccattgcactccagcctgggcaacgagagcaagactccatctcaaaaaaaaaaattagccaggcgtggtggtgcgtgcctgtagtcccagctactcaggaaggtgaggcagaagaatcgcttgaacccgggaggtggaacttgcagtgattggagatggcgccactgcactccagcctgggcaacagagcaagactatctcttaaaaaaaaaaaaaagctggtttgaggattaggtggcaaaccgtggtggagtgtacatgccctgcccagagtcagtgtgccaccctccctggcccggtcattaggacccagggcccgtgcagcccagtggtgagggcagcacccggcatagggcagcaccgtgtgtcctgtccctgcccttctctgtgcctcagtttcctcattgcttagctgtctacctcttagggctgctgaaagccttaaatgattccacacacttggatagcacctgatccctgctgggatttgagggttttcattacacttctgctaggataatcatttccattgtcgaggtgggaacacaaaggcttggagtggttaattccttgccaaggccccgcaggaggaagcagggtcctgcatgggaggccggctagcctgcccactgccccatgtccccacaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgct

SEQ ID NO: 91829 - DNA, 1081 bp, Homo sapiens
cccgtttcagtgctgtccccactgggcagggaccccagccgccactgctgctggttccagtaagcaaagggcagcgggatagtctggcccaggcgggtggagaggttggcaggtagggtgggctcagggttggctggcgtggggcttggcggggtgccccgagggctggggtaggccttgctgagccgggactcggatgtccactcgatgtacactttgaggcccaggagtgtgagcagtgctgacaggcagagaaggcacttggggcagcgcatgacccggcccagggaaggggcggccgcgggagctacaagggagccacaggggagccacggaggccattggggtgtggggatgggcctccagagagggcccagccaggccccaggcagacagcttcacaatctcccatagtccccgccaacccccataacagattctctcggtcccagatcctaaacagctcccctgacccagggacctcgttggtccttattcctagacctaggagtcccccattccaatcccgtaccagcaccctgttcttcccactccgtccaaatgcttccaccttcctaaaagcccaagggtctacctcttccctgtctccatccaggacaagggaccttgccgtctatctcctccctctccctccatttattgccctcaccaggaaatcaggagcgggattcctagctccctggggttagaaacccagcctgcctcccgcaacaccccaaccccagggactggggaaccagggatcccatgcttttttacctctgggtctggctcccgccagctccgggtgccggcctcaggtcaggcctccctcagctccctctgatctgcctgccccagcccctgtgttgtcgaccggcggggcccagccctgcccagccagtccagaggggcggggaggggagtggagcgggagcagggagggccccaggggccggggcggggctgaggcaggagagagggagggagggagggagggaggagggcaggaggccgacctgagagatggggctctggcgtgttagggctggtttctggtgagacagctgggaagggtgca

SEQ ID NO: 91830 - DNA, 1039 bp, Homo sapiens
aggaaaatcgcttgaacccgggaggtggaggttgcagtgagccgagagatcacactactgcactccagcctgggtgacatagcaagactgtctcaaaaacaaacaaacaaaaaatctgggggctgtcatgaaagctgtctagttctcagactgtgacttgagctgagttagcggacccaagcttgtcactgtctgtgggcactcaagggcactctggagaatccatccaataccctggtcttcagaattggcacaactagcacagctgttgagcacagcagccacagggggtcccaaggcacgtgcttcagttggtccctcatctccgtcaaccacaggcacttgtgggattatgatgccattgcatgccatgggcctctggcatcctgtttcccatcagcaagagctcagcgcggcgcccaagcccaaaggcacaaccaaaccaatcctggaatcctatcttaagagtcatctcctgggacactccaggtatcaactctatatccatcaggatgcagtcaggagagaaaaaccacagagtaacttgaacagggaaagtttaatatagagaattactggctttaacagtgaactggaataatgagggcttcactggtaaaatgcttctgaattgactggaaatccatttggggtgctggggaacgttattcccagagaggtgcctcagtggaggcgctgtgtctcctacgcaacttctgagggctggagggtgccaagggcagctgctgaccgcctggtgcttcaggagctgggtgctggggaagccacatgcactgcggcgtccagaggcagaagcacaaccaacaagaaccacgaaggaggcgcctttcctcctataatgcctgtttggtgccctctactgacaaagcttatcccctttcaaaaaacagccaactgaaaaagctgaatttggaacataaagtcaataaatccataaccagcaatactatggggcctggggtgcgctggcctttagtgagtggagtggggcgaaggatgctgcatgtcctgcagtggg

SEQ ID NO: 91831 - DNA, 1085 bp, Homo sapiens
ggtgagattacaggcaggcgccaccacacctaatttttctatttttagtagagatggggtttcaccatgttggccaggctggtctcgaaatcctgacctcagatgatccacctgcctcggccttccaaagtgctgggattacaggcgtgagccaccacacctggcctgtcccatagttttttataatctacaaagcagctgaaggaatcttatcatcaccagctcaaaaccttcaaataagagccaatctccaaggcctaaaacatagctcctactgagctttgagaccccctatcaggactccactggccccttcagcatgacatccctatttcttatttattcaaccatcctaattcaagtctctgagcctttatactctgttccttctcaccactcaaatccctgctcaaatgtcacctcctccaattaacacccaaactcagttagcctccaccatccccactcctctgctccctagccctcacagtcagcctctctgctttgtttggtcatggaattgacattctctgcagtttgctgttatttcctgggttgttatctgtttctccctgtataatagcttggattactgcagtaatctccagactgggcagggatgttatctgccttggtcaccactttgcccccagtgcccagcacttaggaggtgggcaataaatattttcagcctgactgaatctgtctgtgtgcctggttctctggactctgcccctcttaacagcactggggcatcgtgagggctgtggtgctccccaggcctcacccttagctaccattttctctgcagatcttacacctggctggagaagcaacatggtccatacggcgcaggtgcctttttcatcctgaagcagggaggcgcagtcaagtatgaccgctaaggtgttagaacgggctggggcaggtggtggggtatctctctaacatccaggttctgcagtcacacaggcttcagagtcccctggtctctgccgcctcctggctgtgtggcttgggacttgttcctgagcttcagttttgtcacgtgtaaaatgggatggtggtcatttctaacccacaag

SEQ ID NO: 91832 - DNA, 1029 bp, Homo sapiens
cagtcccctcacggttttttagaaaaatatctacatttgtccttatggatgtcaaaatgttacaccatcatttgttaaaaaaagaaaaaaaagatgcacattcatactgtgaagttattaggaaaatactcttgcaaacaaactatataaagataaaacacgcttcaaaagtatgtggtttgttttcttgtttgtctgttttacaatattctataaagtgcagagtcctaagggaaaaaactactccctataacaatagttcaattacagcagcttttgcatagcaatacttagagaaagttggacactacagtttcttcaggaagagaaggatggaagagtatcttctgattcagattgttttttggccataagtctgctttcttcaggaatggttgctgatgccaaatctccattaagtgtattttttgaacagtgaacaggtctatctgggtcttcaagaggaatatcactacaagaatctgtatctgagtaggttcttcggcgtcgctgggagagtcggtgaagtgcagatactggttcttttatacagtggctactcctccctggtgcaagaaccagggtggctgacagaacgcttcctcatttgaacaggagaaggtgacacaggagaaactaagggatccggatggtgccgttgaaacatctcaggtttaaacctggcattggctatcttcacacattcctcaagcgttgtgatgaacgtgttacacgtggcactaagcagagaagaggcttcattgatgttctctgcactaggagatgaatgattctcatcgtggtgaacaaattcctgtatcgtatgaacttgctgcattaagaggtcacagtagaggcgaagttcagacattttggttttcagcgattcactggtttcacttctttctttttcgtttttagtccttgtatcagtcaaacatgctttggagctccccagagcgaccagccacctctgtctttcagctgcgttcactgccttcatgtagaaatgctgctctccaggaatga

SEQ ID NO: 91833 - DNA, 1048 bp, Homo sapiens
ttacatatcctacaattagactgttgccatccactctttcgcctttgtaccagctgtaaccaatacgattctggggcaggttgtgggcgagtagaagaacctccttcccctctgcgacattgaacggcgtggattcaatagtgagcttggcagtggtgggtgggttccagaaggttagaagtgaggctaggagagaggagagagcatcggtcaatattgggacctatgcattagggtggaaaaacagggccctgggtcctgagcaggtctcttcacccctccacgttggagcgtgtgtgtgtgtgtgtgtgtgtgtgtgtgtgtgtgtgtgtcctactgagtcaaagtcagcagtgtgacacccccattccttcagcacctttgaccttggcatttccctgtgtggaatgctcttccccaggggtctgcatggctccctccccactggcctcaggtcctgctcacatcagggcattcttgggagatcccttccctgacaccccctctacagaccctgggtcttttctttctgacctttccctgctctgttccttccagggctcttgtcaacacctgacctcacattctatatctctttgtgtgtgtgttttcctcttcatgacagcataagctctgtgatgactgagacttgtctgatgcttgttgtatgccattgactaaaattgattgcaaatgcttgtggatgagttaatgagtgtatctggtggttatttttcaacttctgattggtgagtaagggcagcatttagtttccttgttatatttttatttggagtgtcatcctaatgcagttctgatttctatcatttttcttttttttcaaatggtaatgacaaatgatgattaacttggaaaacatgatcaattgattttcctccctttttatcaatcccagtttagtgtgactttcctgttgtgacccctgtccctctctggtgttctgtttcctcaggcttcaacaaaagccctctgtctcctctcagagccttgtcctccccaggagaccctagccagtctctgtgctccc

SEQ ID NO: 91834 - DNA, 1030 bp, Homo sapiens
aaaaacaaaaaacaacaaaaaacaaaaaaacaaggggaaaagagtctgcagaggtgaattgggagggttcaggggagaatttgggatttgcgtgtgccccttggacacaggttgggaaagaaaatttcttcctggctcttctctgagagccagactccacctgaaaatgtgatgctagtgcttcatggatccacttaccagagactgtgatcatcgtgactgtggtcctattgaggccagtggctgagttatgggcttggcacatataggatccgctattattcacagtgatgttggggataaagagctcttgtgtggattgctggaacgtcccattgataaaccaagagtactgtgcaggtgggttagaggctgcgtggcaggagaggttcagattttcccctggacggtaattggcctttgagggggaaatggtggggccatctgggccatctggaggaaagagaataaagccacaggtgatgttgtcagagggaagcataagttcctggtctgtggaagggccacggtgtccccctgagccatgtcacaaccctgaagtctcaaccaaacccccgctatgtcccctgagccaaagtctgagacattcacctgtttctcccatcagaaaatgtgaaccctgagccttaaggacatcctggagatgagtgatgatgggaatgggtgtttgagcagaagtagcacaggagacagcccctcccctcccattcttggtcaaggcctggtctgcccaggtttgctcagggcaggaagtcatggccagcctgggtgagggtctgagtccttagacctgagagggactgagagacctggactctggctgtgtggatttgggctggcagcctgggccacagaggaacagaagatactcacagaggacattcagggtgactgggtcactgcggttggcactcgctgggttctgtatttcacattcataggatcctgcatcgttccttttgacgctgagtagagtgagggtcatgttgccattggacagctgcagcct

SEQ ID NO: 91835 - DNA, 1020 bp, Homo sapiens
gcgagtctaagacgctgttttaagaaaaggtcacaaatgagacgaaggtaaatgttattttccttctttctcctgtaaggtgacggagttcagatgactgtgaaatcattgcattttagaactggaagacacttcagaaaactgcttcacaatctttaatgtgctcacagatcccccaaagatcttgtttaaatacagattctgatccttctgatggggtctgagattctgcatttctaaggagcttttggacatgtcgttgcttttggttggtgggccacactttgagtagcaagggttgagggtcatttagacattaattctcattgcacctgattatagatgaagagagactgaactgcagagaaagaatataacttgcttcaccctgccatgcccttactgcatgactttttgtatttaaacccacagctttagcctctccgactagttcttgctccatgcatcacgtagtcctgtcactgttgttggcggcttctctctagcttaggaatccagactccccttttcaccaccttctttggtcttggctcaaggtttcactttggctggttctgccctctcaaaaccttcagtggcttttctgtaatcagatcaaatttgaacgtctgtctagtgttcatttccctgcaacatattatccctgtttagcaagcttacctaacttccctgttttaaaatggtttctttctgcttcagctctccctgctccttcctgttccctacacataccctgttcaggtctctcggtggtagtggtggtggcatgggttccggtgttagactcactgaggttctaatcccacatccaccaacaaccttggcaagttacttcccctttctgaggatcagtatcctccttgtgaaatatccccatatcgtgtgtgagaagagtaaataaaataacatctgcaaacccactcttactcctgggaccttcttcaaaactagcatctccggtggggcctgtgtgtgtctttgtgcatccagagtggtgca

SEQ ID NO: 91836 - DNA, 1080 bp, Homo sapiens
gagctggaggtggaggaggatttgggttggtggagggcagagaggagggccgtgcagagcaggggcgtgttgtaggagaggtgctccctggagctcattggatggggatcttagaggacaggagcttttatgttcatttttgtattgcctgaactcacacagggcctggcactttgggagtattctataaatgactgctgaatggaatgatggtttgtaacctattaacttgtcctgatgtgttagaaagtgggcaaaagtgaagcccattagcagaaagaaaatcttactgaaaaatggtcccatgtatgcatagagcctggtgcggccactttacttacttatgctgctgagttctgcatcagtccacaccgaggccaccgcaggggccgggagctcctcctcagaccttcctccaggtgcctcagtctctttatccctctgttctcccaggtcccgctacctgtcagttcactccatctggtttcccctccatgcacttggggtgggtgtcgcatcctgtgtctcatcggggggtcttcaggtccctcaggtccattgattaaaacacccccaagacaaatggactttcctcttgttaacatgataacttcttacaatgcatctcgagaacattatctgtgtcaagagtctgtctgatgcacagaggccctccctcccccaggaaggaggtcaggggaagttaggagaaaacaccaccctgcctgggttacttatttccctattctacagtgtatttggtagacgttcaaaaatatttgttgactttgtccatgatccacatggctctcatatagtcatttattcacacatacattcagtgagactttgagcccctagtgtgtgcctggtattcgctagatggtggatgctgagatcaggtgtgctgctgtctctgagaagttctcactatacagtggcacctagggtgaccgaatccacctgccccactttacagacatggaaattaaagtgcagggaagttataagattagttcaatgtcacaaagtcactagcctcaaagttacgggaataaatcaagtttcctgactttgtgg

SEQ ID NO: 91837 - DNA, 1047 bp, Homo sapiens
ttctgggaagagttgagcttctctctgagaatcctagggggacccctcaggccaggccctgatccagttctccagggtctttcttagggtcaggtccatggggagaccatggggttcttttctgacactgaccttgccctgctgagtccccccatcagactgtccttcctctgcagcgagtgtctgcagggtctggatgcaggaaaggaattctgatctgtggaagtttgtctcccccgtgtgtgtcctgcactaaatgtccaaaccctgatacagaatgtaatgcagagagggccacaggcacagcccaggcctgacaatcccatatgtgggaagtagaactgacccccaacacccagaggtcatgtggaaatactcacggtatacatggaactgtccagttgcttcttcattcacaagatctgactttatgacttgtagggtgtagaatcctatgtcattctgggtgacattctggatcagcagggatgcattggtgtatattgtctctcgaccgctgtatgcggcccctggggtagcttgttgagttcctattacatatcctacaattagactgttgccatccactctttcccctttgtaccagctgtagccaaaaagatgctggggcagattgtggacaagtagaagcacctccttcccctctgcgacactgagcggcatggattcaatagtgagcttggcagtggtgggcgggttccagaagtttagaagtgaggctaggagggagaaagcatcagtcaatattgggacccatgtattgggatggaaagatggggccctgggtcctgagagagtctcttcacccttcagccttggagagtgtatgtgtgtcccacttggtcaaggtcagtaacgtgacctttctttcttcagcacctctaaccttggcattttcctgtgtggaatccccttccccaggggtctgcatggctccctccccactgccctcagatcctgctcacatcagggcatccttgggagatccctcccctgacacctcctctagagaccctgggtcttccc

SEQ ID NO: 91838 - DNA, 1734 bp, Homo sapiens
tctctattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacggtaagcgggggctccgagctggaccgggcgcgaggtggcagggccggacgccgaagcctcagagcgcgtgcctgagggccccgaggcgcccggcgcgggcccgtcccgccccctagagccgcggccacgtgcgagcggcaggcccggacatgcccggtcagcgccgtccgggaaccgagcgtgggccccggggggcagcggcggggtgcgtggggcgtccggagtcccggggctggggagtggggtcgcgcaggatcctcacacgcaggggccgggctctgttagtgcgatccagagaggccgtgggcgtcggtgagctccttcagacccgcaggagccggagcccggcgttgaaggggccgtgggaagtaacggggggtaccacggtttaggatgcgctggagcgaaaggattggggtggggtccgtgctcttggcagtcgtctctgccaggcctgtgttcacatgcttgactttctccctcagatgcctggagttactgtaaaagacgtgaaccagcaggagttcgtcagagctctggcagccttcctcaaaaagtgagtttggggactgaggttcaaaacgggtggaggctgtcgccttggcctgcccatctgagccccagtgtttgccggtcctggcaggggaggcttgtttggggcctccgtggctcctttcagcgtgaggcctggcttgtgttccggttccagcctctctttgtactctgggcacagcatagttgtgttgaggggagggcatttgggatatggggtagtttgtggagatgactgaatcgtgcttttcccactgttttggtcttaggtccgggaagctgaaagtccccgaatgggtggataccgtcaagctggccaagcacaaagagcttgctccctacgatgagaactggttctacacgcgagctggtgaggaacttaggtctttggctggagagtggggagctgggtgacccctggcacaaaccatacttccctgtctcctctgagctctttcccgccccaagagggagagaaacccttggttgtgtcaccacttgctttgtgtgatgtgacattcgataacttggtactccaagtttttatgacattctaagagctttgtgagaggaggacctgtggctttgagcctcaggggaaaccagagacagatgaatgttcatattttgcttacaggtggtttaatcctttctatatacacggaggcagactccctgggtttggatccatcttttacatctggctgtgtgtcctctggcaagttggttaacctgcctgtgcactctctcatccccaaaatgggactaattattgtaccagtactagagtattgcaaggattgaatgaatttaaagcagagtgtttagaacgtgtctgttgcacagtagttattcaggaaaaagccagttgtctttactattgctcagatcatcaagttagccttctccatat

SEQ ID NO: 91839 - DNA, 1221 bp, Homo sapiens
catggagatggtcacagctaggctccacccctacataacctcaggttcaattcaacagcagtgctgctgggatagtaaccactaaagaagttggccctggagatggtgggagtgcccacccagggtgcagggctgtttgtcaaggaagagctagccgggggggtgggtgaggagagggggctgtcagtttctgggtgttagtgtgtgttttcagtttcccttcttataaaacagtgagaattagctgtttacacacaaggaattgtttacctgagaccttgatcaagacccttaaatctccctctcacactacccccagcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatgggtaagcagggtagggggggctgcattgatggagtagccttgaggcccggtcatcaattccccaacgaatggtcctgcatagtctgcccagcccctcaggcccctcctatcagaggcaggcaggaggggattctgcagaaaagcaaacagcacggggcctcaccccgacctctctggctgactagcccaggctccaggagggtaatttagcgactatctgctttcattagcctgctcgttaacttttcccaattgatttttcggggcttttgatctaaatgcttgcacaaacaacaccccgtcagctcccaggggggctcccactactgcccccagctcgttagaatgcacctgactagggccctcagtgggacttggctggcggcaggtggcttcttgagaagcctggctcacagccaggagggaaggggctgagaacaggacctgtgctcactggggcctgcatgacccttccctccccacagcggccgcaaactgacacctcagggacaaagagatctggacagaatcgccggacaggtaaggcctgcgtttggggtggggctgggtcccttagtcgctgcccaagcatttccaaagcccatacttcgtcaggtagacttatttccttctctggagggcacagcccagggtgctggtggggtcagaggagggctgcccagagacaggagaaaggacagtcctgtctgacttttcct

SEQ ID NO: 91840 - DNA, 1047 bp, Homo sapiens
ctgttgggggaagtggggaggaggagggaggggctggggcgctgccggcagcggaggggcccccttcggaccccacggaaccagcggccgcccctccttgggcctcagttttcccatctgtcaaagggagcaaagaggggagaactcacacttgacgagtgccccataggtggggacgaacggtgcgaggccggggccaaggcctcccacctgctcagtggagaacggacgatcactaccattgtacgggtggggaaaccgaggcccggggagccaaaccgactcgtcccagggaacgcacatcgtgagaaagtgtggagttgggatttgaactcgcacgtgctttccgcaaagcgccatcctccaacccccgcatgctttagggccacctaaaaatgaaaaacaacgataacaacaacgacgagggtcgctgtgaagctgaaagttgcagagtgcatttgaaagagttttcggaaagctcttttctaggtcattaattataccgtgagagacaggtgtagggagagagctggaggccttctcccattgtacggatgggaagactgaggtctacagagaagtcattactttttgcagattacactgcatgtcagagggaaagttgtgctggaactcaagactattgcttttccggttccaaaggaaggggctgggggtgggagacggaggggattgatgtacgaggattggaaattcagcgggtcccctaagtggggagactaataggacggggagccccagtccgccgtccgagtgctcagcgctggggtgactaggagatctccgatcgaactcgggaggagttggacccatctgcacctccgggcgcggggcggggcccggggagtgacgggggcagtcgagatacggaaacgctggccctccaagacaggccagagcggccctatctggcctgcgtggcgcagtacagcgctagagcggccggcgggaggagtagagtcgtcggggccggagcccggcaggagccgggctagagcggctggcaggaggagtggagctgggcgc

SEQ ID NO: 91841 - DNA, 1091 bp, Homo sapiens
tgacacgggctccgtggcattagtcagactaattaaggacacagaagatgtcggtggaaagactcagagagaagtggagactcaaggagagacaaagatgggagagacagcaagagatgggggagaaaaagggatggagagatgagagacagcacatgagactgtgactcagagaggtgtgaggatggtggctgcagaaaccagatgtgggaggacagaggcacagagacagggacaggacagacggagctacagaagcaggaagggggtgtcaccgctgagagggagagatggagggaggagaggcagggatggtggggaaaatgagacagttctggaggaagggaaagagaaaaatcaggaaacagggtgaaaagagaccaagacatgagacagattcaagggacagacagccaaggagagctggctgcggacagaccaaggcgcacgtagggtggaggggacagacgcaccttggagatgggctgtctgaggccccatcacttggtttctgggactggaagcctgggaagagatgaggtccctgggggaaagaagaacttctgggtttggggactcccagtccctgagggaggagggttctgagttttgttttcttatgtggagagttgggggttgggggtttgccattgtgacttcctgtcacaggaagtggggctggtgggttccaaggcaacatcctgtcccaggcctgtcacagaccagaggagacccctgcaccccacttctctcccgcctctcctctaaccctcccatcccctcttgcctctgggctgtgccctcaggaattagcccccaggcccctggtccctccaacctgggagtccaggcccccagccccctcttccattagggcattagggaccccagattgcaggctgtcagactcagccttcccatggacccaggctcctgagcctccaacgcctgcccccgcaaggctcccgtccctgggctcccgccccctggcgggtctctgaagggctctttgtggccacacagaggccccattgagctgcggaggctgggatgggggaggctgtttactcaccttcacacctgggccagga

SEQ ID NO: 91842 - DNA, 1454 bp, Homo sapiens
tggaggcagcacagaatccagggccctcccgacctcagggggctgcagtctggttgggtgggagagatgtttgtgacctatttgctaggcctggggtccccatccacccaggacacacaggggcacccacttctgttgcatcttcatgctcctgcccctagtggccatgttctgagaggtcttaacatctgtccgtcccgtgctgaagtacagagcagccatgtggtgtctgccaggcactgggtagctttagcccccgcaattccaggcccccagagtgtgggtctcgtggccgcagaggccttccagccagccctgctccctccaccccacaggtgctgacgcccccctggagctgggggactcatccccgcagggcccaatgagcctggagtccttggcgcccccagagagtaccgacgagggggccgaaaccgagaggtgcccaggctggggtgcaggggcgggaggtgtggcttactgggcgctggtgggtgggtgcagggtcaccgctgccatctgtgcctgcctgtcccaggctcttgctccccatgctcctctgctgctctctgggtctggccattcctctcccttcttctttccttttctcatctccctcctgcttcctcattgcccccctttccttttatccttcctttttcctctgctccttcctctccttccttttttcactaatccttctcctcctcccttcctctccaccactccttccatctcctttatttccccctcctctctcacctcccctctcctctctcacctcccccctcctctctcacctcccccctcctctctcacctcccctctcctctctcacctcccctctcctctctcacctcccccatcctctctcacctcccccctcctctctcacctaccccctcctctcacctccccgctcctctctcacctcccctctcttctctcacctccctcttcctctctcacctcccccctcctctctcaccttccccctcctctctttcctccccactcctctctcacctgggttttctttccccaccttccatccccctccgatctccctgccacttttcattttttcagcccttcctccccttctctttcaagcccccctgccccctgccccccaccccccgcctcgctcctgcctcctggtgcccgtccctcaaccccccacccctctgctctgtgccctgggggccctgtcccccttacagctggggggcaggctctgcctcctgcccgtccttgtgccgctgctttggggaccctttggtgggtgcggggaggtgggtcaggttccatctgggcccacctctgaccctgtgcccctctctccccagaaggtggaagaggtgggtgcctgggccctgggtgggggaagggctagcccctcccccatttctcccagcccctcccctctccccatggccactccctccccttca

SEQ ID NO: 91843 - DNA, 1085 bp, Homo sapiens
ctcctcccagctagacacatggaattcaggcccgggacgggtcctgagcccaccctactccagtcccagggtctgggcttccagcctgtcgtactttagtccctgttcttgcccatccccactgagacacctgcctggcctgaatctcgctgtagtttgatggtgctgagggctcctggttccagaaaatctcctcccgcttctgcagccgccagtcatttgccttagagcagctcaaagccaagcaacgcaaggaccctcggttctgtgccttcgtgcaggtgaggtggggtctggactccagcttcccagggaggaggggcctggagacccagactcctaggtgcctgcgccctggggtgagcccaaagcctgggccatcgcaacaccagcatgtttcccgcaggaagctgagagccgcccgcggtgccgccgcctgcagctgaaggacatgatccccacggagatgcagcggctgaccaagtaccccctgctcctgcagagcatcgggcagaacacaggtaccgcgggcctggatctctgggcctcggctctcctcttttttttttacattttttttctcactcattttcatcagtgataccatcacagctcactgcagcctcaacctcccaggatctaccatcctcccacctcagctccccaagtagctgggaccccaagggcacaccaccatgcccagctaatttttttagtttttttttttagagacggggtctcgccatgttgcccaggctggctttgaactcctggtctcaagctatcctcccgcctcagcctcccaaagtgcttggattacaggcgtgagccaccatgcccggccagctgtcctttgtctaaccttggctgcccaatctggagcctccagggcaggggttcaccagagctgctctctcccttgcctgcagaagagcccacagaacgggagaaagtggagctggcagccgagtgctgccgggaaattctacaccacgtcaaccaagccgtgcgtgacatggaggacctgctggtgagcctgggctggccccacacccgggacagtggatggtgtgagagcagggggt

SEQ ID NO: 91844 - DNA, 1050 bp, Homo sapiens
cactggaagcggctggagggtgggagtggctggaggggtttcgttaggtaagccagggtacatgcccgattccataaggaggtgtgagaggtggggctcaggaggacacatcgggccctggatattagcagacagtgagtggtgagttgagccatgggagccctgagagcgccaccactgtgggtgacttctccagcttgtgcttagggaggggcaggcactggggggacctgggctctgagccccatctccccctctccctgcagatcacaaagccttctacgtcctttttacctgggaccaggaggcccagatatacgagctggtggcacagactgtgtcggagcggaaaaagtgagggggggtctgagttctgagtgtgggtggaggacgcccaggtttctgggttcccagggacaggagggctgtggggaggccctggcatagggtctgggggctctgactgcccagggatttggcctttctccccagctggtgtgctctcatcactgagactgccggatccctgaaagtccctgcccctgcctctcgccctaagccccggcccagcccgagcaggtgaggggggccatggagagagctggaggttcagggagtggggccggaaggcggggcaggcttccctccacaactccagaaccgtctctgtgtgagcatgcacatgtgtgaatgcatgtgtgtgcatacatgtgtgtctgtacgcaagtatgtgactgtgcgtgcatatatagtgtgtgtatgcatgcatgtgtgcgtgtgcatgtgtgtgcgtgtatggtgtgtgtgtatgcatatgtgtgcatgcgtgtgacagcatgtgcatgcatgtgtgtgtgtgtgcgcatgtgccgaccccaccactgccccgtctgtctcctgtctccaggcctctgtgtcttccattgtctgggcctctctgtctccctgtctcccggcctcgacctctgtctctgtctccggacctccctgcctccccacctccagctctctgtctccctgcccctgcggccccccagggccaggggtgtg

SEQ ID NO: 91845 - DNA, 1049 bp, Homo sapiens
tgaggagtttggattcgatcccgagaacctggagcttgtacggattgttggggggcagcaggggttactctgggagagggcatggagagtcggaacagcaccccaatgccatctgcccccaggccgagaggtgagcccagcgcatcagtatgctctggctggaggcatctccttccccttcttctggctggctggtgcgggctcggccgtcttctgggtgctgggtgagtacagggtctgagcagctggggtggatggtgggagccaggtgcaggagtgtggccctgagctgccggctttcctgcaggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaatattcccccagcatcttctgtgggtctctatgggtggagctgggaatactgcacagagcagggttggggtggaacctggggtgtgggcaagacgatgacaaggtaaacaggtaaaatattatgggatgcccaatggtggtgagtgttcaggaggagaaaagagttgagaaggacagtgtgccgggggtccccgagaccacccccaggtttgatggttctttaggactcaggaatcagagagcaccccaggtttgatggttctctgggactggggactcagtatgcaattgcactcacagctctgatttactctcatcaaagggtatggagccaagtcagccaaaaggaaaggtgcatggagtgaactcgggaaaccaggcatgcacttccagaggccacacctaattcctccagcagtggatcatggtgacgtgtgaaatgtcagccagggacactctgatcctagcctcagcgcccttggtttcatggg

SEQ ID NO: 91846 - DNA, 2042 bp, Homo sapiens
caggggcatcagcatcacctgggaactcagaaatggaaattatgggctccaccccagacttgctgaatgaaaacatctgggctagggcccaggaatctgttttagcaagccctccaggtgtttttttatgccctctagagtcagaaggacagctctgcacggtccccattgtgccttccctgggagagtacacaacgcccgcttctgccgttagagttcccataacgccctcgctcctgacagcccacatgcaccctcctgaaactacaactcctataatacccagaggcgcgcgccgtcactttctgggattatatctcccaaggtgttttgcgagtcagaccgccatcatagcgcccatcctcttagtcaccgtcaggactacaactcccacaatactcggcggcagaactacagtccccagctgctccggggctgcgccacgtcgactccgctgggtggggccggcgtcgggcggggccggcggggtcttcagggtaccgggctggttacagcagctctacccctcacgacgcagacatggcagcgcagaaggaccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggtctcctctaatgggaccctggagtctgggcccctagtcccctccctgcctgctgtacaggaatctggggtcccgggagggagtccaggcacccttagtccccttcttttgcgggggtctggggctccatcccggtccaccactgacccggccccaccccccgcaggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtgtgagtgcctcccgggccccgcacccgcactagccccgaccggctggacccctcctctcgccgctcaggccccgcccttcaccgcccggtccctcctctcaccgcccagggccctcttctcaccgcccaggccccgcccccaaggattggctctgctagactaccttgtcaccaaagggccaggtcccctaccccaccatcaccctggccaggatgcagtgtgactaaatgtcacctggccctccctggtctccaggatgtagcttgccgcccgccggtggagaaggccagggccgtcgggctggcccagccccagctgtctaaccgctgcctccctgcactcctcctccagggtgacgtcccctatgttgctggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaac

SEQ ID NO: 91847 - DNA, 1439 bp, Homo sapiens
caccagcgcctgccatggagccttcccttagactcagcctgaacctcaggccccacctcccctggtgtccccactgcagtccccattctgatgcccccgagcctcccccataggctgctcccaccacggattactccgaagaccccaggccccagccccgcccagggcaccctccacctgtgagcacgaaggatcctgggagactgcccctctgcgtcccctccagtcccctgaaactctgcctctcgttagggccccgcactcaagccctcctgctctcccctctgcaggcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtgtgttgtgcctgctttccagacggggactgcggctgggacagcatcccctctgttggggcgcgctgccaggcgactctcgaaactgcaggaacttagcctggcactggcttggaagtcacggaatctcagagccatctaatcacggagttttcaactccacgaaagtcagagcagcttgaattcaccaggcgatggcattgtggaatcagaacaggggagagggagggaagcagacgtgggatggtgactgggagcctctcctataggagtaggacccaggggacacaatgacgatgatgatggtgatgacagtgattcactgagtgcctgctatgtgctctgcccacttctaagtgtgcattaaatgtgcacagagagaa

SEQ ID NO: 91848 - DNA, 1042 bp, Homo sapiens
gccgtgatcatgccactgcactgcagcctgggcaacagagtgagaccctgtcccaaaaagaaaataatggtgggtgggctggggggtagaaaaggacgctggacaggccgggcgcggtggctcacgcctgtaatcccagcacttcaggaggccgaggagggcagatcacgaggtcaggagattgagaccatgcaggctaacacagtgaaaccccgtctctaataaaaatacaaaaaaattagccgggcgtggtggcaggtgcctgtagtgccagctactcgggaggctgaggcaggagaatggcgtgaacccgggaggcggagcctgcagtgagccgagatcgcaccactgcactccagcctgggcaacacagcgagactctgtctcaaaaaaaaaaaaaaaaaaaaaaaggacgttggatgagggcagaggaggggcagagggagtggggctccctggcatgggcgcctgctctgagcctgcctgtgccacaggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtgagccctggcagccacccttggggcccaggagggtggagtcctcccctctccggctcacccggcctcctccgcctaggtccctgccatctcactggcgtacgaggctgccgaaagcgacatcatgaagagacagcccaggaacccgcggacggacaaattggtcaatgagagactcatcagcatggcctacgggcagattggtgaggcaccggggactccatctccttaccacccagtgccgggcctagagcagtgcctggcccaccgtgggtgcttgggaccctggcattgactcaggggagcagacgtgggcaggaccaaccagtgagctatctgtggggggggtctgcaccccatccttctccacctcctcctctctgctgttgatgt

SEQ ID NO: 91849 - DNA, 1727 bp, Homo sapiens
ccccatctgcactaaaaattaaaaaaaaattagccaggcgtggtggtgggcacctgtaatcctatctactagggaggctgagacaggaaaatcacttgaacccaagaagcaaaggttgcagtgagccgagattgcgccactgcactccagcttgggtgacagagcgagactccatctcaaaaataaataaataaataataaataaataaataaataaatccactgccccaaagtccttcctcaggtctgcccgcacgccctgctgcagtagcccccttctcccctgcttctcccagaggcctcttcccccagcccctggtcctctggctctcctggttgtggggctggcccctctgtttctctgtctttcagggatcactttgccactcctcacacaccctgacctcagccatcgctctctctgctcttcccagggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacaggtgggctgcgctcccgcagaggaggggacggggccttgactcctgggtcctcactgaggccggggcctggtttcctgggtctgagggaggaggggctgggggtctggacccctgggtctgagagaggagggtctgggggcctggactcctgggtctgagggaggagggggctggggacctggacccttgggtctgagggagggggcctggacttctgggtatgagggaagaggggataggggcctgaactcctgggtctgagggaggagggggtgggggcctggacccttgggtctgagggaggaggggctgggggcctggacccctgggtctgagggaggagggtctgggggcctggactgctgagtctgagggagaaggaggctgggggcctggacctctgggtctgagggaggagggtctgggggtctggacccctgggtctgagggaggaaggtctggaggcctgaactcctaggtctgaggggaagaggaggttggggacctgaacttctaggtctgaaggaggagggggctggggtcctgggcttctggatctgagggaggggactctggggactggcctctgggtgtcatccttaccctctctccctccagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggtgagttggccaggggtggccctggagaccagggtcactaccggaggcctgagaccagcaaggggaactggccagggctgcagggggatgtgtggcagagaccacaggccccctggccctggaggagcctgagcctgtccttttctgtcttcctcccctgtggggtcgggagctcccctgggcaggactgagctgacacacttcagggtccctgcgtcatccagcccaggccccatctggtgggtgaagctgacttggaggctttttaaagatattctcagccaggggcggcagccacgcctgtaatcccagcactttggaaggctgaagcaggcagatcatgaggtcagaagat

SEQ ID NO: 91850 - DNA, 1034 bp, Homo sapiens
gaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtgcgaggctgccgggcgggctctggggtccctggagggcaaggagggttgtgatgctgcccaaagcctgtctcagcccagggcctcccagaatatactgtaaatgaatgaatgaatgaatgaatggatggatgagaggggaaggtatcctaggaaatgaatgctgactggccgtcttgctgatggggagatggaatgcgggcgatgcagacatctaggggcatggggcggaggttccgaggctgggaccctcacaccccaacccttccctgccactaggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtgtggcttggggtggctgggggaggcaaagccaggcgtggggcgggagaggccatccctaaaaaacaatgcctgcaggtcatcatggtcaccggcgatcaccccatcacggccaaggccattgccaagggtgtgggcatcatctctgagggcaacgagactgtggaggacatcgccgcccggctcaacattcccgtcagccaggttaacccccggtgagccacccatcccagccagggccctggacatccctctagggtgttgacacagggggaccgcttccccccaacctccctctgcactgcctgtcccattctttctgggactcctccatggaccaggccctgggtctggccctccctccggtgtggggacattgcagccacagaggtagccaggc

SEQ ID NO: 91851 - DNA, 1082 bp, Homo sapiens
tcactgcaacctccacctcctgggttcaaggggttctcgtgcctcagcttcccaagtagctgggatgacaggagtgtaccatcatgccctgctaatttctgtatttttagtagggatggggtttcaccatgttagccaggctggtctcgaactcctgatctcaagtgatgcgcctacctcggcctcccaaagtgctgggattacaggcgtgagccactgcacctggctgttttgcactattatgcatgtggctgctatgagcattctagtccctgtctttgggtgtctctgccctgtttctattggtctgaattgggggtggcattgctgggtgctgcctcattcttttccaggccctcaggattctctgggggctgggcagctgggctgtggccctcgtgtcgctcatccaaccctgctgccgggcttgtccctgtaacttgcctgcccttgctcgtcctccaggtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcaggtgagcgcaggccccgggtgaggaccatgggggcctggctccaggagtccctggccctcacacatgcctcccccagggacctcatttgacaagagttcgcacacctgggtggccctgtctcacatcgctgggctctgcaatcgcgctgtcttcaagggtggtcaggacaacatccctgtgctcaaggtgggttcagctactggcctcacctcggccctgcctgtgtcctcccctcagctgtccctgttctgacaaccctttctccttgcagagggatgtggctggggatgcgtctgagtctgccctgctcaagtgcatcgagctgtcctctggctccgtgaagctgatgcgtgaacgcaacaagaaagtggctgagattcccttcaattccaccaacaaataccaggtactctgggct

SEQ ID NO: 91852 - DNA, 1825 bp, Homo sapiens
ctcacacctgtaatcccagcactttgggaggccaaggtgatagatcacaaggtcaggagatcaagaccatcctagccaacatggtgaagccccatctctactaaaaatacacaaaattagccaggtgtggtggcatgcacctgtagtcccagctactcaggaggctgaggcaggaggatcgcttgaaccaggaggcggagattgcagtgagccaagatcatgccattgcactccagcctgggcgacagagtgagactctgtctcaaaaaaaaaatcgacagacccttagattcaaacacaaccattacagaaagagggactcaagcacaaacaggggagactcagacacaccaaccctcataaccaacctagggtcagacacacaaatacagacccccactgacacaaagctcccttcccagactccaggcgagcagggactggtggagagtggcttgggcggcccctgatcaacatccccacatctccccacagctgtacctgggcatcgtgctggcggccgtggtgatcatcactggctgcttctcctactaccaggaggccaagagctccaagatcatggagtccttcaagaacatggtgccccaggtgaagggtgcccagcaaggggccagacgggggtgttagtgtatgggctgggggccgggcccagtgacccccaggcagagggagtctgggaggtgacattactccatcccacctcagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtgggcctgggcctagggcccggctttaccctccctcgggctgcccaggagctcaggcccagcccctcctccctcacactcaggagtccaggtcccaacccctcctccctcagacccaggagtccaggcccccaggccctcctccctcagacccaggagtttaggccctgggccacctcctcacccaacagtcaggagtccaggcccagccctcacctttcggagatccttagggaccctagaccttggccagcagcactgtgccttccccaccttcaagatcccagcctctggcctcccacacaccactcacccactgggcacccaggcttctagctgtgatctccaggcacacaggcttcagccccaagccctgtacacaaataccctcctgtcccaggccctggactgaaccctctctctgctgcacctacccccaggtggacaactcctccctgactggcgaatccgagccccagactcgctctcccgactgcactcacgacaaccccttggagactcggaacatcaccttcttttccaccaactgtgtggaaggtgaggcgggtgcagagaagacacacagctggggcagacacagggatgtgtcccagggggtcaggcctccagaacctccctgagccaccccacctcagcctaacccctctggcctgcaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtaaggccaggctcctgg

SEQ ID NO: 91853 - DNA, 1121 bp, Homo sapiens
aaaaaaaaaaaaaaaaaaaagacagatatgtaggaaggttggacagggccagggagagggaagaagagacagaagcagagttaaaatgtcacatagaggtggggcacggtggcttattcctataatcccaacagtttgggaggctaaagcaggaggatcgcttgagtccaggagttagagaccagcctgggcagtgtagtgagaccccatttctagaaaaaaattaaaaattagccgggcgtggtggcacacacctgtagtcccagctacacaggaggcggaggcgggaggatcacctgagcctcagaagtcgaggctgcagtgagctgtgattgctgcactccagcctgggcatcagagtgagacattgtttcaaaaaacgaaaacaaagtcacatagacacagaacacaaaaggggagagccccgcaaagatgggcacagaaacagagagagactgaaacacaggcagaagccagacagggaccttcggggacagagactcagagacacacagaaccagagacagggaagctgattgcagcagatgagactcacgaggcctgagagtcaccagaggcagaagggaggtgaagtcacccagaggctccgggagacacagggagaccccgagaggcagacagagaccccccacccagagatgcaggggcaccggccaggaggatagctggggcatggagggccggtgtcctcctggaaccccttctcgcccgcagtctggtggctctgacagctatcgtatcgccacctcgcaggacaagaaagatgacaaggactcacccaagaagaacaagggcaaggagcgccgggacctggatgacctcaagaaggaggtggctatggtaagcctcgccctctgcccgcacaccctcccagagaacctcgccagttcttggctggcctaggcactcaccgtctcccccaaactcctgttcctcagacagagcacaagatgtcagtggaagaggtctgccggaaatacaacacagactgtgtgcaggtgtggccaggctgtgggctgggaccctgggaactagggaggaggagctgggggctaggacccctgggtctgagggaggaggggctgtggctggtgtcttaa

SEQ ID NO: 91854 - DNA, 1084 bp, Homo sapiens
ttgcttggacttctcaacttgatttgggtggtgcaggtctcttttctccagatcatataggaataagctgaggataagctgaggtctttctggaggtggtagtgcaggactggctgggatttccgggacaggttgaatttagaggggatggtggttggtttttgttttttgttttttttttggagatggagtctcgctttgtctcccatgctggagtgcagtggcatgatcatggctcacagcaacctctgcctcctaggttcaagcaattcttgtgcctcagcctcccaagtagctgggactaaaggagtgtgccaccgggcctggctaatttttgtatttttagtagtgacggggttttgccatgttggccaggctggtcttgaactcccaacctcaggtggtccacctgccccggccttccaaagtgctggggttacaggaatgagccaccgccctggtcgaaaggatggtgttctgtgttgaggtccttcataagcaaagtcccagaggcaggtgtgaatctgggcttttaggcctgactggagttaagtgtggatgtttgagggggcggtgtagatgttgaccaagtggggtaaggaggtgtgtgcaaagttggtggtccttcagcgtcagatatatgtgtcagatgtgtgtccaggatgccccacatgccagcttgcagagggcttcctgtgctgggctggcatgtggtccaggagttgccatgtgccagctgtgtgttcgaggcatgcggtcacatatgctgtgggccgcacgtgagtgtgtcagtgtctcctccccatcacgagcatcgggggtggtggtgagtcacgggctcagccttcggcgccaactgtcatgtttcttccccccaaatttcaccccccacccagccatgcaccacccacccccactccaagatctgtgtcgcttctctcttccatccccctgtcctgctcagctccttctgagaggctgcagggtgttccctgggaaggagtctcccacttctggctctgccctccagcttcctctccttgtcccatccacctttcccactgcctctctgctcctgtgacta

SEQ ID NO: 91855 - DNA, 1797 bp, Homo sapiens
gcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggc

SEQ ID NO: 91856 - DNA, 1044 bp, Homo sapiens
tggtttcccctgaaaagcgagctactccaagggtgtttacggcctcccctgtggattatgttgccttgaaagcccagggtcctctgtctcctagggagggagttgagggcaggatcttcaggctggggaacatggtcgcccctcctctctccttctcatggtggcttgggaaggtgaagctgcagacgtgggcaggtctagggtgccaagatttttcctctcggtctgggtgggagcgaggcccaaccagggtcatgctttaaggaacatggggcgtggattcaagacgcctgggtccatgtccattgtcagctccccagagcaggggccgtgacatcactggtgtctggttcattgcttgccacacagacaggattcaagggacatttgtggagcaagtgaggaagaacccgtgcaacagtagaggctggggtggggtggggtggggaggagcaagtcctgagtgggaggcacagccggaggagcagagggattcagacatctttgggttgaattgaggggaagttgacagatgggggcatttggaggatgaggaggatctcaggatgaccctgggtgtcctttccaagcctctctccttcacctaggaccagtcacctccacccaacaccaacaaggtctacattagtgcagctttcacagttccccacctctggcctcacagctacctggtttgcggaggggagtgaggatctctgtgttagagagatccctctgatgtgggaagacggcatttgtgtttcaaaggcgtgtacagacccacgtatttacccacatgctatatgcttgcttatgcctgaaacagtgcttacttttcactagttatgaattttttggcattaccgtcaaacaaaagttttccaattagtacaaggccttcctaatagaagacagaaaggtccctctgggccatgtgggaaaggccaggatgtgagcacaagaaccaggtgtcagctggggcagggctgggtgggtcttggggtggagatgaggttggcaggatcagctgaggagtatgagatt

SEQ ID NO: 91857 - DNA, 1035 bp, Homo sapiens
gcaggggacaatgagaaagaaaaaacagtgcggggcagctgcagctgaggcaggtgggcaggactgtggggcaggaaggaaggacctcacacctggccccccaccccccaggctggccatgcctggcagagtacgaggaaattggccaaggccctggtgtgtgtggactgtgtgtggagggtgaggtggcggtgtgtggtaaggagggatgtactgctctccctacccatgtgatcaggtcccagtcggctctggctggtccctgaagctacctgagatcatccctgtccattcaccctgtcccctccccaccgtggctcacaggggcccagaggaacgtggaaaaaggcttgagcatccctgacttctggcctggggaatggggagaaaggtgtgtgtgtgtgtgtgtgtgagagacatcactttggacgtgatcccctttcagtttctctctagctttgccatctcagagtctctagtgggttaccaactcccctccaccactatctgccgtctgccttttatctctctggtctcctttctctctcactctcactcagcctttctgttcctctctgtgcattgccccctttctagttctccctgcctctggcccccgttctctctttatctgcgtcttctctctgtgtggctccatcactgggttttctgctctgttgtgtgctctttctctgtttctctctccgtctctccagtcactgtctctgcgtctctctctgtcgtgctctctgcatttgcccttcctctgctctttttctctgcctttgcctcctggttttggtgtctgtgtcccttccagtctctttcatcttctgtctctgcttctctgtgcatctctctgcgtgtgcctctgtctctcactctgccgttctctttctcttgtcgtctctcggggtctctggctgtccatccctgcctctgtttgtgtctctctcgctccccctccctgtccccccctttttttcctgtttctaacacccacactcacatcctacctctggagtaattgctttt

SEQ ID NO: 91858 - DNA, 1607 bp, Homo sapiens
cttccttctgtctcctcaacttgcctgtgagccccgtaatagagcagagaccttgtctaattcatctctgtcccctgccacacttgattcagagccagagaaatctcaatatttgttgatgaactaaatgcacaaatgaatggacaaatgtacaagtcagaaatatcattatgacttttatttttaatctccccagagcacataggaacttaataatgagtaaccttttcaaatttctttctcatttgttcctcgtagcagtcctttgagatacaccatttaatcagttaattcctccatccacccatccattcactccgtcgtccgttatgcactaattgagcatctcaaatttgccaggccctctgccaaacacaaaagcttcaagacacagttacagtccctgcactttaagaagcttccagtctgatgggaaaaacagatgttccacagtggcaggcactagtatgcccatttatgagttggggacacagaggctcagaggccagaagtgactactgaaggcaacaagtggctgactggacctgagttccaggcacctgactccacagttagccaactgcagctcctgatgatgtgacaggaggagggttcctccactggaggagtgcatcatcctgcatgaggatggggaattctccgggatgttgactgcattctcctctctctccaggttctcgactggaccgggttggtggcctgaatgtattagcttcgctgcgtctgcccaagaggtaaggaccacggccttagagttttgcttattgatgcaccttctggtttctcacagaagtctctgctttcccatcctcgtctctggcctcaccctgggtgtgttgctgcccttctccactctgcccacccagaggttagaatctgactgctttgttctcaccctccatgcatcctgtggctttcgggccaaaccagtggttcttggtgttgatgactgtgggtgtttctgctgatcagtgttacggctcagtaggagagagatgggggtaactcggtggctcagatcacagctttgggttcaagcacacctatgttcgaatctcttttcctgacttcgagggacttgggaaagtttgagcttccatttccttgtctgtaaatgggaatactaatagaacccaccttaagtgccatcctgagagcaaaaggagatagaggaagaagagccaggtggctgagtgatcctgggcatggctcagtttccccatctgtcaaaggagggtaattaatagcatttaccacatggaggtggcgtgaagatgaaagtacttattccttgaaatcgtgtggctgcaggaagtgggagctcaaaatatggctggaagcgttcccctgaacaaagaaggttttatgaagcccctccctgaagcccactgagactcccaggtagaagccatagttctcctgctgctcacctctgtgggaagcaggggctctggccatttgccctggtgtttgctccagcttgcttggtgaggccctggcaatgagcatctagggaggagggtggacagggcttctggggtgggacagccctctactgccacccctattcccaccagagaagctta

SEQ ID NO: 91859 - DNA, 1070 bp, Homo sapiens
gagggcagggagactcaagtgtgggccctgctggagggaagcccaaggtgggggcactgcctgggggaagaccccagccctaaggcgctgtctgactctggcccccccgaggcctggggattccctcgcccaccccatcacttacaccaatattgacggttaatgccgtgtcgccaccgtgttcaacactcagcgcggctaattgttttgactgggaatcggcaaggcgattaaacgccatcgattttgccctgcgcgctgcatcgatttttaaatttcctattgatcccggccctaaatctccttaaccaagacctcactgtggagatgacagccgctgattagctccagggcgggggctggggggaagcagcccctgagcggggagcaaccccagctcctccctcccctcagggaccaggggttctggtccccttctgcccctgaagatgaaggcccagggagagacaggacagatggaggaggaagtggggagacccttggccctttttaccccccttttgcttcttgtttgggcttttccctggtctctttgcccccgctcccttcattcctctctgtctatttctccccatctcttctctttctctctccccctccttctcagtccatctttttctttctcctcctcctccttttgaactctggtgcctcccttaattcctcactcctccttcctacagggctgtggagaggctcagcaaaccctctttggggatgggcctcctgacctcttgcctacttctctgttctctccatcttgtacacaggaggtagaaggacctttccaaaggcaaactggattgtatccctctccctctctgacgaagccctggctgcttggaccaggcacttgacgccctgcagggagcagcccctgcaatctggaagcctcgtctttccccatttttcttactgaaccctggacaggcaaagtcctggcattctctcgttccttgcacctggttctttctctgattaaaatttgtcttccaggtttggcttgggtgttgtttcctccctaagtcttctgtgatctcacccaggat

SEQ ID NO: 91860 - DNA, 1022 bp, Homo sapiens
aagaagttatgtcatgaaggggcttgcagagaacgtagctgggaagtgtgggagccaggattcaaacctagccaacttgtccccagagttgatgcccttaatccttgtgaaggaagtgctcctggaggatagcagccttcacatgagaagctgggaggggttcaggctgccggtagccgtgtgcatgaatagaccaagcctttgtctgggttactaaaggggcagtggctagtttggggaggggggattatggccttccctgacccagagtaagcccacaggatttagataagcaggagaaggacagctctagggaagagctgacagcatttttggatatctatgtctgaagatcacgctctagaagagaagatttggggagcctgcacagaggcctgcttactccttggggagagctgggggcagttgatgccagggcaaagggccattacagggacccttaccatgactatcaacagaataaccttgacagtttgagctgccgtagacgtgggttagattgccccaagtcgtgataagttctctctcttaggaggcatctgagcaacctctgcaggaggtgtttgagaatgagtgggtatttgggctctgactactggggaacttaggcacctcgtggtgcaggcattcttccaggggtgggaattagggccaggaggctgaatgcttcttcctgttcttctcttcctccagtgtctccagaacgctatagctatggcacctccagctcttcaaagaggacagagggtagctgccgtcgccgtcggcagtcaagcagttctgcaaattctcagcagggtcagtgggagacaggtgagcccagctgggtgggtgtaatggcagcatccctcttttccttatgaattgtgcccatcaaggaaggggcctgaggggttattctgtctcattttcactgtgtgtgtgtgtgtgtgtgtgtgtgtgtgtttattgctacagatactctgttctgaagcaacatacagaattgttgcacatagttt

SEQ ID NO: 91861 - DNA, 1033 bp, Homo sapiens
acagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaagtgggttggccaaggccctttgcactgcatcaccctggtgcccagcaacatcaggtaaccttcactgagcaccaagcttatgccaggtctgtgctggccactctcatatacctcttcagatcctctgcttgtacccccagcccttgccttccctggattttgggcacccaggactttgctctgcctggtggagggtacttgatttctctgggcttccttcatctcaattctgacagtgtggaaggaaatctgtaggtacccaggtcctcagctccagactgggtgatgctggagacccaggagcaagtcagcacaggctctgcccacaggaggcatgcacaatctggtaggagaaacgcacaagtacagatagcttgctctctgagtgtgtctcattgattcattcagcctgtgtgtcctaaagcctcccttctcccatactgggtgatgctgggggcagagatgagtcaggcctaaggcttctctgggctgtgatggggatgtgcagggacagtgggatcccaggaaacagacctccatggtgggagatcaggagttaaggacttcctagagaaggtagtccctgaaggaaaagtaggaatctggcagtgaaagaggaaaagaaca

SEQ ID NO: 91862 - DNA, 1158 bp, Homo sapiens
aaacaggcagccggacagaaagcaggttttcatgccaataatttattgaacggaggtctgtacacaggcaaaccttactgtggaaactaagacatcaggagctctctccactcccctggccctccagggtggggtgaggagggagtagaccttgggggcagaggacaggaggggagttacagctgtaggaggggcggggccaggttggacggtgcgaatcgacgttttctttaagaaaaaaattataacaatctatttacacccgggggccagggaagggaagaggagacgggctgggctggttctatttacaagggacacaggaggggagggggtctggaggaggtggaggtctgggggaggggagggggccaagggggtaggaggtcctcatccccccaacaccctgtccttctcttccctccccacaaccagttaaaatcctcttaaaaagcccaccacaggggtgaggctggtgagggagggactggaggtggggacagggactcatttacctctgccctctagtctaggggcccagccagggcaggagcttgatgggctatggccccccttcccagcccctcttggggctcccagatggaagtggaagggtgcttggtggggccctcaggaggagttagtgagggtaggtgtggcatcggtcgactgccagtctgagctggtcggagtctcagttaaagctggagggaggcagggaaggagcagagttagcctttgcctttcagacaccccttcgcccaacccaaaagtaggaattctcttgtcatagatgctacattaaaagttacaagctgttactttaggtgaagggttgcaaactcaagtgctaaagggccacgatagtaactgagtgacacaccagagtgccaggctccatataaggcggtggctgggctgggcacagtggctcacgcctgtaatcccagcactttgggaggctgaggtgggcagatcacaaggtcagcagttcgagaccagcctggccaacatggtgaaactccatgtctactcaaaatacaaaaataagccaggcatggtggtatgagcgtgtaatcccaggtacttaggaggctgaggcaggagaatcacttgaacccaggaggcagaagttggagtgagccgggattgtgccac

SEQ ID NO: 91863 - DNA, 1136 bp, Homo sapiens
tcaagattccaatttttatggagggtcagcagggctcatatagtcccagacctgggctgcctgcttacccgatacaaactgacctctccttagtggttgggccttagtttcttcatttggaaggtgggggtgtgggaagcaaccagtcataacttgccgcaggcactgtggcagtgagataacaggagtatgccagtgtccagggcatctcaccctcatgagccctgcacccatccctcaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtggtgagggcatagcctgggatctggggagtggggcggggtaggggggcagccaaagattgtgaggagcttggtgttgaagcaggagtggggagctaagggcagggtacaaggcaggcctggggctcaggaaagatgactcccagattcagggggaatcgaacctgcttcagttgtgctttactgtgatctgccttgtgctaagctttttctggtttttcattgagagaggtctgtggctgaaggtgtccacaaacaactggccttcccaatagctgggttcccatttggtgcccatcataaccctgctgtagtctaccctgactagcatgtcaattcctgtttctagaactctccatccaaccgtctctcaacgccattcttatccctcctcacttgaggtccccagcgggcactaccaccctcaccccgtcctcacaaggtaagtggggaccatctgctgggggttaaagtatctctcagcctggagagggtggggctgttcgctcagtgactgggtttcctgaatgtatttttaaatcatcgacattttgatggcataggaaacacatcttacaacatgtgaatgaccacctttagagggtattcttgcgtacaaatgtttaaatgtgtttaatgccaatgggaaagccagagaaataacgtctggcctgaacacaaacaaaaagttgaattcgttgcccaagtttg

SEQ ID NO: 91864 - DNA, 1266 bp, Homo sapiens
ctgctgtggaaggtgccctttcaaactctcatgcccattccctcaattcagacttcccctcatgcctggaaaatggcagttgtccccacaaacagggaaggacacagaggccctgggagcaagttgcaccttcatggtggcaaagccttgcttcccggttcccccaaggtctccagcagcccttccccctagctgagaacagagggctgacagggaggttccagagctggtatggactctggagtcaggtcagctttcaaatcccagtcctgcccagtcctagtggtgccagtgcgggcaggcggcctcacagctctaagctcatctgtaaaattagcattcaacagcatcagcctcctaagtttgtgaggactggatacaagaacagaagttaagctttcatcaccaagcttggcatacagcacacagaaaactccaaaacttcccagattgccactccccccgccaccctcccataactctgaccgatggatgaggtgtaatcagtggctccaaagatgagctctggggcccggtagtagcgagaacagatgtaggagacattgggctcccctcggaccaactgctttgcactgtgggaagagatgggcaggggtacacgtgaggcaagggttggggtcccccctgcctcttcagccacccaacatgccccaggcccacctgccaaaatcgcagagcttgaggacagcagtgtcagggtccaccagcaggttctggggcttgatgtcgcggtgacacacgccctgggagtggatgtaggccaagctgcggaagagctggtacatgtacacctgcggcgggcacaggatagcagaactttagcccagctttccccatacagcaccactaccccaccagcttggcctgaagagcccttccaggcccactctccctgctgcccccacagctttggggaaacccatttgaaaccttggttctcttaatgtgcaccacaatcacttgaaggacttgttaaaacagggactactggctgggcgtggcgggtcacgcctgtaatcccggtattttgggaggccaagaccagcctcgccaacatgttgagatcccgtctctactaaaaatacaaaaattagccgggcgtggtggtgcacacctgtaatcccagctactcgggaggctgaggcagaagaatcacttgaactcaggaggcggaggttgcagtgagccgagatcgcaccactgcactccagcgtgggtgacagagaccctgtctcaaaaaaaaca

SEQ ID NO: 91865 - DNA, 1211 bp, Homo sapiens
tcacaaggtcaggagatcgagaccatcctggctaacgtggtgaaaccccatctctactaaaaatacaaaaattagctgggcgtggtggtgcatgcctgtaatcccagctacttggaaggctgaggcaggagaattgcttgacccagggaggcagaggttgcagtgagccgatattgagccactgcatgccagcctggcaacagagcaagactctgtctcaaaaaaaaaaaaaaatggggtgaagaaaacacatctgtggcctgggtttaacctgtgggcttccagctcctgtgggaggggaatagtctggagacaaggaattgggggatactccaggggaccttggagctgggacacagggagtagctgcctggctgttgttgggagtgagtgtgagtagggaggagcagccgagagagttggttgtattctgagactctccctttgccctcaagaaccgagagctgcagatcatgcgtaagctggaccactgcaatattgtgaggctgagatactttttctactccagtggcgagaaggtgagatctcgaggtggtggtggtgggttgctccagccattttcctgcctgcctgcctttcccccactgctccctgcataccttccttccccctcctcactcttctcacagtgcctcacacctctcctttgctccctgcagaaagacgagctttacctaaatctggtgctggaatatgtgcccgagacagtgtaccgggtggcccgccacttcaccaaggccaagttgaccatccctatcctctatgtcaaggtaggccagcaggtgggctgctgggacccaggcccacaaagccaggggctctggagcctcctgccttttatgggatccctcatccgccaagtttatgttggtttttggaggccccatgtcccctgctgttgttcccataaccccccgagatggagctcgcctaacacaggggagggccaaggcaggcaaggcctgactgaatcaggaaggcagcctgacacctggggttgcagaagctgccaggtagttgctcaggtccatacagggagtccagtggcaccagagatgttggagttagctcaggataagggggtggtggggaccaggactgcacagagacagctgctgaggccagagttcgggcctttagagccttggctgggggtaggtgggaaggagttagggctggaggaaggttag

SEQ ID NO: 91866 - DNA, 1016 bp, Homo sapiens
gaaacaaactcaggtaagaggattgcctgaggtcatagagcaagtgccccagtcaaggctggaatctgattcccaaaccctctaccttaaccatttggttacacttcttcccaggagagaaagggacctggcagggctagcgcgggtggttctgaaggtcgcgctcttcccaggtgtttggccagcgcagaatggaatggaggtgccctgtgagctaggagaggctcagggaactagaaggagatggaggaagtggaagttgaggaataattggtgtttaagggcctggcatttggagcttagactagtctggatgtaggagaactgagcctagactggaaaggaaccagaccagggcctcggtcttggcagggagggcccttgggcaggaggagctccagggtgtcagaatttgattggagttgagttccagaagtaagagggatgtaggggcagggagttcctaggcctcactgaggaatagagaatggggaagaatgctgagaccgcattctgggaaaagtccaatgcctggagtctgggactcaggatcctagatagagttcgaggacccagatgcttccacgggaccagagtgagctggatggccactacctgtctgttgttgcttgtgccaggtaggggggcaagcctcatgtgcccatgcctgattttttttttttgagatggagtcttactctgtcacccaggctggagtgcagtggcacgatcttggcccgctacaacctctgcctcccaggttcaagcgattcttgtgcctcaaccacctgagtagctgggattgcaggcatgggccactatgcctggctaattttttttttttgtatttttagtagagacagggttttgccatgttggccaggctggtctcgaactcctgacctcaagtaatccgcccccacctcgacctcccaaagtgctggtattacaggcatgagccagcatacctagccctgatttttcaagacaaactgaaaactggatttagatgtgaa

SEQ ID NO: 91867 - DNA, 1028 bp, Homo sapiens
ctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgcagtgatcaatgtcctaggtgctcggtgcagccccctgagggccacagcttttgcttgattctgaaggaggggccccaccctggctgctagtgggtctgtggccagatcagtatagagggcctaaccctaatcagaatgggccaaatccaggcctgggaaaccgtctcctgacctcagaggcacatgagccccagagcttgatgatagtggtctcaggcatgcgccggcttcatcagactgctcctctgttccatggggaccttgtccttgaaagctcttcccactgtttttcaccacaaccccactgcccttgctcttctgattgcctggatgccttcccacttgtggctaggaattcttcccacaccccaggtccccagtgaagaccaggagctcccttttgcactgcccctcgcaccctgcccacacccctctcttgttgctctgagttcagctgggagtcctt

SEQ ID NO: 91868 - DNA, 1050 bp, Homo sapiens
aacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaact

SEQ ID NO: 91869 - DNA, 1029 bp, Homo sapiens
gggccccccaggaggccggcgtgttcttcctctgccaccactcctcccttccgaccctcatagtcccttaaaaaaagtttgggccgtcacgtgaggttggggggtgcccaggagttttgtccccccaggcttgcatagtctgtctgggagaatccctaccccgcctctgtgggacccaggtgtgcttctgggacctcgccatcccagcccttgctgtctgactgctgccacttctgcactctgtctcgcagtctcctgaacccctctctccatgtgcctgctctctccctgcctcactggcccccatgttcccgaggtcccgcacccccaagcttcctccgtgcaggtctggtgtttccctgttttaagcacgtggacgcatacacagcacactcacacatgctccccttgcccgtgcctggctcctggctccaaggcctggggaacagagccccattgagacaccctgacgtcaccccctcttcattctcccccccccaaagccgggaacaggccttcatgtatgctgtgtccgatgaggaaagccgccgttgtggtgggcttgggagtggggaagggtccctgccagaagtgggagccagggtccaggccctggaggaggggttgctcagggaaggggtttaacaagggggcctgggacagctcccagaatgcggcttgaggcctttccagagcccccccacctcctttccgagttccctttgtgttgcatgtagtctctctcactccctctcttctgcaaagtttatttttagcctcctgctcccccgctcccaggactgtcgctgcacacacgttgcctggttaccgggacacggaggctggggcgggtgggctgggaagggtggctttaattttggggggagggtggaagtcagtacatcccccacccccagattgatgtctcaggggctttggccccccttctaggtctagagccagattggggctgaggtggaagtaacatggagcttggttccctgagaggggctgggagctttttggagg

SEQ ID NO: 91870 - DNA, 1893 bp, Homo sapiens
ctggcgccggtcagtggggttgtgatcgctgattggctggctgctccagctgttgcaggtccattcaccattttgtgtgttggagtaaaaaaaaaagggagaatcgagagggagagccggagggggggcggggagggaccggaccggaccgagccggggccacggccccccgccccgaaaccccgccgagcccaaggtgaggggcggggccagggctgacacaggaaaggggggtccggggggctgggggccgagaggggacaggtggcagggacggggagggggtacagggggaaaggggtgggcggaatggtgggaagggaggagggagtggaggaagtggtgggggtttgacagaaaaagggtaactgggggagggggtggtgggcaaagaagggtaacaggaatggaggggtgacaggactagatcagggtgacagggagagggaggggacagagttggagagtgtgacaaggagaggtgatggggagagaaggtgacaggtccggagatggctgacaggacagtgactgggaggaataggtgacagagataaatgggggtgacaaggagggggtgacaggagggggcctagggcattttaaccgagaggtagagatagaggtagtgacaggatgagagagagagtgtcagagaagctggtgccaggagggctaatgggaacagagggtatgagaccccaaagagccagggcctgggctggcctgggctccgggagttactactcagatctgaggaaggtgagggcccccggggcttgggtgggagttattcagacagggtggacaggaagagagtaggccctaggggaaagaaagcagctctggggcgaagagaggctgggccaggcagcaaggtctaggggtccaggcggcatagttgtaggccctgggtggggtatgcaaaggtttgtgcttggaaaaaactggagccagatctcagtccccaacatggtagtctagtgggtcagcgggtattaggtggtgatggctgcccaacttctgggcatttgggtgccagccccgggacgccctccaggctctgcctgtgaggaccccaggattggcccaagaaagggcaggcctgggactccagggtccacaggaggagcaggcccctagtgagagagcatgaggtcaagggtcccccagtagctggaagactgagtcggggttgcctctcattgtgtttggcttatggttctgggtcccccaaccctcctagaggcctctgttttggcctctcaggttctcttagtcacttcagagtaaagttttttccccttttcttttctcagggcagctcgaaagggggcgggcagtaatgactgttcaggaagtgggtgaggttggcctgttgggcttgtcctgctttctttgaccttatcccacctatccccacttggagttggagggcatatttgggggcctgcggggggctagccgactcagccaccctgccagagccagcccagccagggcggggatgcatgcaggcaagaagaggggggctgggcttgcgggtatcacgctgggtgctgtggggggaggagcaggctcccatccagtgggacagagaaaccctggggtgtagctctgtgtcccactgtgtgatgacgtgtgcgtgcttctgtgcgtgtgtgtgtgtttgtgcgcgtgcgtgtgctcatgcacggccccgtggcagtgctgggtatgagctcttgccccagacatgcccctgcctgctccctgccaggatctggggagatggctgtacctggcagccctagggtgcagagcagagtgggcagccgtccctcgggactctcagctgcccacttcttcccacagtgcctggccatgccaggctgcccagaggggcagagggag

SEQ ID NO: 91871 - DNA, 1044 bp, Homo sapiens
caggctggtctcgaattcctgggctcaagcagtcttcctgtcttggcctcccaaaatgctgggattacaggtgtgagccactgcacctggccttatttatttttatttatttattaatctactgttgattcagggcctggccctgtgctgtgcctggccctgtgctggatggtgctgaggacacagccctacttacacagggctcacagcctctggaaaagacagacccctccctagacagtaacagtctggggtggtcagggatggggtggaggaagccaggaggccgtgggagcccagagaagatgcctgtccagcctgagaagtcagagaaggcttcttggaagaagggccagatgcctatgaactgaaacctgaagggtgtgcagatgtgagcccggcagggtaggcaggaaggatcttcaggcagaggaaagagtttgtgcaaaggccttaaggcaaaagcagatatttgtaagatgttgaatctggaaagtcaaagactctaaatggcaggtgagtgttggggatgtgtggctggattggtgagcaagggtcagatcagagaggacccttaagtaagatcattatgaactgtatcctgagggtactagggagtcatggaaggttttgagcagattcaaccactgctgcaccatagagggtgtgtttgagtctctgaggccagaagcagggagaccagggaggaaggaggctgggtgtggatgtgggtaggagccgctgtggcttgggcttggggcaagagccctttcaggaaggagcactggcctggcccttcccttttggggctccagcccaggccagtcccgagggacagggcacagggacacgggttatgcctgcccctgatgttcatatacagaactgaggctgtgagctgtgtgtttcaccctgacaccaacattttttacatttgttgttataggtggtacaagcaaaatttcacagcagggatttctgtccttaggtaatgaagaaactaaatcagagggtctctaaccactcccctacccttcacccccc

SEQ ID NO: 91872 - DNA, 1028 bp, Homo sapiens
gtggctagttgaggctggagctgacaccagagtccaggcttagcagaagggtgccgtggacgacaggcccagcttgaatgccaggctgagaagctggggctctacgcgggccagtaaagagtcaagaaggcatttagagcaggggagggaaaatgttggatctaggtgtcagagacccctggagaccgccctggaaaggcaggagttgggaagaagatggcttggggaagaggaggagaggaggaagagcttgtgaaggtgcaggagtgagtcttggtaactgtagaagagaccccagctcccccagcttagcagcccccagcaccaggagctgcgaggcgtcaggctgcctcctggcggcaggcggcggcgggacagcaggcgcgcgcatgcgcggcagagggggttggggggtacgtcccggagcccccggtgcccgggtattaatggctccattagtggccgggagggaggcgcattagcggcggcgacggcgtctggctcccattaccaccggcggcagcggctgcaccgcaggcggctggaccctagcccgccgcgccgcctcctccacccccaccctatcccctgttcccgctccccacgagggcccgggcagggaactcccgtccccctatttcagcggaaaagctgattgtgaagccagatagatttgggttcaaatcccggccgtgccacctcgcggctgcaagatgctatcccccctctgagcctgtttcttgcgaagtagtcggggaaaccgggtgctccgggggctgtgtagaagcggactggcacccagcgagggccgcgcccagcccccgctggcacctaggggtgtgggttcccgcgcgcccctgggtgcagacctcctgtgtcgggcctccgtccttctcattggctgccgtctcgcccgctgaccgctgattggccgagacctgcttctccgcccctgagcgattaacccctgcgctgccgcgtcctcgggctgggtggggtaccctccctcccaccgcagacagctcggg

SEQ ID NO: 91873 - DNA, 1321 bp, Homo sapiens
tgagtaatggaaacagcacttgagttagagctctgggctggtacatcttgactgcatgatcttgccacagtttattcaatctctgaggctcattttttcacctgaacaatgggtgtaataaagcatacctccctaggtggctgtgaggattcaatgaaccagataatacatacaagctcccagcacacagcagccccagtaagtgttagtttcctttcttcctggccctttttttctgggagggggggcggggttagtgggtggctggcagagcagtgtggtggggccagccatggtgtgctctgtggttccctgccttatactgctagacagagggtccagagtggccaatgagtgtcagggtgggtggctgaatgatggcggtggccactgagctctgtatacctgatgggcctgggtactgaagcaggtagcacccattagggtaggattatatagagggtggggtcggtatgatggtgtctgtgagagctgagtgtgcactggggataggaggcgctttgtgagtgctaggaaggctgtgtgtgtgacggaggagtgtgtggttgtgtgggaggggtgtggagtgtgtgtagtggacaagcagggctatgctgagttcctcctgtttgacatgttgtctgtttgcatgattcatgtgggctggtgggggtgtgatgaggatgcgggttggcgaagcatgtgtgacagggcatggatgagatgggtgatgtgaacaggatgggtgaatgcacgatggtgggtggggagcgatggaccgtgagcgtgtgaggttgtacatctgtgtgagcaggtatgtgaggtgtgacagcgtgggtgtaagacagagggcatatgtgcccgtggggtgtgtaggagataatgggtgtggcacgaaagtgtgtctgtatgtctgtgaggagtgtgagtgtgagtaggtgagggctcaggatgcctcgcccagccctacgcgcagtttgtctgcccagcggggccaggcgcgcccaggcgggtgtgcgggaggcgggccgagccgcgcgtgagcgtgttcctcgcgcggactggacacacaacagcaccacgcacaacccagagacctccgcagcgcggcgccccgaaccgcccccctggctcggtgcctttactgcagtgcgccctccctgccaccctcctaccgcggccccgcccccggccggctcggggccaaccggagcccgccccgccctgcccttatttgcatatgactgacgttcccccggggcggccaatgggggcgggcgcggcggggcctgacccgcgcgcggcggcggcagccaatggg

SEQ ID NO: 91874 - DNA, 1050 bp, Homo sapiens
tgcgggcggagcggcgtcggccgctgaggaggtgcgagcccctgccgggtcccccctgcgccggaccatgtattcggcccacaggcccctgatgcccgcgtccagcgcggcctcccgtggcctcggcatgttcggtcagtagcgcctgggccctgggactgcaggggtcaaggtgtcggggtgctaagtgcggagtaacggtggtgggggtatagtaggggagagaacagtagaggcagagtaaagggatgacggggaaagttacggagctcggccgggccgagtggttagtgatggcaggtgggagtgtagcggagtggggcgtatctggggacagctgtgatgttaaagtgatgggatggcacaggtccgctgtaatagaaaggtgaggggtgcagagtaactggctctggagcatggggtagaataggaacagcacgagacctgctggtcctaggggaggaggcttggattgggtagtggggctaaggacagggctcaggaagcgagtgaggcactgttagctgagatcagagtgacaggctgcagtgtgtggtgtagtttgcagagagcgcgacacctaagaacctggagggttgtgcactggggaggggttcaggagggagcaggaccaaaggactgccctccattgtctgctgggtcccttttccccaccccccagaaaagaggaggccttgatgggaaagatctttgcaaagagaggcacaggtctaagtccctggaggcttttatatggggttggagggcccagcgggttttcaggggtaagggacagggtcatcgtagtcttgagtgctcttcagtgctgtcttcgtgatcccagtcccttgtttcctgaggtctactttttcctttgtcagcccctctcagaatcaggtctcgaggccagtgcctcgcacagagctcccccctgtccaggcttctgaaggcatggggaggtcacctcaggtcaggttgatccggatcaagggaaggcctggaatgatggagagcagggctagggcggttccctcctcccttcttcatctt

SEQ ID NO: 91875 - DNA, 1064 bp, Homo sapiens
gagtttaccacaccctcccctgttttgggcaagggggctggaccctggactacagataagccgaggggctgatggggaagggaggctgggaggccgatttctggatggtgcattgtctttgtgggggcaaaggagagagctgctggagccacctgtgcccagccaggaagggcaggtctggcactctgtgtttgtggtgggggaggaaggcaaggagcaggacctctcccacaccacagttgtaagagaccccacagcctgtgcatagtgaacggagagttggaggggaggggacgtggggccgtatgcctcaggaaagggaaagagagcatgaggccaaggtgagacgctgtgttgggcggcgactgggctgctgggaatgtggcatgacgggggtgggggtcccagcccgtagaggtctggggccttgggagtgtgggatggcagccaagcatgacctggtttgtggcaggagcaaatcgttcctctggcctggtccctggtggcagggctggtggagattggtggggggaggagtggggcgtgagtactatttcccttccctgcttctgttttcttttttataaatctagaaacctttcagggaggagtttttcctgagtgacgttgcatggacgagtccaagaggctctggtgttgggggtggggggtagacaaaaggggtggggctacctcatctagggtggggaagagcttgagttggggttggggccaggctctcctgctgcacagctcacctggctcctttccacagtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaaggtgagggctggtggggactggggggaggcaagggtgtggggtccaggtggcctaggagccctctgatctacctctgtgtccccagaacctgctgagtcggcagctgttgctcatgaacggccaccaggtgggacaggga

SEQ ID NO: 91876 - DNA, 1001 bp, Homo sapiens
gaacgggactcatcttctgagaaggatggacgcagccccaacaaggtactttatccctgcctgtcctgtgctcaccccgtggccacccacacctgtctgccaggtcctaactgtcccgctctgggctgtgtttaatgcagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtaacgctgttgcctcttggctcctcccagcttcttctggtggggtgggtgagtgaagggttgccctgccctctcctgccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctgggggttagtcagccccttggctctcccaccctgccacctccctccccgagagccaccagctacccccttgcttgctcctcccctgccccagcagctcctctctgctctatcgctttaatttggcgacccttatccgtaaaggaaccggcagttgattcatgtgacggagccagggagatccacacagatactaagattcccaaacagcaatctcgttatcaactgttgtttaacgagtgtttactatgtgcctggcactacagggaatataagctgtagtctgcaaaaccccattctatttctagaagaagaaactgaggttcagagaggcaaaatcacttgcttaaagtcataaacaagcaaatgacagagccagaatgtaaaccccagttcggcgggcccccagcaccatagttggggccactgcagctcg

SEQ ID NO: 91877 - DNA, 1103 bp, Homo sapiens
ttgcagctgagcccatactcagaggccagggaaggggtggggcggggccggcttacctcactcctccccatttcctctcctgcggcagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcaggtgaggggcggcctggcaggcagtgctggggacccagggtggggctgaggcagtccgggccctaacttggtctcctgcttcttcttctctgtctttcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacaggtaggtgtcagatcaacccagagcagagtgagttgggggacccaggggatgggctccagtcaggcctggctcagcaaacaattttctccccactagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggtgagcgcctgcaggccgtggggctcccactgc

SEQ ID NO: 91878 - DNA, 1029 bp, Homo sapiens
tctgcttctgtttggccagacctggattcagcacccgaggaccccacctcgcccaagcgcaagatgagaagacgctccagctgcagctcggagcccaacacccccaagagtgccaagtgcgagggggacatcttcacctttgaccgtacaggtgccgtggtgggcagaactttgggggcctggggacctgcaagaggagtgggtctctggaaggcggttagagagtgagagaggtagggtgggtccatccaggctgggaggaagcacagcctgtcagtggtgggttctggagtctggcaggcccctaggttgccctgtgactgtgggcaggacccctctctgactcccctgtgaaatagaatgcagtgagggcttgggtgggcactcagacggtggcaggaaggccctgccgctgctgcagccttgccatgctgcctgtgccctgcacaggtacagaagccgaggacgtgcttggggagctagagtatgacaaggtgccatactcctccctgcggcgcaccctggaccagcgccgggccctggtcatgcagctctttcaggaccatggcttcttcccgtcaggtgagcctgtctcggagtcttggggtcactcgggtgggacttatctgtacatctcatcctgtgctccccaccgtttttctatctccagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccaca

SEQ ID NO: 91879 - DNA, 1461 bp, Homo sapiens
cgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctggtgagcgttcccacctgggatattgaggagtccgggggcgcggggggtggctcaggagaacggctggttcgtgccactctcactacctgattgggaaactgagggcagttgaggaggcgctgcctaagggagcagggcggggcgggccctggagcgtgcatgccattgactccctctcgcgcgctcccgcagcaccatcggttcgtggctgacagcaaagataaggaacccgaagtcgtcttcatcggggactccttggtccagctcatgcaccagtgcgaggtgagggcagtccctctccccctgccccatccagccctgtgtccatgctgacacatctggaccagaacccaggccaggtgaggtattatgagagtacccagattggcctcaggcagcccgaggctctgagaatcttggtgtaaggtgcaacattctattgagaaagaaatgtatgccttggttttatcagattggatttgtgtataatgtactaagacctaaaatgaggctttcctgccataggcttgcctaaagtgaggctctttcttgtttgctttaagtagtgcgcagccctgttgggtttacacaaagctatagtcactttacaggaagcgaagggcaactctaatggcactccacaaagaggactcaatcataataatatctttccacaaagcatgtccaactgtaatgggtttcatcaaaataagtttcaactgtaatgccattgattcaatgcatggctcaagcagactggattttcatgaagtgagtcttgcttctatggggcttggtttgttttgttggttggttggttggttggttggtttttgagacagggtcttgctctgtcacccaggctggcgtgcagtggtatgatctctgttcactgcaacctctgcctcctgggctcaagtgatcctcccaccttagtctccgagtagctgggactacaggtgcacatcaccatgcacctggctaatttttgtaatttttgtagagatggggttttgccctgttgcgcaggttggtcttgaactcctgggctcaagcagtccgcccacctcagcatgagcaacagagcctggggcttggtttaaagtgagagactctaggcagggtgtggtggcttacgcctgtaatcccagc

SEQ ID NO: 91880 - DNA, 1109 bp, Homo sapiens
ttcatactttatctagtcctagactttttttttccgagagagaatcttgctctgttgcccaggctggagtgcagtggcttgatctcggctcactgcagcttctgcttcccaggttcaagtgattcttgttccttggtttcctgagtagctgggattacaggcatgtgccaccatgccgggctaatttttgtatttttagtagagatggtgtttctctatgttggccaggctggtctcaaactcctggcctcaaatgatctgccctgggattacagacgtgagccaccacgcccagcccagtcctagtccttataacatcctcatggataagaggcatcctgcttttgagcaggagggagtttgggatcagatttctgtctggagtggtatgggggttgggtggaaacagaagaccttcaacttagggaagaacttggggaggcagatggtgagctggcctccagcaggcacttaacaaagatgtacttgtgattccagaaacagagctttatagtttggttgaggctggtaagattctgggaggtctggttgtgtggccgtgctgaatggttcttctgcattccccaaagcatgggtggggtctgtgtctgatgtcttgggggctctggttagagcctgagggagagcttccagctttagtattctgtcttttatgtatttcttcatttcatcatccagcatttcctgagcctttgccaagcccgggtctgggcaatgctgcagagggaattaggtccacatccaggccctgctctatgggccttgtaggctgcagggagacagacctggacatagatgttcctggcccagaggaatgaaggttataatgggatgtgagaaccctggagagggggcatctaacccagctagggggcatcaggaagaggcctggtggtgggaagggataatatgttgcagacagagggagaagcttgtacaaaggcccagctcccattagagctgtaagcagtggggtgatttgagacaaagcgagggtctgaacagcaggttagggacctggactttctcctagggtggtagggagccatgcagggctttggggcaggggagggacggggccagatgtt

SEQ ID NO: 91881 - DNA, 1658 bp, Homo sapiens
ccctgtttcccctggggccctgatctgtgagcgcagcctccacgcccatctcctaggtctgaccttgctcctgcatgaaactccccccaccaccccaccctcctccgtgacacccacttccctctccttccagagcttgcccctcacctgttactccaaccccaccccaccttcacctgcagggcctcccctgctgaggatatcccactctcatctataccccactctcatctgtgaacaccaccctccttcctccagccaggcccaaatctgtcctcccatccagccactctgtgtggccttggacccctgccatgacttccagcctcgcaccactgaccttacgccgaagctgtgtacatccagctttcaatctggattgcgctttgagccctccccgccttgacctccccagatctgagctctttcagtccaggctgaatgtcaactacgctgtctgtattctcccagcctgccgtctttctgtcttttctcctttttctctgtgcatcttttcctttttctgttggtcttcttttttccgtctgtctgcttccttctgattgtttctctttgtctcttgtttctgtctgacagtttgcctttcccctcttcctgtctctctctgtctccctttctctctctctctttccttttccatcctctcccttcctgtctgtctctttctctctccctttgtgccctgtctgtctcattctgcctcttttcctctctgtgtctcctttgtctctctgtccttgtctctccctctcttatctctgcctttatgtctcctttcccgcagcccctgggaccatgccgctgtgagcctggcttcttgggacgtgcctgtgacctgcacctgtgggagaaccagggggctgggtggtggcacaacgtgagtgccagggaccctgccttctctgcccgtattggggcagctggcgccttcctgtccccaccagggctgctggcagttttcggaggtgagcagatggggcgagtatctgggatctggaggcccggcagcctatggccagggcatgagactatccacccctccacaggccaggacctcaacaatgccctgggtgacctcgtcctatacaacttctccgccaacacctgggagtcttgggacctgagtcctgccccggtatggacccctcctctgccctggaggagcctttccactcaatcagacccagccggggacccccggaatgatcccctatcacctagtgctcccacagttcctgcagcttgatataggaacctacttctccctgtttctgccttttctctccggttttcttttttcttcttcctcttcctttatctgcctttgtgcatcttatttttccatgtgtctcctgttgctcaatctgtctctgttttcgtctgtctgacttttgggcttctgtgttctctgtttctgtgtctccatctctctggatctgtttctctctgccatttgtccctttaactctgtctccttgccttttctctctcttattgtatttctctgtttctatgagtctgtctcttcttttctctctctgccggtctctgcctttctctttgtctctgtctttatctcgccttctctccatgtttctctggctctgcatctctctgtctaagcctggctctggctc

SEQ ID NO: 91882 - DNA, 2265 bp, Homo sapiens
agaacatggtgaggccgcctgggacattcagggggttgtttatggtaaatagggagttaggggtgtggtatagagcatctgtggtgatttgaaggttctggggaagggctggggagaaattagaggcaggagatggattttttgtgtgtgtgtaagacagagtctcactctgttgtccaggctggagtgcagtggcgcgatctcggctcactgctaccttcacctcccaggttcaagcaattcttctgcctcagcctcccacgtagctgggattacagatgtgcatcagcactcctggctaatttttttgcattttaagtaaagatgggttttcaccatgttggccaggctggtttggaactcctgacctcagatgatccgccaccttggcctcccaaagtgctgggattacaggcgtaagccactgcgcctggctgggaatggatctttcgtagaggagggagggtgctgaggttttcaattgtgagcagaatttgagggaaactttgaagcaggtgaggaaggtctgagtcagacttgaaaggcccctgaaggctgggcatggaggtgtacacctgtaatcccagccctttgggaggtaggggcaggtggattgcctgaacccagaagtttgggactagcctgggaaacatggcgagacatcatctctccaaaaaatacaaaaattagctggccatggtagcatgcacctgtagtcccagctatttgggaggctgaggtgggaggatcacttgaacctgggaagttgaggctgcagtgagccatgatcgcatcactgcacttcagcctgagtgatggaatgagaccctgtctcaagaaaaaaaaaaaaaaaaaagcccctgaggaggagggtccctgggggtctcacctctgaggttctcaggatctaaggagctctgaggccctcttcttaggagggggtggggtacagggtgggtttggaggtatcaggggtctgaggaaggaatgggaagggttctgaggcccctgcctatcactcacacctaccccaggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgtgagtacccaggacctacctccaaccctagccgcaggccccagcctcagatcacctgggctttctgaaccccaggccacaaactctgaaatccctagattctggcctcggactccttaactcttggcctctgaactctggacctcctcttgaaccctgtggcccctgacctctgcctatagaccctaacctgatcccatattttgacccccatcttctgactcctcacccttgaccctgctgaccctgacctctgccctccatactttgacctataataatctccagattcctccagaccttggacctctttactgatttcctaaatcctgacttcctatgtgcctgagttctcaacctgggctccaaacccttactttcagttagcgccagactctgacccctgccccagaccttgactgctgccttcctgtgaccccttccccaggagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggtgcctgtggggccaccaggggaggtcacaaggtggagggagccacagcaggcaatgggcagtcaagggaacccctggtggggggtgtgggggaaacagcaagggcttttggccttgatctgcagagcctggtggggagggtgagatggagctgtagagagaggcacctggggagtcaggactctccctgttgtaggggccagagaatgcaactccatccttttccactagcggggagtttctcagcataggcactggagcccaggagtaggccttcaggcctgccacctccaagtgatgtcaggcagccctcgacaccctgcttcctcttgttccctgggaggg

SEQ ID NO: 91883 - DNA, 1046 bp, Homo sapiens
ttctatgtatggctcctgtttctatgttgtcccccgcttcttcactctcccaccctgcaggtgcctacagggggacttctcagggcccctcggtgggggtaactgctccctgtgggtgggggagggcctggggcttcccgtggccctccctgcccgctgggcatacgcccgctgtcctgacgtggatgagtgtcgcctgggcctggcccggtgccacccgcgggcgacctgcctgaacacgcccctcagctacgagtgtcactgccagcggggctaccagggtgatggcatctcacactgcaaccgcacgtgagtgaggcgggggttgctatggagatgttgccccaggctggggcacatggaggtggagggaggaagccatcatggcgctgggtcccctcctgtggaaccagcatccccagttagccaggggtttttaccttgcacactaggtccttattagagtgacagggtccccagtgtaaccctggttaccatggaaatggggcacccataggctgtgggccatagtcttcagcgttgccatggaggcggaggaggacctagttgaaagaggttttcacagtggtgctatgtggttgctatagagacaggcttggtgatgcatggagttaccttggagacagggtcacccacatagcccaaaaccatggaaacagccagtggctttgatggtgtcatggtgggtggagatgatggggtgctttaggggctctgggcctgcctggcgctttccccacccccaacacggcccctcaggtgcttggaggactgtggccatggtgtgtgcagtggccccccggactttacctgcgtgtgtgacctaggctggacatcagacctgccccctcccacacccgccccgggtccgccagccccccgctgctcccgggactgtggctgcagcttccacagccactgccgcaagcggggccctggcttctgcgacgagtgccagggtaagcagcccttgtcctgggcccagcctggacccagggagcctcctcccttcttggggctccagt

SEQ ID NO: 91884 - DNA, 1122 bp, Homo sapiens
acccagcctgcatcctcagaccctgaccctagtattgctgtttttttttttttgtttttttaatccttcaaaacccaaactcctcctcagatccccagcactttgttcctaggcccacagacagacccccccatttcccagatagcttcctatttcctcagctcccatctccaattctccagattctcaatctccccattcctagagcaggaatggtaaattgttacaccttgtacaccaactctgattgattggtactgactgccaggagctgcatgttgagaaaggggctcaatgcaagagtgcctgatagatgagccgtgtctactttggacacaggaaggggagtggtggccttatgccatagtttgacagtctcccctggatgttcaaacagcccatttcccagtctcagattgccctcccctcttgaacccctcctcctcccagaccccaggtgtcgttctcatcctcattgtctcctaatcctcgattctgcacccctctagctgagctacgtcctggcgtttgatggattcccacgcttcctggacactggtgttgtccagtcggaccgcagcctcatagctgccttctgcggccagcgacgggacaggcccctcactgttcaggccctgtctggtacgggggctaggggaagtgggacctcttagtcctgggctatgtatcccttgcccctgaactcaccacctgaagtgggctcaggacccagctctgccgctgcttatggggtgatgtagtccctcaccatctctggacctcagtgtccttagttgagaggaaaataggattgcgccggctgagctacgtctgcagagagaagggctgaatgagacatgtctctggggcatatagaatgtggttggtgtgaggatcccacaccactcactctttccagctaggcaggagtgtagtagcgcaatctcagctcactgcaacttctgcctcctgggctccagcgattctcctgcctcagcctcccgagtagctgggattacaggcgcatgccaccatgcctggctaatttttgtatttttagtagagacagggtttcaccatgttggccagtctggtcttgaactcctgacctcaagtgattcg

SEQ ID NO: 91885 - DNA, 1730 bp, Homo sapiens
gcctggcgggccccatgcacccaacggcgcctgcctggggtcagccctcgtcacactgcggcacaggctgcacgagtactgtgggggtggtgggggtgctgggggcagtgggcatgggactggtgcgggccggaagggactgttgagccaggacaacctcaccagcatgtccctctgacatgcccagggttctcatccacagcagctgggtcacctgatagggccgccctggacttggggtccctccacctgggggcccctggacactgtctacttggagaccactggcccccttcccccagggttgcccagatggggcctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcagagagggagaagcactgtgaggcctccagaggatgtggcagtgagggacgatggggtgaagtcagctgggcattcaaagaagctagactgagaacgcctgagaagaaccagctacgggaagagctttgggaagcaaaggcagaggccctggggtgggagcaggcttgttttattggaaggaccagaaaactggtaagtgtgacccagatcaagtgtgaggagatgaggctggggatagtcaggggctggatcacccagggccttgtgggccccacatagggttttgggttttattctcagggcaatgggaagctgttggatggtttgatgaaggggagtgacaggatccgatgtacctatttaagaatttaagagggtcgggtgcggtggctcatgcctataatcctagcactttgagaggccaaggtgggctgatcacaaggtcaagagttcgtgaccagcctggccaatatggtgaaaccccatgtctactaaaaatacaaaaattagctgggcatggtggcacacacttgtagtccgagctactcgggaggctgaggcagaagaatcgcttgaacccaggaggcggaggttgcagtgagctcagattgcgtcactgcactccaacctgggtgacagagcgagactccacctcaaaaaaaaaaaaaaaatttaagaggtcactcagttgtgctgtggagaatggaccggagggacaagaggggcagcagggatggtgggctggagtagggtgctggcaatgagggagtctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctggaaagagacagatggcaccctgagacagcccagaggtgaataggacccccaggctgcagggataaagctcagtggtggtgttacctcaccggggaccagggtcacacagcaaagctggaacaacag

SEQ ID NO: 91886 - DNA, 1033 bp, Homo sapiens
ctccctctgatccccagtctttccccttgtgtgccatccctgggcctggagccccacagagacctactgtggcctcagatgagtctctgggcctcagtgtccccatctgcaacaggccctcaccgatagcacttccatctcggtgatgttccagaaggctttccagaagtgcacgtccaggttctgtgtgatccgctcaaactcagccccacgcagctcggggtcgatggcaaagcggccgctggtgaagagagagctggcggccacacctaggggtcagaaggggtgtcagggagccccagtgggtcaggctgcttgggcaggagtggggaggagggccaagagagtaggctgcgagtagaacctggctgggactcactgaggcctgtctcgttgcgtttgtagtgctccccgaaggacaccagcccaatggagatggtctgcaggaatggccggatggcaggcgtgaactgtggagagacgcggctgcgtcacccaccgctcaagagagggatggggacagggcaggagcgaggcacagggatgtgcggggaagacacattcattcagtaaacgtttcatgagctcctactgtgtgctgggcatagctctcggctggttcacggacctgatgttctcaaagggaaaacaaatgatcagcagataagcaaagccacgcgcagtatcatgacaaggaatgacgaatggtttggaaaaaaaaaaaggcagtaggtggagagggcaccagtgatgactaggggtcaggctacttagcgggtctcggaggagagatctgactgaagcgaggggagggtgttccctgcacagggaacagagagcatgaaggcttaaaggtgagctcataggaggctgaggcaggagaatcgcttgaacccaggaggcagaggttgcagtgagtggagatcacaccactgcactccagcctgggcgacagagcgagactctgtctctaaaaaaaaaaaaaggtgagctcatgcttggtgcttgacctgggtagcgacagtcagggggc

SEQ ID NO: 91887 - DNA, 1084 bp, Homo sapiens
gtttgatgctgacactggtgtaatcttcagagattaatgaccagatctccaacagccccatctacccccactttggtaaacagtgaggttttaaaatctaagaatttggttaaacctttccagtatcaggaaaattgtatcctgcttttcctctcttcctatttcccgacaaggtgacattgagtagaaagggctgagttgtgtgcttatcctggtcttaatttcacctcttttttctattctcaacgtgcttcttccctagtgatttcacggagtgactctggtataaggaaaatcatcctttggaaacttacttgttttcttcacattgcccttgaaatgatcacaggggcactgcttctttggcagcccagacactgtcatgaattttcttctcggggctctcaggaaccaatctggaacaacagcattgctgcttagatgggagagttaatacatttgataggagggagtaggacagagctttaatcgccatcttctgtgccttgcatttccactgcaatggggtgggaaaaggggtcaacagagaacagtgtccatccagctatttgaatgccagtatttctgagttgtttttcctgacaactttgggcaaggtttgggcaagggtttgggcaagggtttggtggcaggtttggagggtgcatcagaatatcattactccaaagaatgaggagtaaggcttgggtgtctgcttttcagtggctactttcccttggggaagccattttgcctctctgctttcagtcttgcctgtgagtaaaataaggctgagaataggattcaggaagcttttggaaggccaggaaaaaataaaaaggcttttggacggtagctctgggttcttcaggaaaaggataaggggcagggcgcagcctgacatttggctggctttcccctagaccttggagaagtccagttcttgcctgagagtcaggaagaaagtgggcacaggtgctgcatgtggcaggctgtggagaggggaatgggtgaggtcagctgagataacatctgcattggtctcagaggggcccaagggagagagctggggtcatggtgatgc

SEQ ID NO: 91888 - DNA, 1079 bp, Homo sapiens
acgttggccaggctggtctggaactcctgacctcaggcaatccgcagcctcccaaaatgctggaattacaggcgtgagttaccgtgcctggcctgcaggtttgttatacaggtaaacttgtgactcaggggtttcgtatacagactattttgtcactcgggtacttagtacccaacagtttttttttttttttttctgatcctctccctcctcccaccctccaccctcaagtaggccccagtgtctgttgttcccctctttctgtccatgtgttctcatttagcttccacttataagtgagaagacacagtatttggttttctgttcctgtattagtttgctaatctattttattaaagtatgtttccctttcacccctcctccctccccaccctaatattttagggctaagccctcatcactggacacaaagaaactggtttcttagatgctgctatgctttggttccacccaccaagacaatgggcctatttttttctataatcaaaggccctgtgtttggcccgtacagttctacgttaaactggtgccaaagctcacgccttcctgttccgttccttccaggtcatctcagaatctgcaggcttgtggggcagggtagggagtcctgagtggtgaccacagaaaggggaaagctgtgggaatccaagacagttgttcttgagagagtcttctaggcctgttggcagaagaagcagaattgtgggccaggacctgggtcctggtgttggtgactgagctctgactttgaatgagtagatttgcctatctaggccttagctgtgcctgctgcaaaatgagatttgagatgaactcaagcccttacagcttgactgctctagccatgcattttcttttctcttcctcattgaaatctatatcattccttcagggcccaaggacccatgctcagaagaaatcaatttggctaatgtccttatgagaggggaccaaccctcaggctttatgtgctctttggccttttatgcaagagtggtgagggtggatatttttgttctggtcttcttttggtgctctttgatagcaggaagggcaga

SEQ ID NO: 91889 - DNA, 1049 bp, Homo sapiens
tccatagaacctgacagatccagggcacagagagacacatgtgcatgttccagctcccagtattcatacagatatggtgaagggtaggtggagttagattcttacggtttggttagtattgtccggggagctcctgtaacacatgtgagattctgtgttctgtgataatgtcttgtatgtcactgctacttaagagtttaaggtgaagctttgtgagtgtattacatgtgtctggtgcatgcgtgtgggtcagaatgtggatcagtggctgctgatgtgctgatgctgagaggaagtgatttaggagctgggcttgctctctttatgtttctgctttttgtgcaatgtcctggtaacttgtcagaggctggataagatgttagaaattttcttaatccagtctgaaatctgccttgttttattcctgggtatgaatcatgtgaggggttgggaggtggaggatgaaattcccataccttctgaatagtccaaggtcagttctcagaaatcagatgttggttgtttagccatcacacccttagatttatgagttggacctagaggatttgatcgcttctgtgacagaggtatcatcctgttcccagaaaactggcgacacgttgacatgcaggaaattggtcagatttatggcttgtttctaaccaacatgtaggcgttctgccctttaaaaacaattaaatttcactgatgtttttcatgtatctaacaagggccagttgctgaattctcaaagataaataaaataagccgggcgtggtggctcacgcctgtaatcccagcactttgggaggccgaggcaggtggatcactaggtcaggagttcaagacaagcctggccaagatggtgaaaccccacttctactaaaaatacaaaaattagccggggtggtggcgggcacctgtaatcccagctacttgggaggctgaggcaggagaatcgcttgaacccaggaggcggaggttgcagtgagccgagatcgcgccactgcactccagcctgggcgacagagtgagactccatctcaaaa

SEQ ID NO: 91890 - DNA, 1133 bp, Homo sapiens
attctttaacaataatttaaataatcgctgaagggcagctctctgattcctttcccaagttcctagcagattgtgtttatcagaagctggttccctcctgaagctataacccctccctctcagcactgccttgaacagagcccataaagatattaaaacatatatgtgcttttgcattttccatcaggaattgccttggattttggcaagtgattttcctagttgcttctagtgggttctctgaagacaggcttgccagaaggattaggtggtattctagctaagcaccaaggtgcttagaccctgatcctacaggtagacaaccctgacagtggacaaaggtgtggcatttcactattggttatatatttgattttcttgtgtttggtgagttcacacaaggctttggagaaataggagaaggcattactgcctttactttctctctctcttgtttcctggcacatgtacttaatggaaaaggacataacctcaaggctatggcaaatccgaattagagtgataggacaggactgggggtgggaaggaatgagtgctctgaacaggcaagtttaaaacaagtccaggttgggaaaaggggaagggaggggaagttctggtccctctttcccaaagtcagctttgccaaatttcaatgacaagaaggttgggtttcctacagactcccaatgtactttcatctattgacactgagagaggggcagtgaccaggcagcctggagatgcctattaggaaggaagagtaggagaaagttgtttctgtccccacccctctacccctacaggggaaaggaatctcctagtgatgagggtgagagacttgaaatacatcagcactgcagtgagcaggacaggtttcattactgcttttttacttctgaataaattatttctgtggctgttagggatggggaggctgaagttggttgtgtgggttgctgggcttcaaagttcagggtagaataagtaacttcattcatctgaaaagcacaaataatgatcagttaagtcagtgacacagggcagggcctcaccttgcctggtgtgattcagcaccacaagctgttaccattttgaaattttagctctggagaagggcttttgttgttacc

SEQ ID NO: 91891 - DNA, 1690 bp, Homo sapiens
caggcgcccgccaccacagctggctaatttttttgtatttttagtagagctggggtttcaccatgttagccagaatggtctcgatctcctgaccttgtgtttcacctgccttggcctcccaaagtgctgggattacaggcatgagccactgtgcctggccataaaatgaaaaattctataaaattattattaaaaaacaggatctcagatctattaaaattgaaattatccttttgacaataagagcaggatcagactgaaggtaggggagtgagaatgattcagtgccttccttttttaggccattgtgctgggtgctctttgtaggttatctcgtttaatcccttcaacttctctttgaagtaggcagaatgcccattttacagatgacaaagctgatgatcaaagaggttaagttacttgacaagggtcacagagctactaagagtcacatccagtattcagacacaggatgggaataattccaaaatgcatgttcttgctgcaaagtagactcatgggagtgattacaaatacgtctttgttgttgcactgaggaacattaacccaaacttgatgttacattgtgtcttcatgaataatcaattctacacagaatcatttccatgagaaaataagcccatgaaaaccggctatgcttaccttgttaggtgggtcattggagtggtcctgagctggagaagcaaaagaagagttagcgatccatggaaatgcaaagctgacttcaggtgattctagctgaaggaggtggcagttggagggtggggagtttaaggatcagttaaggaatttacttccctcagagtgtatggtccagacccagcatgttagtaccagagagggggcaggggcagaaccacaggaggccacaatccacttgtgaagagttctaccagttcacaaggccttgatttttgcccagatgtgtttctcagcaacatgctccagtggcaaggaggggcattgagacttgtagcacccacagcacccacaagataaggaaagtctcaccaagggagagtgcccacatccgtaatagaggcaggaggcggaaggagtaaggctgaggaaatggctcctggaaacatgggatcttcctcaggcctgcctggcctaggcagagtgagcctctctcctcagatgtgtctcaggggactcctgtggctaggaagggtgggaagacctatgccaccttagggttgggaaatagagatcctttctgtgaaaattcagaagggagggagtggtttgggaatccaggattccctgccaggggagggcacgtggtggaacataccagttctcactggggtaagtggctttacttactgtggttggagactgagggtttgtgctctgtgagatcacgctggtcgcttgccctaaataaatatcagaaactgtgactgctattcccaagcacaggatctttgttccgtaagttaggaaggacactgtgagcaggtaattccttagagtccttgatgttcatactgcctttcttctgagggcctcgttcttcagtctaactacaatcccttctagtgtttactcttttcctgtttgctggatgttcacatttcatttcattctttatcagctgcttctgtgcctacttctatccttaaaacctttcccattttgttttccggggtagatactttttttt

SEQ ID NO: 91892 - DNA, 1049 bp, Homo sapiens
ccctcctgacctgtgcgtatgggggacataggggagagccgtgtgtcacagaaggtggactgatgatgaaaagggagccgccttggcccatggagaagtgcttatccttttcttgttttctcctcagcgggcctagagctgtattgtcaaaagggtctgtccatgactgtggaagcagatccagccaatatgtttaactggaccacagaggaagtggagacttgtgacaaaggggcactttgccaggaaaccatactaataattaaagcaggtgaaatgagatggggcatttgggctgggtaggagggaggttgattatctccatgccaatgcttgttcccttcgtccaggccaattgtgacggccaccatccatttcccctccttcctgtctcataacagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacaggtaccctggaagtgggggagataggtactaagagaaactccataaagagcttgtgtatggcctccctttgcattctgacttggcttagcctaagtggtccataccccaaagtacctcacagttcaagtaattttatgtttctgaattgttcattgggatctaaacactgctcagagcagcgagataccagtgaagcctggagtgtaaactgggttttgtgtttattaagcaataagacaggctgggtgaggtggatcgcctgaggtcaggggtttgggaccagcttggccaacatggtgaaaacctgtctctactaaaaatacaaaaattagcttagcctggtggcgcacacctgtaatcccagatactcgggaagctgaggcaggagaattgcttgaacccaggaggcagaggttgcagtgagccaatatcacaccactgcacttcagcctgggacagagagca

SEQ ID NO: 91893 - DNA, 1051 bp, Homo sapiens
cgagaccagctggagtaacatggcaaaaccctgcctctacaaaatacaagaaattagccaggcatggtggcatgctgccagctacttgggaggctgtggtagaaggattgcttgagcctgggaggttgaggctgcagtgagctatgattgtaccactatattccagcctgggtgacacagcaagcccctgtctcaaaaaaaaaaaaaaaaaaagagataaagtgcttgagcctgctgtgtgtggatgtagaaactatgtgactgccagatgcctagaattctgcagggcatgggttttcctgggccttacttgtggagcttagggaactgggggaaaactaaatttcccatagtgtccatggaggagggaaagcaattttaggaatattctgggaagagcccctgccagagaggcacccaaggcctcctggggaatgtagttctgagaggcctgaggcactagactccttgactttccttcccctcccttggcccctagggttcacagtgtccaccgtggaggaggagaggactctgaaccctcggctcaccctcagctgtgaggagtttgtcaaaatcatgggcaacctgaacttgcctaaacctcagcagataggtgagcagctggggacctggacttctgggtctgagagaggaggggctggggtcttggactcctgggtctgagagaggaggggctgggggcctggactcctgggtctgagggaggaggggctgggggcctggactcctgggtctgagggaggagaggctgggggcctggactcctgggtctaagggaggaggggctgggggactggactcctgggtctgaggcagtaggggctgggggcctggactcctggctctgagggagtaggggctgggctgggggcctgggctcctgagtctgagggaggaggggctgggggcctggggtcctgggtctgagggaggaggagctgggggcctggactcctgggtctgaaggaggaggggctgggctgggggcctgggctcctgggtctgagggaggaagaactgggggcct

SEQ ID NO: 91894 - DNA, 1061 bp, Homo sapiens
cactttcagaggctgacgggggcagagcatgaggtcaggagatcgagaccatcctggccaacatggtgaaaccgtgtctctactaaaatacaaaaagttggcggggcatggtggtgtgcacctgtaatcccagctactagggaggctgaggcaggggagtcgctcgaacctggaggcagagattgcagtgagccgagatgaggccactgcactccagcctggcgatggaatggactctgtctcaaaaaaaaaaagagggaggggaagaaagggggtacccaggtctgcagggcaggtggccagactgactgggttcactggggccttcctgagctgggagagaatgggctgggaacaagaccatgaggcccactagagtgagtattttagtaaatgccaatggctgttgcctcctgaacgccctccccacttcccttgggcctgtttgtctgaggcccgatttgtcccctaggtacctcatggcagggccaggttccagcagtgaggaggatgaggcctctcacagcggtggcagcggagatgaagcccccaagcttcctcagaaggtctgatgccccctgtccagtgggggagggtgtagtgggaggatgacatgagtccgctgtggcaccccaaacttcccactcttgcctcttgcaggtacccccccaacacacccacactgttcctgccctcctcacccacccactctccctccttagcaaccccagaccaaaaccaagcccactcaggcagctggacccagctcaccccagaagcccccaacccctgaagagaccaaagcagcctcaccagtgctccaggaagatatagacattgagggggtacagtcaggtcagactctgagggaggaggggctggggcctgggctcctgagtctgagggaggagggcctgcggcctgggctcctgagtctgagggaggaggggctggggcctggactcctgagtctgagggaagagagcctggggacctggactcctgggtctgagggatgaggggctgggggcctggactcctgggtctgagggaggaggggc

SEQ ID NO: 91895 - DNA, 1431 bp, Homo sapiens
gaggaggggctgggggcctggactcctgggcctgagggaggaggggctgggggcctggactcctgggtctgagggaggaggggctgggggcctggacccctgggtctgaggggggaggggctggggcctggattgctgggtctgagggaggagggtctggggcctggactgctgggtctgagggaggaggggctgggggttgacccccagtggtgctaacctaatctactctttgtcttctccagtgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatgtaggcttgcgcccccctccctgcgccgctgcagtttctcccccagctccctgtgtctcctccaccttgtgctttctctgtgtccactatgctgcatgctttctctctctctcacttgctttctttctcactgcattctgtagcctttgtcttctctctgatttttgcatctctcccttggtctccaacctctttttgtttctcccacctcaatctcatgatctgtctgtctgtctgtctctctctctctctgtctgtctcccctgtctcgttcccctttgcccctcagatcacacctaactggcatcttcacttctgccccccaccagctgtgcctttgccaacacccccaagtacagccaggtcctaggcctgggaggccgcatcgtgcgtaaggagtgggtgctggactgtcaccgcatgcgtcggcggctgccctcccagaggtaaggcctcacacgccaaccctgctccttatcctgtgctgggcaatgccaggaatctggaggggagtcagactggggcctgccagcggagaacacaggtggtcccagcccagagccagcagactactgagaggagcggggcaggggctggggtactccagatgagggaaggaggacctgcctgggaggtcacagagggctctgtgaagcctgcttatcagaaaaggctggaggagcagtttgtgcaaaaactcaggggtgggagaacaagtgttagggtccatattcattcattcaaagtgagtcccggtgcagtggctcacgcctgtaatcccagcactctgggaggctgaggcaggtggatcacttgaggtcagaagttcgagaccagcctggccaacatggtgaaaccccatctctactaaaaacacaaaaattagctgggcttggtggcgcacgcctgtaatcccagttactcgga

SEQ ID NO: 91896 - DNA, 1002 bp, Homo sapiens
ctccctgactcccacccctcctttcccaggactccccctttggcttgagttttgtacggtttcatagccccccagacaaagatgaggcagaggccccgtcccaggtaagctgtacctgtcactccccatggccttctccctgcctctccacccccacctgccagcagcccacctataatactgaccttgcgggaccttagaaggtgacagtgaccaagcttggccagttccgtgtgaaggaggaggatgagagcgccaactctctgaggccgggggctctcttcttcagccggatcaacaagacatccccaggtgagctcggacaacgtgggtcctgagtgagtagggttgagacctagactcgtgggtctgagggtagagggggctggggctcagattcctgggtctgagggaggagggtagtggagtcctggactcctgggtctcagggtggaggaaggtgggcctggcctcttgtgtcctgagggttgagaggtctggaggctgggactcctggatcactggtgggttttggcaacaatattctgtgtcccatagataggagtgaaagggtcttggggctcagccctctcatcctggatccactttctcccttcatagtcacagccagcgacccagcaggacctagctatgcagctgctaccctccaggcttctagtgctgcctcctcagcctctccagtctccagggccataggcagcacctccaaggtgaaatcatcagactttggtggggtggaggaggagagaagctggaggcctcaatccatccccatcccctcagccccaggagtctcccaaagggaagaggaagttggatttgaaccaagaagaaaagaagacccccagcaaaccaccagcccagctgtcgccatctgttcccaagagacctaaatgtgagctaactagatcccttgtttccacaggggcctgtgctcctgtgtcctaggggaagcggggctggagcctgctgtcctgaatc

SEQ ID NO: 91897 - DNA, 1048 bp, Homo sapiens
cctgactctctggattctgttttctcatttccagcctctagtaattccccttgcctttccgctgactcacctgtgcatttccaaaaggtgtttgaatattgtgccagtttactgaatattctctgccgggaaagttccttaggacatgtagcccgctgtattgccagatatggaagactccatgggagaatttagataagggtcgctcacatctggaggataaagagatccctctggggcctgtgtcagggcaggactgactcaaggcctagaaacaaagggtctggagacatctaggcccaagctacattctagtgactcccagtcccctgtgtgggccctgtgccctcttccccagcccctagaagctctcatctaagccaacctgccctggttctcatgcactgtggcttctcccacccaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggtacctagggtgggagccagggtgcagagtccttggtcctgggcaaggagggaaataagggccaatattgagtcccatagggctgggaggagtagacagctggtgtcccatgggattatggggaggctgggtccctgcgttccctgaaatgggtttgggatctttcctgtaatgagaagtttcatctcccggaggaatctaggaagggtgaactgcagcatctcagaggggaatcggaggaggggaactgacttgttagagaggtggcctagtagagtgggcctagtagttaacatcaggagatctggcgtctgattactgagttcacgtcctggctataccactttttagctgtgtgatcttgggcaagtgacttacgctctctgggcctccattgcctgatccttacagggttgctgtaggttaagggatgctaaaagctgtggtaacagtgagactggagta

SEQ ID NO: 91898 - DNA, 1019 bp, Homo sapiens
aaaaaaaaaaaaaaaaaaaaaagaaaagatctcagttttaggatgatttgttacacagcattattacagtgtaagttaatacaacttggttgttttaaaccactgagattagggactcctttgttactgtaacatcatctggtccaccccaattgatgtcagtgtttagtgcctgtcaactaatggcctccacttcccaggttcaaatgattctcatgcctcagccttctgagtagttggaatttacatgcctggctaatttttgtatttataatagagaccgagttttgccatgttggctaggctggtcttgaactcctgacctcaggagttcaaggcaaatgagcaccaaatgctaatttaagtgatccacccaccttggcctcccaaaatgttgggattacaggcatgagccactgcacctgacctcagtcttttaaactgtgatagatacagattgctgacagttttagtcttgagatctagattcaagcccccagctcttcctcttaatcggtgacctcaagaaaattgtttcatttctctaacctgttttctcatgtgtccattgggaataatgacatccaagcccggagttgtgaaaattcggtgacataatgtctgcacaagtgctctgtcaacatgtaggtgtttgtgtagagggagggatttgtgtttttattacttagtgggtgatgattccactgggctctcttatgatcaagtgactccagggaaatcacatttcattctgttaccccagttgctgtggaaacagagtgactggaggcagaagagacagaacctgtctctggcctgggagagactgagggagtattgcagcggtcaccaacatggtaaaccccagagggagcagcttggggaggtgatgtgtttcagttgggatgtccaggtttgatgtgactttgggacattctaggggtggcatccaggaggcagttggggatcacatgtggagctgaagacagaatgtggggaagttgtcagtgcagagaaag

SEQ ID NO: 91899 - DNA, 1045 bp, Homo sapiens
ctatggtttctcttccaactgtgacttctcactctgctgtgcgtcctcttctgactgccacttcttgaccttctggggcttctagattggctgtgactttgcggcctgctgcgggtgctggcctggttataactcttgaccctgctggacatttcagtggggctgtaactcttttccctactggggatgatcatctgaccgtagctcttcaccttccttgatgaggatggagatgggttgtcactcttctccttggagggaattccagtcggggtttgacacttggctgtactgggagttacagccagctcggaactcctccctatacctgagcctcctggtgggcggtaactcttcttgctcagatttctaggctggctgtcactcctttccctgttgctggttctaggccggccgtaactctttccccggctccctttttgctgtgaagtgggagttctcaccctgctggccatgcctggtctggcaccatgagttcttatcctgccaggagtgctggccctgctgggtgacctcttggagctgcggcttccccttctgccaggtgtcctaccccggctgtgtgtgcccctccgctggtggcatctcacgtcgctggccttgctggctttgctggtcctggtgtcggtgctcaccctgctgggtgttcttgctttgctgcggactcgggacctgctgctgggccggttagaaggggctctttttgtactggtcgatttggtggacttggaactgcttgggctcatgactgagttacgggatgtcgctggtttggtgggcactaaggatctgttgggtgttgctgatttggtggacttcaaggaggcaggaggcttgggatccgcagtgggcatggaggatccactgggtgccagagacatactgggctttgaagatctcttaggtgaagacatggtgggcgcaaaagggcttgtggtcctggaagtcacagtagacatgaaacacctggtagccgtggacgatgacctgattgcctgtcacaggccaactgtgtgaagtaata

SEQ ID NO: 91900 - DNA, 1018 bp, Homo sapiens
ggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtcttcatggttttatatataatatattaaaaaatcaaaagtctgtatgaaaatatcagattgcacccccctctccccattcctggcttttgccccctttttcttgttaaaaaacaaaaaacaaaaaacaaaaaaccacacacacattttgtacggggtggggaggggaatggggagggggtttggcaatctcactaaccaccattaaactgaggagagaacaagtgtttggggtggctgtgtgtctgtcctgctgtcaagggctgtaccattgggaggggaactaagggagaggggagggaggagtgtgatggttgctggtggacagtataggccaggagaaggtcctgacctcactgagggtacctcgacctccccagaaacctgggtttggccatttcttcagccaaatagtcacagtcttgtctttttgatagcgactgagctaccccattccatggcccggacccttaccctggcttccccctacccca

SEQ ID NO: 91901 - DNA, 1086 bp, Homo sapiens
tcagagttctgcaggctgaaccagaagcatggtgctggcatctgctcggcttctggggaggcctcaggaaacttacaatcatggcggaaggtgaactgggagcaggtacttcacatgcccagagcaggagcaagagggggcaggtggcacacactttgaaaccacgagctcttacaacagattcactattgtgaggacagtaccaaggggctggcgctgaaccatgagaaaccacccccatgatgccgtccctcccgccaggccccacctccaacagtggtgactacaaactacaagttgacatgagatctggtggggacacagatccaaaccatatcagtgcctgacctatgctgagcctcaataaatgttaaatgccaccatcatccacaggtgccaggtctgcattgggcacatagcattttgcaatcctctaactttgcaaataaatgagccaatacatactctttctccttaatgcaagcgattggtctctatcaccagtgactgagaagtgccgactgttagggaatggcagctaaaaagcattatttcactacaaagtctagttcagtcatgcgctggtaccgggggtgacctcttttcccactctgggcctctgctggaagacgaaggggaaggggtgggcagtatctcaagggtccaggctctccttctctgccaccagtaccccagagcatgtccctgaccttccagctactgttgacagccatccaggatctggctgagcccactctcctcagagaaggtgctggggtggcagctttgggggtggcaaactccatcttggagcagaggaaggagaaacgccctgctgcaggatctcgcgagccagctgggcatggccggtggtcaaatgctctgatgcaatgataatgaggatgtaacggtccagcagcacctgctggaggtacttgtcagcctaaaaagtgggcgtgcctatgcctggccggtctgatgatgaccgtgggtgcgggtagggtgtagggtccacagccatttctatcacagccatgcaggctgagttagggtctttatttcgtagcctctcatgatattgacagg

SEQ ID NO: 91902 - DNA, 1093 bp, Homo sapiens
tagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcag

SEQ ID NO: 91903 - DNA, 1032 bp, Homo sapiens
gccttttttgttgccataggcatgaaaaaaaccaatgatagtctgggtgcggtggctcacacctgtaatcccagcactttgggaggccgaggcgggcggttcacgaggtcaggagatcgagaccatcctggctaacatggtgaaaccccgtctgtactaaaaatacaaaaaaatgagctgggcatggtggcaggcgcctgtagtcccagctactcgggaggccgaggcaggagaatggaatgaacccgggaggtggagcttgcagtgagccaagagcacaccactgcactccagcctgggtgacagagcgagactccgtctcaaaaaacaaaaaaagagaaaaaaaaacaatgataaagtcaagctgaactctccactggtttattaaggtttcccaatgtggtcaacctgtgaaatgtttttttatttctgaacaaatgttcagttgtcttcattttcatttctgagttctctttatcattctaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatg

SEQ ID NO: 91904 - DNA, 1090 bp, Homo sapiens
ttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaatgaaatacaaagatttccttctttgactatttaggaaagactaagcaaccaaatagcaaagatccctcaggataatgaggtttatgtttggaatagcatgagcagattactacttaggacacagattcctaggaacattcctcattgaaaataaaatggattcctggaaataggtaactagaaattttggccagaaatggtttcatatgaagaactgagaatgcgtgggaagtatagagggcaagtgggcttattttcatatatgcaaagcaatattaaggaactctattttcatgttttagttcttcccctcatgtagcattgtctctttcctctgggatatgttccctgatgtgagagtcctctg

SEQ ID NO: 91905 - DNA, 1006 bp, Homo sapiens
ccattccttttcttttgttcacaaacatagtttcctcatgcctcactgacacagagtagagtatttagcaagttttatgccttcagaaattcctggatatgtagacactaatctcttagtgaacatctgtgtagcactaaagagtggaaaagactctctatacatattgcaaaattgggttgcaattctgtaggttctatgtagatgatcttattttggaatatgcaggtatttgacatccagagtcttatttattcagactaagattaaaccaagattacaatagttccattttaatgctctgttgtaatattgggctgtggtagttctgtacttaatactttatctcacccttttgctttttcaacctaggttatcggtcagtatttgaaaacaaattcatatatatttttcatactttcttgttagctttattccatttttccatctctaatattttttgactaagatgtcttatattgctttctttcagacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatgctatggatttagtgaccgtattcaatcttttt

SEQ ID NO: 91906 - DNA, 1050 bp, Homo sapiens
gtgaaatatttactatctggcctttgacagaaaaaaatcaaccacccctgtttcattaatttcttgggaatttagagggaattcctaagtgggaattctatattcaccagtgcaaaagtcagaataagcatcctttttaaggcagacaaaataaaatagtttatatcagttcttatctggtattcctctttggagttgtaaaaacaggtccagcatccaaaacccaaagagctcacccagaaggcacctgtacatcttgactggaatcttttgggcactgacaatttaaggacaactccccaggtcaccaattttcctttttccatctgtcagacttttcctcctccatgaactttggaaggaaatgatgcccagctgagcaggaatgtgtgtccttttttaggaaggagtgaacttcaaaattgtgactgtggacttcacacgggaggaacagggtacttggaaccctgctcagaggaccctggacagagatgtgatcctggagaaccacagggacctagtctcttggggtaagaatacactcctctttaatgaagatccatctactgaaatgatttcacattctgatcgattaagaactgtgaaattcagcagccagaatgattttggctgcatctagattgtgtttgtgctctttattccccagtgaagattaattttagtttgtagggtagaaatagtgcagattcttgggcttgagattttcagtcttcatgttcctaaagaccaaaggccaggaccagattctgcagtaattttcttttgtccccagctttgaaaactcaaattcctgtatctttccttgtcagctttttgaagcagatacaatctcctagttggagcaagggaaagaatataaaaagaattttccaatacatgtgttcaagtgagaaccagacacataggggtcattacaggtgtagaaggtccatttgaaaaaatccgcatagaagatgccacattttttcttcatttcccacctcctggtggactgtatacatgactactttttccatatatactctctat

SEQ ID NO: 91907 - DNA, 1850 bp, Homo sapiens
actctgcacgtgtgctggcatttgggcagattggggaggcatgggcagtcctaggaccctgattctgcctgaggatgcccaggtgtgtgggggggagcagctgcagaggggcgggactgtgtcaggcaccccttgtgcacacacaccggtgtttggttgggaaacaggaggccggagatgagttttagacagagggtgctggggtctttgtgtgattggaaccctgatcacagcctgatggtgcccagtttggtggaaagacaggatcttcctgagccacaggtgcccccgaaagatgtttggtcagaatctgggcaggtgtggctcaagcagggggctgtggagtaaggtggaggaaacagtttgggtgcaatttcaggaaacagctgcattgtgaacctacgctatgctgcgtgagaatatggtgggagcaggggagagagtaagtgggagagatggagtgcagaggttggggtgcctagggtaggatttgccctctagtcttggatcccaaaacacctagttggtacagaggcatctgagcttctgagacatgtatttagagcctgggtagggctgcttttgtctggcttgtgctggtgtctgttggaggcccccagccctatgcaggccttgttgtagtttcaggcctgagtatacccaagttggtggagggactggtttagagctacaaattcagggcctgggagggtgttagggtgggaatctggctggtgctgttcgagtaggagccagtggaccccagaagtgtggagggaacaggatgtgggtatagctgagctctgtgcataaatgcttggctatttgagcaggatgtgggtggccctctgtgctgagttgctggagggacaggtctggctgatggaacggtaggatcagtcttagttgttgaatcagttcctgggagcagtggagctgtgtcaccagcttcatgcagttaggcagtgagtgtgattctggccctaggaagaagtgctggtttggggctgtagattgaggttggtaggggtaggatggggtgaacaccagggggtcctcgatatgcctgatatttgtggggatcccagggcccagtgaataggagagggatggactggtgctgcagactttggtggtgggcagaaggccatgttgggcacaagctgggcttacaggtagatggtccaggggcccaagatggtggaggaaccaggttggagctgcagaaacttggcctgggagagggactgagggactctcagtacatacacaggtatttgggcaggaagctggcaggaacctccagaagtgcatttgctatgggaatgcatcctgcatcctgggagcaggggctaatgggggtggggggcccagcggttccggcagacctacatcttcatgctgtacttggggcttctctcagtgcagctcaggacctcagcaccctgctgtgcctggaggagagcatggaagagcaggatgagaagcccccagagcccccgaaggcctgtgcacaggtgagtggagacccagagcttgggtctgtctgcagcctgaccctctcagcttgggaggctgtggctcctccctgactctctttgcagccttttagggggtttggggccctcatggccatcaggcttctaacacttactatatattttatgaatctccctgctagttgcctcacctttttagcccagataactctttctggaaggaatttggcatcctgaatcaaaagcccttaaaatgctgattcccttttggccagcaattcacagctttgagaatgaacaattggaaatatactaaatgtgcaatgtaagaggatagctgaatgaattacg

SEQ ID NO: 91908 - DNA, 1019 bp, Homo sapiens
aggggctgtgccactgtccctttactcttgatcaggtatttgggtaggaagcaaaaggttgtaggtaagattccgagcaggtggctctgggcccctggagcagacaacgcgcttctccaaggtctgggggcgctgtggttggtggagagaccagattggagttgcagattcttgtgccagaagaggcagtgttgctagtgaacccttggtgggaattacccatgggcagcaaactcccaggctgaaggagggtatcagggcctagaaacaggttctgggcagagggccccctgcacgtcctgggggtgtctgaatggaaaacagaaacttgaactgatagtagggacctatgtaggatagtgcagagctctagagcattcaagatgggcagagactccgggttggagatacagaatttaagtccaggaaggacagagctgcaacagctgccatcaaattggtagctggggaggaagcagtatgttgccagcatcgttatgaagcaggtgttgctgagacctttacttgggtacgctatttgcaggcgtgagaatgtgcaggttagtagagggacagagcctgtgctgcagatttggtcccgggaagagctgactgcacaacacccaggccgtcatgattgggcaagagaaggacaaagggcccagttcccattgagctgctgtatcgtaggctcgagaacccccacgctggcgagtgcccaagtcctggggctgattatggagctgtatgctcaagctactgtttagttgttgtagtgtcctggctgcgggcaaatagtggggcagttgaccccagaacctacacagaggctgtgggtacctgagatgtcccaggcaggttgagacacagggtgagggatgtagattgttgactcaggagcatggtgtgcccccagacgggcagaggagccaggtcctggatgcagattgtgagcacgaacctgctctgtggctgtatcagtaggagggagtctaggtgggtggcccgtgtgcagtggc

SEQ ID NO: 91909 - DNA, 1029 bp, Homo sapiens
aggggagagtaatggaaaacgtgggcagaggtagcaggggccagatcacgtggggcctgtgacaccagaagacttcggtttaactctgagccaggctaggcccccagagggtactgagctgaggtatgggaactgacttagggttcacaggcgacctctggtggccatgtggggaacagacgagggggcgagggcagaaacggagcccagcgtggaggcggctgctgggggccgggatgcacagcgccagagcagggaggtaccgtggaagccctgaggagaggtgggattctggatggatcttaaggcggggccgacatgattggctaatgggttgggtgtgggcatgagaggaagggaagagttggggggcctccagagttgctctccgcttatgctatagagggcgtgagggtttctgggcacgtagtgcgtgctcaatcactgtcactccggacctgcagcagaggccacctcctcacctttctgtctctcccaggaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtgaggaactccctgggtgggaagaacagggaccaaaggaagaggtcgaggcagggttccctgtctaatgctctctggctcccatccttctcctaagccttctcacaaaaggaccagtggggccagctttactcccctgttaactccatacctatatcactggtaccgttgttcagctgcctggatacactccctccacacacacaggttgggatagatgtggaatccctctctctcagggactcaggcctttccaaatatattaggcagacctctatcaattgcaattgacagaaacacaaagtagtctaagcaaaaaaaaccaaacaaaacaggactttattgaaaattcaccttcaggtatggttagatccaggggct

SEQ ID NO: 91910 - DNA, 1122 bp, Homo sapiens
ttctgggatttccactctgataggggagacatggcccctatattttgggaatttccaatctgatggaggagacatgacccaagcctctagggtcttccagtttgatgggagagacacctctcaaagtctgggaatttgtagtctgataggggaaacacagaccccagcagacactactgggacccagaatccacctccaccaccgcacaagtcacctccttcctcagtctccttcccagcaccctacatggggagtgccagccagctggggggaggccagcaagggttgggaaggggacaccatgccagatgcagaccaaactgacccagcccgctcgctctctccccagctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagaccgtcacagtgcagggcaagactgagacactggaagtggagctgcaggtggcccgtgagtgtgtgggaaggggcaaggcgtgcccctttttagacaagggctcccaaaaggagcctttgcttcctccatcaggctggggggacatagaccaaagatggatacccatcccccatcaggctgaaggaagcagccttgtctcctccgcctaacttgggggtccccaaatagggttctgcctcttctatcaaactaatgacctacactgtgggtagacaggcctcctccatcagactgagggttgctaaaggggacccccatgccttctctctcaaataagaggtacagcacactgaaggttttaaaagagaaggcatagtctgatggtggagcatcctttttcctgcagacaggtggaccctaaaacatagggtccatattggggtaatgggttaattataggagtttacctctcctatcagactgcaggcagagaataagg

SEQ ID NO: 91911 - DNA, 1059 bp, Homo sapiens
atttccctgggggcggggcagccgctggggttgagtccgggtcactgagtcacaggaggcggagagggaggctttggggacacagggggcggggcatgggggctgcaccccggacttgcccagggggcacgcggcgtctctctggttctctcccccggtctccttctgtcttcgaaacttgcctgacctccctctggttgtctcctgccccgccctctgtctctgtctccccatctctgttgctgtctctgtgtcccctgggaccttgaaagtgggtattggggccccgggaagggactttggccggactcgggccccacccgagtggatcgttaacccaggatgtgagaagtggctgtgtggagaggcctcaccccttcccttcctttcgacctctctctggatctcccttatcccccttcatggcgaaacatcccgagcacagacctgtgttaattccacctccaccccttgctcccggtgggacctcagacaagccatcccctgccttgagactcagtttgttcttctggaaaatgggaccaatggcaacccctgcctgctggtgttgtgggggccacagcaagggaagaggggaggaattcggttggacaggctgggggctgtgttccctgcccatccaaccccacccctggggaccctcagacacaggagaggggtgtggagcactatcccaatgcacagaaaggaaagctgaggtttggaggggcgaggcttagggtggggaccctcagaggtagggtgggaaggacacccaagcctgtcccactcctggcatcccagggcagctggtgcagtggttccaacctagcaggactgtagaggggagaagatgtgatgggtccggtgggagcttcgaagggctgggagagacggtgctgctggaagagagggtgctgatggttctctgaggttggaagagggataaaagggtcagaaggaggaggatctgaagaaggaagataggtctgagagagaagtagatggtttagtgggaggagggggagaggatctgaaggaggaggacagggtctgttg

SEQ ID NO: 91912 - DNA, 1072 bp, Homo sapiens
accagggggtcttgaggacccaggagaacagagacccgggtttctgggtactcagttatgtggggccacaagtgatcagggtcctatttgaggtcaagatcaggtgggcagaagggatcaggggactgaggatcctaagattgggtaattctgagactttgggtaatttagaggcaggatgaaaatttcaggggtctccagacagaaagcctcaaggcctcaaggcctggtattggagatacgaggacctggaaacttgggagttcaagaacagagggcccacaaggatcagcagatgacgaagaccacacactcttctctccatcctatctccatccctgatctcaagaaggggtgtcctctaccacagctgtggccacgtcaccatccccaattgacccccaaagctgcagagagccgttctacagagccccaaaactttaggtagtttctgcaccctccaccccatcagcgtgacagctggagagcctcaagctatgtgcatcaggagttctgccacggcctcccagctttcctattccaagagtgagaaagcaggcctcagttttccccgtctgtgtgatgggttggtatggatttgcctgctgccatggtcccctcgcctttgtttgtttttgtttttgttttttgagacagagttttgttttgctctgtcgcccaggctggagtgcattggcgtgatctcggctcactgcaacctccgcctcccaagttcaggggattcttgtgcctcagcctcccgagtagctgggattacaggcatgcaccaccacacctggctaatttttgtatttttagtagagacagggtttcaccatgttgcccagactggtattgaactcctgacctcaggtgatccgcccgcctcggcctcccaaagtattggtattagaggcatgagccacagcgcccggcctgccgtggcccctttttaaacagtttgatctaaaattacccatgcgtggtggtcagcatctgtaatcccagctacctgggaggttgaggcaggagaatcgcttgaacctgggaggcagaggttgcagtggggcaa

SEQ ID NO: 91913 - DNA, 1022 bp, Homo sapiens
ggctccggctcctgctccgcgtccagctctgatcctttaaggcctagttttctcgaccctcgggctccacgcccctggctacgaacttgtcccattcctcctctgccacctcaacggcctaggccccgccctgcgatggcctggctgaccccgccttccagctaggccctgtccacgcattgtccttcccccctccagctcccccgactccttggggcgcgggcctcggtgtccagctccggttaattcatcgccgccaacgcagtcccgcttggcctgcccttggctctcgctcctaccttcctgtgaccccaccccgatccggtgccgccccacgtgccggccacccacccgggcctccagcctctgttcccttaccccgggtggcccgcgcgccctcctgacccggccctcccgtcccgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtgagccggggcagctgtggacatgccccttgcacacgtgtgtccgcgggctggttgcaggcgagtgtgccagagcgcagaggagtgagggtgtctgtgccgttgcgtggaggggagtgggtgagcctctgaaagcgcgggtgtgagttccagaaatgaggagagactggcaccaagaaaaaaagtgccttgcccatcttttcatactgagaagtggagaggccaccacctggatccagtgagctaggagggatgggagagaggactgtgaggcatgggtggctctatggtcacgcccatcttcctacaggtcatcgacatcctgagggggaaggccacccggcctgcttccacctcccagccagacccctcccctgaccggagcgccaacacctcccccgagagcagcagccgcctcagctccaatgg

SEQ ID NO: 91914 - DNA, 1498 bp, Homo sapiens
agggcaggattcgaactgtgggtgggacagaggccaggacggactgagctaagagaccgagagaactccggctagggcgaggggcggggctggtggaggcggggctggtgggggcggagtcggccggaagggccgaaaggggcgtggcaagaccttggcgaggcggccggtaggcagggggcggggcgtgggaactactcgggagcagagggggcgtggctagaccttagggggcgtggtttaacgccgggagcgaaggagacagaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggtgagacgagcggacggccccctgccctcgcgcggaccccctccaaccttaccttccgagctggggaagccgagcaccttccccgcccacccccggctccccgagccccctctcgcgtgcccccttcctggctggccccacagactccgaccccctacacgtccgattctctcgaggagactctgacccctcctttctgcatctctctcaccaccacccccatccttcttaatccaattgcccatcctacgcctgcttgtctgtccccctccccatttctcggattcccgcgccgaaagggttaaatcccaggaaggcctggtgccccctccccaccccgcgccgagtagttcacccggatctgggtctctgtctcctctacccctctcaggaatgtggggaatgttccccccacctaccgcagtaaggtctcgaggaagaggcgagaccacctccctcccctatttttccttcttcccggcttgggcgtctgaggcccggagagaactgaggacaagcggacctgattcgggtcccttggagggctaaggataagagttctggcgacttagggggaagggcctgagctcggagctccaaccccgaacctcagggagttgggggttctgactccgtggactccagaaaaattaggggccgggggctccgtcttcagggtccctggtagaatggaggctaggcgctaagtctaactgggatctaggtaaaactgggggcgagagaggatcaaacttgt

SEQ ID NO: 91915 - DNA, 2143 bp, Homo sapiens
ccgagccagggaggggcggggcgggcgctcctggctccgggttccggactccccggtttcgggaccttatctatcctctggtagcgcctttgtcctcagagccatagcaggaggtggacgagtggagccgccgcccttatcccccgtccctcccattgctatgccttggaccccctggcgtccttccatccaccccactaggggaggagagcggcccccctggggagggaggggctgggagggaacccttgaaagaggcgctggccccgccccttgcaggtgacccggttgtgtattcccagcgacaaactctgggatgctagagtttcccgagggtttgcgcagaagagagctcagggggatcttgggggaaccccggccacctctctggcctcatttcccccaggatggctctcactggcctcccagctttgacccagagctgggaactccgcttccatcccctgcctctcccttcaggcagaaataggcagatgagatcagaactggcacctctgggtgaattctccgaacccaccagaccctgagcctactgttagcttggtgcatgatctcaccgaaggctccagcttgccctgggaaacaggtcctgtttctgtttccatcttagagatgaggaaacaggctcagcaaaggcaagcagccttctcaaggtctcacagcaggtcccggggaagccgggctccggttcttcagagccccgcaccgggtgggctccaggaagtgcctctgagtttccatttcctccctcgtaaaaaaactgagataacaatcctttccctgcggaccatccggaaggctcccaggccccactgattccctgtgaaacctcttagcccctggagaaggagctgtcggcccctttcttgaccacccccaccccaatccttcgcctctgctgtccactggctggccggctggcatgtgctcgctctccctctctctctctctcccctccccctccctgttttcctccttccctcactttctttccccctcttcatctctcttcgtttctcaccctttctctctccatccctctccaagctctttctctcttctcctctccccatctctctctctcctctccgtctttctctgtatacctgtctagctccactgcctcccccgcttggcctcctcggggaatgcgggtgcaccacctgggcccccagctgggccggctcccctcccccagctttcttccctgcccatccgtgtgtccatgtccgccaggcagccccacgtagtggagggggaggggagcagagggacggcagcctggctgtctcctctcattagggaagggggactgggcagaggagaagttggggggtgggtatatagagaggctggagctacaaggatgggtacagaggccaatagagggaagcggtcagacacagatttaggaatggggtcagagacacgtgtaggaatggaatcagaggatagaaggggagtgaaatgccggcacagggtcgggggagtgaaataccgacacagggatgaggctgaaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaacacagaagggacagggagctgggcacatgggccagctcccccgcccctgcctgggacgctgttacatttttaatgtcccagcagtgctgacaaatggagcaggaaggggaggagaagaggggacccagcaagatgggccaggctgtgagaaggtgtgtcagaaatatggggagacagggcactggagacccaggaggcagggagactccacagtcagagacagaaacagagacgtagaccagaaggcttgtgagaagagaaccccaggaatcaaggcagagagccaggttccagacacagggagacccagacggagaaagagaccggagatgtcagacatacagaggaaagaggaagagagtgactaacggggacagggtatcttctcagg

SEQ ID NO: 91916 - DNA, 1035 bp, Homo sapiens
cagcaattccaaaatcatatgtaatatgaactcatagtacacgttatagttgtataatagaatagtcattttagtcttccctaaaatgtcttttccaggtggcttttttggaatcaggatgctgcgaagctgcctacgttgcatgcggagcctgcatttcccgtggggcccccttcgtggtggccctgcctggaggtgtctgggtccctcccccacccgactacttcactctctgtcctctctgcccaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcataggtgagcagggtaagggcgggaggcaaggaggtgggagggccgcggtgtgggagcatccccttgcgggtcagtttctctcttggcttcagctgtgaggttcacattctctgtgggtttccatccatcagcaaatgttcattaagcacctaccgcgtgccagatgcttttctgtgtgctgaggatgtggcaggcaaccaggcattcttgggaaaaacaaaaaaataagtattggctgggcgcagtggcccacccctgtaatcctagcactttggaaggccgagatgggcagatcgcctgaggtcaggagttcaagaccagcctggccaacatggtgaaaccctgtctctacgaaaaataaaaaattagctgggtgtggtggcccgtgcctataatccc

SEQ ID NO: 91917 - DNA, 1030 bp, Homo sapiens
aaataaaatgggcaacacttggatagggcagtgcaggccagacattaccctaagccatttacctatcaatgtattatttaattcacacagcaatcctaggggtgggtactttcattatccccattttacaaaacaagaaacagctacagagttgcaaaaccacttatcccaagccaggccgctgataagcagcagagctgggattggaaccccggcagttagggcctaaccaccctgctcctctgctgagtgtttgttgaatgactgccggtgaggagtgacgcaccccctctcctcctctccccagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctgtgagtgtatcgggggtgacccctcccccatcaaaactgcctacactggcttctctaaagcactgtctacattgtctctgaatgttgtctacgtgggttccctgaagccaaattctgcactaccttcctgccattgtctacactggctcccatgggcaaatctacatacttccccctcattgtctacattggctttactgggttcctgcatgctgtgcctagtctgtggtaacctgggatgggcttgcaagagccagtttgatacatttctttccaattccacatccaatgaagtcttctcggtagcttgaaatcaaccttggggaatatttacaccaaggaaattggcaaaccctagaaatgggggcttcttttattccccagagagttggtttaccagcaaagagctgcccccaacagtgtctt

SEQ ID NO: 91918 - DNA, 1346 bp, Homo sapiens
gcctgtaatcccagccatttgggaggctgaggcggagggatggcttgagcccaggacgtggagtttgcagtaaaccaggatcaccccactgctctccatcctgggcaacagagcaagatcctgtctcaaaaacacacacacacacacacacacattatttgtagtggctcccttaggcactgccagcactgaacaataactcccacaaaattatccacagtggtttccctgaacagtgtctacactgacatcagcacacaacagcctggactgatttgccccagacagttttgactgctgtacctcctgccaacccgccccgtttctttagcattcctgtctatctgctaacttgtccacccgctctgggattctcctccttgctgatccagtccccccatttcccccagaccctcctgaagtgtccatctccggctatgatgacaactggtacctcggccgtactgatgccaccctgagctgtgacgtccgcagcaacccagagcccacgggctatgactggagcacgtgagtcacgtggtctcagaaccctgggtctgagggaggcggggctgggggcctggactcctggatctaagggaggaggggctgggggcctggactcctggatctgagggaggaggggctgggcctaaattcctaagtcctccaggatgaagggagcttgcattttggcaatttggggtctccgggagtacttaggtccctggagcttggctcctggtgggtgtatctttagggatgaggcctgtgctcccctctcgaccttggtatccctctcacctgaccccacacccctccaggacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgaggtgagtgggtcttgggggccgtgtgtggagacctgggtccgctcccctggagttctgcccttcaggacttggggctgcactgggggaggctgcgccgccgacctgggagggatgcagacctgcctggctgaggggagatgagggttggccttcccctcgtggcctcagactggggtctggatttggggtgtcggggtaggtgaaggcagcagagttggggggttgaggactttgctcggggttcctagaaagtagaggcctgggtagggtcctcacgaatagacccgaggaagctgccctgggctccagctcctgagaaagacgcacacctagagtcaggcatgcaaacttcaaagagacagaaaccaagagc

SEQ ID NO: 91919 - DNA, 1140 bp, Homo sapiens
ttcaggcccttgctcagttgtcaccttacagtaaggtagaggccctcccactaccttcggggaccccactttgcacctcctatcacttccgcactgtatatttttgtatcccccgtgacttactcccatctggcatgtgagctattgtactggtttgcttactgttgttctccctgcccaaccagaatcaaagttccatgaaggtagacactttgtatgttttgttctccactcatctcccatgcggggcacacatcctcgctccttcctcatgctcagcagtttgagttgaatgaaagaatgtcccctgcccatgggagaggacatagacaggcaggcgatgatgtggggtgggatggtcgcttggaataaggagctgtggcttcctcctggagaccccctcacgctgtccctctccttgcagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagagtaagtgatgggccctgagacggggatgggagaggggtcgaagaactgaggagtatggggtaggggtgagggtgggagaaaattctccataatggctgtgtgaaacagacagacctaaaggaactggggtctaaatggagtagggaggtatgggtttctctctgctataaagtatggcattgaatttaaaaattagctgggggccaggcacagtggcttacacctgccatcccagcacttttggaggctgaggtggggagatcgatcgtttgagcccaggaatttgagcccagtctgggtaacataggaagactacccccatctacaaaaaaaaaaaaaaaaaaaaaaaaatggccacgcagggtggctctgaccgctccgctctgcaaagactcctcggagcccaggatcctactacattttttttttttttttgtgacggagtctcactctgtcaccgaggctggaatacagtgatgcaatctcggctcactgcaagctctgcctcccaggttaaagcaattctcctgcctcagcctccggagtagctgggaatacaggc

SEQ ID NO: 91920 - DNA, 1043 bp, Homo sapiens
tgtcctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatccccc

SEQ ID NO: 91921 - DNA, 1051 bp, Homo sapiens
gctggcacacatgactgaaacagcatgggactcacccgtggggcaggggacagactgttcccagagagtaacaagccaggatgggcaaggctgacatgggggaacccaaaggtcggggagcctaactcagcttaggtggtcagagagcacttcgtggaggaggggacccccatccgaggctttctgaccctaggcttctcaccccggcccatctcacatacttgcacagtgcaccacctctgaccccttccgttctctctgcctcacaggcgttccctgtactggtgggtgacatggacaacagtggcagtctcaacgctcaggtcattcaccagctgggccccggtctcaggtccaagatggccatccaggtgagtggggcacggaggctgctgctcccctcggccaccgtgagcagggagccgccctcacaccccctcctctccacagacccagcagtcgaagtttgtgaactggcaggtggacggggagtatcggggctctgacttcacagcagccgtcaccctggggaacccagacgtcctcgtgggttcaggtaagaggcggagggcttggagggtggtcacaaaactgcagttctggctttgccagcaaatccaccccatttgtgaacctccttttctgccactggagaagtggctcagcaggagtgattttgaaacatcaggcaacatactacagtgggtgagacggtcacccactgaccatgagtgggtgagtcagagcagtcttttttttttttttttttgagatggagtcttgctttatcacccaggttggagtgccgtggcacgatcttggctcactgcaacctccatctcctgggttcatgcaattctcctgcctcagcctcccgagtagctgggattacaggcatgcgctaccacgcctggctaatttttgtatttttagtagagacagggtttcaccacattggtcaggctggtcttgaactcctgacctcaagggatccacccacctcagcctcccaaagtgctgggattacaggtgtgagccaccacgcccagcc

SEQ ID NO: 91922 - DNA, 1113 bp, Homo sapiens
ggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaaaggagcccttgagggaggcctgagagcaagcccaagcctccagccggggtgagcctagagggcttcctggaggtggagtctagcctggcactcagggtgggtggaaactgatcgtcattttgcccacaggaatcctcgtagcccactacctccagagcatcacgccttgcctggccctgggtggagagctggtctaccaccggcggcctggagaggagggcactgtcatgtctctagctgggaaatacacatgtgagcctggcgcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccacttgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaaca

SEQ ID NO: 91923 - DNA, 1199 bp, Homo sapiens
ttgggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtggcctggggtc

SEQ ID NO: 91924 - DNA, 2830 bp, Homo sapiens
tgagtagaaccaaccccaggttaccaaccccacctcagccaccccttgccagccaaagcaaacaggcccggcccggcactgggggttccttctcgaaccaggagttcagcctcccctgacccgcagaatcttctgatcccacccgctccaggagccaggaatgagtcccagtctctcccagttctcactgtgtggttttgccattcgtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgccctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctcccatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctaggattacaggcgcccgccaccacgcctggctaacttttgtatttttagtagagatggggtttcaccatgttggccaggctggtctcaaactcctgaccttaagtgattcgcccactgtggcctcccaaagtgctgggattacaggcgtgagctaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgtattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtcgggggcacggggatgagctcaggggcctctagaaagagctgggaccctgggaacccctggcctccaggtagtctcaggagagctactcggggtcgggcttggggagaggaggagcgggggtgaggcaagcagcaggggactggacctgggaagggctgggcagcagagacgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggagcttagaatgtgaagggagaatgaggaatgcgagactgggactgagatggaaccggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcaggcagaccctgggccccctcttctgaggcttctgtgctgcttcctggctctgaacagcgatttgacgctctctgggcctcggtttcccccatccttgagataggagttagaagttgttttgttgttgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctggga

SEQ ID NO: 91925 - DNA, 2697 bp, Homo sapiens
gtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccatggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctatacctccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagac

SEQ ID NO: 91926 - DNA, 1047 bp, Homo sapiens
gggcagatcacttgaggtcaggagttcgaaaccagcctggccaacatggtgaaacttcgtctctactaaaaatacaaaaaaattagccaggtgtggaggcacgcgcctgtaggcccagctactcgggaggctgaggcaggagaatcacttgaacccgggaggcggaggttgcagtgagccgagatcataccactgcactccagcctggctgacacagcaagactccgtctcaaaacaaaacaaaacaaaaatagctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaaaaaaaaaaaaaaaacaaattttgaacccctgcccatcttcctggcaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacttagggaggccgaggtgggctgattgcctgaggtcaggagttcgagaccagtctgaccaacatggtgaaaccttgtctctactaaaaatacaaaaaaattaggcaggcatggtggcgtgcacctgtaatcccagctagtcgggaggctgaggcaggggaattgcttgaaccaggaaggtgggagttacagtgagccaacattgtgccagcct

SEQ ID NO: 91927 - DNA, 1048 bp, Homo sapiens
gtttgttgagttagtgctggaatgaaggctcagttcctgtcttcaagggtttcccagtcttgctgaaaggaggtcgtttcccctctgggtttctgttgattattgggttgatggtggcttgagagaccagggcccaggttgttctcattgccctgagcttccagatggcactctgatcttctcttgtaccaactctgcttaaaaacaatcaagagttacccctttgcctttaggacaaagtacaaattctttaataaatcacagtcttgcacgatccgacacttttcttcagactagactaggatttctcgagctcggcactatcaacattttgaattggataatgctttgtttggggggctgccctgtgcattttaggatgtttagcagcatccgtggcctctacgcactagatgtcagtaggatccacgcccctccccagttgtgacaaccatatatgtctccagacattgccaaatgttccaagagcaggggggcaaagccatccctgcgtgagaacaactgcgctaaaggggatccgctgctctgaacctattttatttctaaacctcttttattgcctctcagtctctttcctcatagtctatgcacaggtctctcccctctttagctagttgatgtgtattagtcctacagatttcagatgtcccttcctgcagaaagccctctttgactgtctgggctccgctgtcccagccctgccctactgggtttcactgtctggggactgggaaccccaggagggcagagccaggactgccttgatcaccactgcttccttagcaccactcagctcagcgccaggcacagaggaggtgctcagtgtttgtggaatgagcggatcttgaaacagaggctgggctgaggtggaattccctgatgccgtggtggatccaggtaatcagtgaagacatgccgcaaaacctagcttcctcctgctcttgcctagccctggtggtctcagctacttcttggaccctttagcagatgttgctggggattgtgtgtgtgcgtggacgtgcagatc

SEQ ID NO: 91928 - DNA, 1050 bp, Homo sapiens
taggattccagattctttcttttaaaaattttatgtttattattttttctttatttcttttttcttttaattcatccatctgcacactgaaggggttccagattcttagtctcctctcgggggatcccagggggctggatggcaggtttcccagtctgagtcaagagtcagcccctgcagccctgtggtcaccaggagctcctgcaggatttagagtcaagggtctgcatgcagaccagggcagtgccagctacccccacacactggcaaacggtggcatctgggctccctccccagatgtggtctttagggacatcttatctccttgccagccctgtgactaccttctcagggcctccctgacttggtcactagccccaggtcaggcgccagcatgtgctaagtcagaaggaagtcaggcgggtctatggcggagagccaaggcttggggactcaccaccttgctgcttctctcctcaggatcttcatcatctgggccatcagcagttggttccgccgagggccggcccctcaggaccaggcgggccccggaggagctccacgcgtcgccagccgcaacctgttccccaaagacactttaatggtaactgccgggtggtagggcagacttgggaggtgatggggtgtggaggggtggaatgtggaggagtgatgtcagcagtcgggacagaccaggtccttgctcactggcaggtctaggaaaacaggtccagggttgaggaactctgggcccatccccaacacgtgagacctctgtcacctgggtccatccccagcacataaaacctgtgtcacccaaaagaaaaagcaaattcatttggttaaaataggttaaatcagggtctttggatgttatatttcaaaagtatgttcagcctttcagggttgcagagggagatgtgcaagggagagagtgtgagaggtggggagggcagggagccagcagaggctgacaggaggtgggcccggaaggagaggagacctgcacttccacagtgggcttgggcacaggcagggcagggcttcagg

SEQ ID NO: 91929 - DNA, 1036 bp, Homo sapiens
atcacaggcatgagccaccgtgcccggtggctcacagtgcttttgtagctctggactgcttcgtccataagcctgcagagctctgaccaggaaggcccagcagccatgagggcaggagatcattcagggagctcctgccccttcctacccctaaattctaattggcaggctggccagtctccaagtgttctttgttcgttgacttcacaggctcagaccaggacaaacatggtggtatgagaaaagagaaaatatgtcctctctgctgctcttcctctctcctctcccctgtcctccataattactgttcccctgagtgtgctgaccgctgccatagctctttagccagcctgcagaggctctgaagagcaggcctgagctctgttcccttcctgtcccaacagaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacaggtgggggcagctctcggtttctggccccatggctgcttgactggcactgaaggaccttttcctccagtccgctccttgctgagagcatgtggagtttgggctccaggcttggcccttccctgggctcacatggtctgtgaccacaagccagtccctgagatctctgggcttcactttcccctacctgaaaaaggtagataggggtggaattggcctgggaccctcccagctacctctaaggttgtgcagtcctccactttaaactggtgaaagattagtaattgtccttggggatgtttgcctatcaccagtttatcaggcagccccgtttcaaaataatattagttaatgttgattgagctaagtgcagggtactaagctaggctgactcatggaaatttcccggcaaccctgtgaagcaggaactgttattattctcatttaacatgtgaggaaactgagagagaaggaaa

SEQ ID NO: 91930 - DNA, 1040 bp, Homo sapiens
gatctcagcttcctgtaacctccacctccctagttcaagcgattctcctgcctcagccttccgagtagctgggattacaggcacccgccaccacatccggctgatttttgtatttttattagagacggggggtttcaccatgctggccaggctggtctctaactcctgacctcaggggatctgcccgccccagcctcccaaagtgctgggattacagtgccctactgagctggggtttctgcctggggcatttggtgatggtggcgtccccatgatcatgaggaactgggattcgttgagatttggggaggcagttctggcattccaggtcacattgatctcagcaggtgagtgcaaggtggatgccaggagaccgtgagccgttgctggtgggcaggggtccgggctctggaggctgcaggtgccagcaggtctcacgtcccctcctttcccacctcccaaccacagtgatcaacaaatacaagcgcagacgatttcagaaaaccaagaacctgctgacaggagagacagaagcggacccagaaatgatcaaggtaaatgggcagggttgtcagggcctatagggaccaagccaggccattcacagctcatcccagaccactggggctgtcatctgtcaccaccactgaaccaccatgccggctcggtcatgccacctcccctccctgagcactgggctcctcctctgggaaatggggtcaggaggcagctgtctctcagggagtgaggaggatcccagacaaggttacctgagcctcttgccagcctgggaggggtctacatcacagtcccattgtcacatgaggacacttgctcagtctcagccggaagtggcaggccagggactctcacccacacagccaggccccagagcccaagctcagcctggctccaagcacacacacgagaatatggctttagtaggaactgcaggattcatagttgctgtcactcccagtgggctggggagccgggcagttaatctgtggttaacctgcagtgggcactaagagacttcc

SEQ ID NO: 91931 - DNA, 1835 bp, Homo sapiens
ttcaagatcagcccaggcagcatagtgagaccccatctcttccaaaaaagagaaaaaagaaagaaagaaaagaagctgtccatggtggctcacgcctctaatcccagcactttgggaggccgaggtgggaggatcgtgcttgagcccagaattcgagaccagcttgggcagcatagtgagaccccatctcagaaaaaaaagaaagcaaagattaagattttctcgggaaccctggggaggaagtgtacagagagtgatagtccccgagcacttccacctgcctctgaggtccttccccccatgttgcctcagagggctgaggactatgggcctgtggaggtgatctcccattggcaccccaacatcaccatcaacatcgtggacgaccacacgccgtgggtgaagggcagtgtgccccctcccctggatcaatgtaagctccccagccctgccagctgcctgcagagcctttgagagggtgctcggggtccatctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcaccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtgagtgcggccggtgtgggcgggacttcccggtgccttcctgggcgcaagaggccaagaggaagtgtgccaggcctgggctgtgggacctcccgcctggtgctcctctgcccacagtttcacaacctcccaggtcccttctccacagtgaaaggaagtgggcacccagccctccagccctagatgactgggggtcctctccccaggctgttctgttggaccctttgggtccagacctgtcccttcctccttctgtcccagaccttgtgtccctggccctggctccaactctgtgtctctgccatctcactgggtcctgaaatgtcagcctgtgtctgtggcgtgaggctcggctttgcctcctgggctgtcgtcactgttgggtctctgctcctggctcccagtgtcccttcacccactccccgcagcactcccttggcctctgcctcttcccctagtgccatctccccgtctcttctgtctttgtgagtcaccctcctctctctccccatctgcccatctctgacccagtctcctcctggctggcccacctt

SEQ ID NO: 91932 - DNA, 1075 bp, Homo sapiens
tcccggtgtcagggcaggggcctggaggaggtggtcttgaagtgcatgccacagatcttccttcccagggagggcgagctggcaccatggtgtggcacagaccccgcgtcccttcagattctgccatgccaggctgtttggcctcagggaagcagcttccctgaccagtccttagcacctggcacgtggtgagccctgtccatggcaccagtcaccgtcaccatcagtcaagggactgcaccttggggtgctgggtgctgacgtcctatgggagggctccaggggtgccgcctgtctggtgctctgggggtcacccaatgaatatgagagccttcctgggagagaggggtctcgttcagcacccctcctgaggacccagccccaccccagggtgtgaggatgcaggccaagggggcctgagggagctgcagtagggtctcagcacctcctcagcctcctggttcccccctaccccctgcgcacagatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccgggtaaggctggggcgccatgctgtctcgggagctgcaggggttgggagggggtagtgtggcccagctggaccctggagctggcccccgggggattcccagcaagtgcctcactcccaggactgaggggattttctcaccaggggattttttgggtcacacatggggcaggggaactgggaacggtggggaagggcaggggctggttctggcttgtggggtgggagccagcgtagcaactgaccatggcacccacctcatccacagctggaccgagagcacagggtggcaggaatcttcccccgcctatccttcaaggacaagtccacgtatatcgagtcctcgaccaaagtgtatgatgatgtgagtgtcctgcacagtgggcccctgggggtggtctcc

SEQ ID NO: 91933 - DNA, 1632 bp, Homo sapiens
cgtgcctgtagtcccagctacctgggaggctgaggtgggaggatcccttgagtccaggaggttgaagctgcagtgagccatgattacgccactgcactccagcctgggtgacagagtgagaccctgtctcaaaaaacaaaagaccgggtgaatcacagccaatagtgagtactgtgaagggcagagtggtgggaggatgcacattaataggggtccgggggcccctctgaggacaggacatttaaacagaggcctcagatatccagggagagagctgtgcggatgtgacagaaggccccaccagtgcagaggccgctggtagagtgtgcccaggtataggaagtggtagagtgtgcccaggtgtaggaagtggtgagggggctggtatggccagtgcagagtgcacaggggagaggtgggagaggccatccctctgctcatgggtgctctcactgcaggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacggtgaggcccggtgggcaggtgggagctcccaccggaacagggccctgaggcagtctttagggcccaggcctgagggggtgccacggccccagatggggtgctcagtctgagggggctcggccccgcccttgcatcacgccctctccacccaggcccacctggctgtggacgggccagcccgacctcacactgcctcccacccctctccagatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcagcactgcccctcctcctcgtgccttccttcctctgttgccttggacaacagcttccagcagggat

SEQ ID NO: 91934 - DNA, 1053 bp, Homo sapiens
cagatgaagaagccaaggcacaaaaaggtgaagtaataggcttatggccccacaactagcaagttgcagagccaggatttgaacagaggcagtgaacccagagctccagccacagccgcccaggactcagtctccccctacagcccgggagcctctggagggtccaaagtctaactctgtctttgggtccccaggttcatccagcacagatgcctaagaaggattttcccagttcaagtgacttgaggttggccctgccactgacctagagcgtgtcccttcctctctgccagcctcagtatccccatctgccaaattggggggaccttggcaccctactggcttcacagatcccatgagataaggggtgcaggaaaactacctttcaaggggcaaaggtctggctgccaggagccactccctgagaacagaggaggacagatctagcagcggaacaggttcgcgtctataaatccccagccagagaccagcgcaggcagccctgggtgggacacctggctgcagctgccttccgttgctgtgtgattctaaggctcactggcggcctctgggcttccccttgtcctgtctatggaatgacgggaggtcggtttcgattcctccacgattctgtgaagggctgagctttcctggggaggtgaaaaggggcttccctgaggacccagcattactgtacctcctcacttaggaagcaggggtgaatctgggattttgggtggtcactgtgggaggacagggctggggtacagagcaagaggctgcctgggttcagatcagcctctttgcatctttttgttgttgttgttgtttgtttttgagacagtctcgctctgttgtccaggctggagtgcagtgacgcaatctcagctcactgcaacctctgcctcctgagttcaagcgattctcctgcctcagcctcccgagtagctgggattacaggtgcccaccacgatacccagctaatttttgtatttttagtagagacggggtttcgccatgttggccaggctggtctcgaactcctgacctcaa

SEQ ID NO: 91935 - DNA, 1013 bp, Homo sapiens
cccctgtctcctgggttcaagtgattcttctgcctcagcctcctgagtaactgggaccacacccagctaatttttgtatttttagtagagtcagggtttcaccatgttggccaggctggtctcaaactcctgacctcaagtgatccacctgcctcggcctcccaaagagctgggattacaggcgtgagccaccatgcccggcaaaagatcttcgttttggacagacactcaccgggcttcagcttgagggctggcgattgttcgttaaccccttctgtccgagtgacttctttctccacctggactatgggttccatgaggatcagatgccctgccttttcaattccctacgtctccagggccccggggatggcacccactgggtgcccagtaaggctttggtgactgaattctcgggattttttttaatacacttcttcctcttgctccttcccagaatccacaaacacatcagagctgcggatttgccgaattaacaaggaaagcgggccgtgcaccggtggcgaggagctctacttgctctgcgacaaggtgcagaaaggtgaggggcctggggcagcaagcttgggcagagcggggtctggcaacttggaggggtagccagggagcccgggaagatgaaaggatgagaaagagctggttaaccagggcaccagagtgcaagggtccagaacactgtctttgcagtcagacacagctgatgggttcattcactccctgagtcgccttctcacccgtctgcgtaggacgacagagactcgtctgtggtgacccatgctgcaagctaggcggtgccatcacagagctcacgacatgtccagaggactctgatgttaagggtggaattgcataaatgaacgctttacggtggttctgataagcgctatgggtaaagcaaataggacaggagaagcaactccacttcattcatctctgttcaaatggcccttcctcaaacaggcttttaaaaaaaaaagacagctggtcaccgt

SEQ ID NO: 91936 - DNA, 1032 bp, Homo sapiens
catccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcgtgagtaactggccttttgtctggggtgagggaccctgggttggggggcacagctggtcatcctggtaaaatctgggcttggaagtatgtcaagacaagaggctcatttcctcaggagtatattcattaatcttttcttgaggataatcattggtgggatcccaagggcttctgtttgttgtagcatactgtgtcgtttggtgtggcctcccagtgccgatccggtgttagcaagaaaaagggaagtctctgtaaccctcagagcagtcctgacgttagactggccacctccagaatgtctgtttcgcttattgctgtgttccccattcccagaagagctcagccactcttgagatttggcttggcacacaataggagtgagtattaagttggcctggcacagtggctcacgcctgtaatcccaagtggatcacctgaggtcacgagttcgagac

SEQ ID NO: 91937 - DNA, 1679 bp, Homo sapiens
ttgtttatttctaagatagatgcttttttgattttctaaaatcagaggctgccaaaattctagtgatcactgaggccttagaatcagggacatgtgttataattgatactgtttttgccatcattccaggccacatggcttcctggtggtagagccagggttccccttagtttcgcctcactctgcatttattcattcacttccacaaacagtcattgaacacctgcggtgtggcaatggtaggggagagggcagcagctccataatcaatgtcagtgatgccaattgcaaaccaaggtgatgtgacagacagtgtgccattctctgagaaaaataggacagaagtcctggatagaagctccctgggaggcacggataggccacaggattccaggccgagagcagcctgtgcaaagccctgtgtcagccaggactgtgagcacactggaggggcagagagaaggcccgtgtggctggagcagggagagcgagggcgcttgtgcaagacagggtcagcagggcctctcttgggctttggagacaacaagtagaaattggggtatctgctagaacaaggaagggccgtgctacatccccttctggcctgccagcctgcccacctcttgttccagatagaaaagctgaggccagccgggcacggtggctcatgcatataatctcagcactttgggaggttgaggcggtggatcacctgaggtcgggagttcgagaccagcctgaccaatatggagaaaccctgtctgtactaaaagtacaaaattagccaggcacggtggcgcctgcctgtaatcccagctactggggaggctgaggcaggagaatcgcttgaacctgggaggcggaggttgcggtgagccaagatcgcgccattgcactccagcctgtgcaacaagagtgaaactctgtcttaaaaaaataagaaaagaaaaactgaggcctagggagggaaggaaggaaggggacttacaacccactgtcccacagcgagtcagggacacgtgtctcactgcagggaagatcaggaaggctctggtacattgttgagtcccccaggctgggtgttgggggtgcaggagagcccaggtcatcccagcccacacctaacttaaaatgagccacagagaggcatgcagtggagtgacctgtgcagtcagaatggcgtgtggcactcaggagcaggttatggttctgaagggtccagccagaggcctccagaaacagtgagaatggtggtagagtgcccaagtaccaggccaggcactcactctgcccgtggtcccattttacggaaaaggaaactgaggcacagatgtgttaagtcccttgaccaaggtcgtgtgtccaaggctctgctgcagttgcttgtgtcccaccagacatagtttgattatctggaagtggtgactgccccccaaggtgcactggggttgcacctgtcttcctgccccaccgcacccttgtgttcccccactgaattcctagtgtccccaacccactctgacctggggtctcttgtttgctgcagtctcagaggagcagtgcctgtaccagatctacattgatgagttgtacggaggcctccagagacccagcgaagatgagaagaagaagtgagtcggggtctggggtgcagggggttgaggaggcaggagggctgg

SEQ ID NO: 91938 - DNA, 1044 bp, Homo sapiens
gtcttacaggttctgtggggtctgagagggacatggttgcaccctggggcatctgaggcccatgccttggctacctggtctgagggcagtgctgaggctggggtcagaggtggcagctgccctttccccctcccaaccatgtcctctggccctgcccccacccaggaccgaacctgccgctggtaaagagacaggagctgccaaagtcagtaagaatttggaactcgcccgtctaattcccgtcagcagcagtgcccaagagctgggcccggtgggcctgcaggggggcccgggtgggctgggagatccagccccagggacagggaggggaggggaagggtctgcccctgtgagaaccatgtccctctcccctcctcactgtacactggggctccacctgtcactgaacctctgggagcctcagggctgtccacagcctgcccctcctccccacgtcgttctcccccccccaccccccccccgcacaaagccccaggcttttggctgaggtgggttgtgggagctctgggacacccaccccctctcccgcctcttctcccccctccccagcccaagctgacgcctcaggagaagctgaaactgaggatgcagaaggcgctgaacaggcagtgtatgttctgccctgtccctccagggtttcacagctcttctttcccttggcagtgggagcaaggagactcagcaccactttgggaggcctggcccttccctagagaggccacgcaggcacggaggtgctctggggaggaatgggtttgcatcagctccgctgccgctatgctggggcctctgcagtcaggttgacctgtctgagctcagcttcctcattttagagagtggggctcttagcgggcacggtggctcacacctgtaatcccagcactttgggaggccgaggtgggcggatcacgaggtcaggagatcgagaccattaacacggtgaaaccccgtctctctaaaactacaaaaaattagccaggcatgttggtgggcgcctgtagtcccagctactcaggaggctga

SEQ ID NO: 91939 - DNA, 1054 bp, Homo sapiens
gtgggaactcggtgtgattaaatttggtcactaagccaaacgcacgggacactgcctagattgagttaggccgccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccggtgagcaccccgggccctgggcccagcctcccttacctttgaccctcgggtgggacccttccctttgggcatgggcccctcgccctgccttatctccttcgccccgtcctgcccctcaggcccccttctgaccttcggtttcccctctccttcagcaccctcagcccccatcctggccccaccccacgctcaccacccgcttcctccctgcagaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcaggtgagtaaagccgggtgcagtccccctctcaagttcgagggctgggcttcctgctggaaaggggctgggctggacggcagggcactgagcactacttcccctttctc

SEQ ID NO: 91940 - DNA, 1024 bp, Homo sapiens
ccaggtttcctgtagaggagcgggggttcccactggaagcaaggggttaggagtgggtatgtgtagggggatggggatgcaaagaccgagctctgcccttaacccagcagggaggaagtcttcccctctctgaacctcagtttcttcctgcctaaaatgggcatcccagacgcccccaactcgcaggcaggaagatcggtcccaagtgccccgcaaagccgcgggccaggtggcgacccgggctgtgctggcttccaagcctgcgagccagcccgcgaccacgtggggcagtggcggcggcgcgggcggaacccaggctccgcggcttgcggcctgcccgggcctctgcagcgggggcgccggcggaagtggggacaccagtagccgcggacctcggtgagtacaaggtggtggggggtcgccagcaggttccctctccccggccccagctctggacgctcaccccagtgcaacgccctgagtgacggaaagaggtaggaccgcgcctgcagcgccggctggagggacgttctggtccccagacgctcctatcagggactgtttgatcccgatcgccggcagcgggaatgccccacgcgggtggggtgaggagaagggagaaggagaaaaacttcccctccggaaaataataaatggccacgataacagaagcatcggtggcagtcatcccgctttacctggagcggaatcgctcgctcagtctgagcctggaggtgggaagaaggtccagtccgaacgcccagggcggtgtggggagtggacgcctgggggccgggaggacctacttagtataagaaaaggagagcaatgggtggtcagggcggaattgaaaggaaactgaccggccccaggggagaaggggaggggagagattctgtgcttggggttctgaccctctcgggtggccccatttagctaatttgcatcaagattcagcagccgatgatgtctgtatgtgtgtgtgtgtctgtggacacgtcaacaccttggttaattaattagg

SEQ ID NO: 91941 - DNA, 1012 bp, Homo sapiens
gctcactgcagcctccatctcctgggctcaactaatccttctccctcagcctcctgagtagcccagctaatgtaaaatatatatatatatttttagaaatggggtctcgctatattgcccaggctggtctcaaactcccagcttcaaagtgatcctcctgccttggcctcccaaagggctgggattacaggcatgagccaccatgcctggccaggttcatcttttggcaaatatttattgcctataagttgagataaaaacattataaaagcagacaaaggtccttgccttcacggggctcatgtttttgtgcatgtgacacttttgtttctgatccaagccattgggggacgatggcacagattttaggagggtggatcagtctggggcaggtgcagtggagctgcctggtagaccagcctctgcttccactcctccctcctccattagccccatgcttaccatgtaatgacttcctgctctttttcttcactcaacagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttgga

SEQ ID NO: 91942 - DNA, 2014 bp, Homo sapiens
ggtgccaggacgaggactctttctcagggacctacagacaggctttagcacccattctgactcccggaagagcacgcgaagctggcccccagctggcactcggtaaccagccttcagtgcgtcagcgggagtgcgtgtgcacttgtttctgggagcgagtactggggctctgcgaaccttcacaggcatccgactccaagaggattaagaaccgtggggccaaatgccctgtgttggacggactgcagctggagcagtcactgagcacggaggccagaaacctgtttttacaaaagctccccaggtggttctgacaacctcgcttggctgtctgtgtgctttgctccgccatccatcactcagtcccaagcctgccttcagacctcagttcaggggtggctggcattgacctcaaagccttttttggagcaaattaacaggtgagcattgaaatactgcagaaattcaagctgagccggccacctgctgcagtagggcatgggggcaggtgggttaaattcttgccttctggctgaccttagtcatcaccagtcattgccttccatgtgcctgtaccaggcactggtctcagtgccttttgtgtattatcgcatttagatatcacagccaccccaggaggtaggtgccgtttgccccaatttgtagatgaggaaatggagcccatagaggtaaagtaattttcctgaggtcacacagtgggtaagtggtggagctgggattcaaatccaggcagccagcctggcgccgaagcctgcgcagtaataacccctgtgcggcggctgagtgcttggacgcattcggtgcaacgtgccatacggtctcttcatctataacccagaatcgtttataaaatagaggcaacagtgctggctttgcggtgttgtggcagggaggagaaacagaaacaggtggggtaagggcccagccttggtgggcacgcaggagggggtcactgtggttcgtggacagcttgagtccctggagatttgtgctgctcctctgtcctcagcattgcctgctgttctgacccttggcctctgggacgtgttcttcctgtgctactcagtgtctggtatgtgataggcgctcaatatattcttgctgcgtgagtgacttggtgaccccgtaaccagtcatgcattcagcatggtgtggccgtgccacgtgttacgagtcagggcagaagacaggcccagtccatgcttctgtgggggtcacagtcaagtgagggagacacacagtaaagaattctcagcaaaccaggcttctgaggactcagattagggagggtccacagggtgtgcaggagggcagggcagaggcagcttcctagaaaggacgtcaccaaggaaatccagcagtaagccaggtgaggagcagtgggaggagtgcaccaggggtggaaggcagagagaaccagcctggtatgtctgaagaacagaaaaaagccagacttagttgaggtagaggcaggctggtcagaggtgaggctggaggaggcaggagagactgctgtgtggggccttatgggctgtgctagcagggagccccagagggcttaagaaggggcctgggctgggcatggggggctcacgcctgtcatcccagcacttcaggagctccaggcgggaagatcacttaagcccaggagtttaagaccagccttggcaacatgacgagaccttgtctctacaaaaaatacaaaaatcagccgggcatggtggcatgtgcctatagtcccagctactcaggaggctgaggtggaaggatcacttgagtccaggaggtcgaggctttagtgagctgtgatcacaccactgccctccagcctatgtgacagagtgagaccctgtctcaaaagaaaaaggaggggcatggtgggtgtttttaacagaatcctgtgtggaggtgacatgaatagggtgagactgagacagggaggccagggaggggccgtgagccaggagcccggaggctgtaggcttggcgtagc

SEQ ID NO: 91943 - DNA, 1035 bp, Homo sapiens
aggtgcccagccctgggtaaatatttgtctcagggcagacaggagtgggtgtggtcagcgtttcagagcccgggggcaggtggaggcagcaggtggggtggtgactgggggcccctggctggagctggtggctctgcttgctctttgctcatccagcatccactctcccgggggctgctgaggcgttggcctctgcaataacaggggcttccgtttgccacgcgccagccccacactagacgctttacacaagagagttcagtggctgcttttagaagtctttgtgtgtcagtctcagtctcattggctccattttgcagatgaggagactcagccatgaagggtcgagagccattgcctgtgtcaactggggtctgttgagttatcagggccagaatccacctggggccacaggaggtgaatgagggtgttcattggatggaggccaggctttgcctgttcccaggggtcctgaaagctggcaggaaccaggtctgccacctgctctctggaacacatgcactccttgttcctctttctctcttcagaacgtcttccactaggctggccatgggccacacaagcccagccctcctggtgtctggaacaggaccacccagtccagccccctgacccgggcagctcatgcaggcttagctaggaccccacatcctccctgtcaaatgggcgatagagggccagcccacgcttgttggggtggagggcagtttttagaggaggctctgcagacaccccaaataggcacccccaaatacaaggtctgactgcaaaggccatgccctcactaggttgctgttacatgtgtttagaaggtgcattcacaggctgggcatagtggctcacacctataattccagcactttgggaggccgaggcaggaggatcacttgaggccaggagttcaagaccaccctgggcaacaagtgagacccccccccccatctccacaaaatataaaaaattaaattttcggaaggtgcattcacatcacaaggcagaaagtcactagtgtcc

SEQ ID NO: 91944 - DNA, 1081 bp, Homo sapiens
gggctgggcctggtggggggtgggaggttgggggcagagggcccttccagccatgcaaaggtgcactgtcttagacatgcgcacggctgctgtctccccccaggtgagaagcttgactacaagacctgtgaggccctggaagaggtcttcaagaggctgcagttcaaggtcgtggacctggagcagacaaacctggatgaagatgtgagcggccctgccaccgcccacttggctccctgagctcccgggccccttcgaggtttgggtggggagaggacactgcaggaggagggggtcccctagacaaaggctgaggggtggcgcaagggcggggcctcttgcagggcaagagggagacatccaatatgaccagagtggatgtggagggcgcgttggggcacctatggcccaccctcataagcaaggagagccttagggagctgggctgaggggcaggcgtgtggcccccaggagccctttcaggaaccacgctggagggtccagctcctacagggtgggcttgggaagcattctgagagcagcctcccatcaaggcccaagggccctcacctcctcagccttgggagtccccaggcaccccaggtgtcgggatccaggggcaggggacctggagaactgaggcccaggctcaggaacaccaaggcctgtcctggtcactcagcacgtcagtcaaggactttggagggcaagtgacagaaaacaaaactgactacagcagagaaggaaagggtttgtccccgtggctcacggggccctgtctgtgcttgtcctcctctcccgtgtggctctctccagaccctggacccatcgtctctcggtggggcccggtgtcagggcccacgcctctcctccagggcagcccagagctgaggctgagcccccgaatctctatgcgcagggtgcctcggccctcttcgacatgatcgagtactacgagtcggccacccacctcaacatctccttcaacaagcacatcggcacccggggctggcaggcggccgcccacatgatgcgcaaggtgggcgcctctcggcttccaggaagaggcagctcaggctcc

SEQ ID NO: 91945 - DNA, 1110 bp, Homo sapiens
accccaggctgagccttccctccccagccacagttacccccattgtaaaacaaggcgacatagccagacgacagctgtggcttcgttgctcattgagacatgggggcacaggtcctggggccagggagtgctggggcggtcctggggccagggagtgctggggcaggcctgagccagtgcctcacccctgtcctcttgcccctgcagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcggtgagccccaagcccgggagggtgagcaggatgtgcagcctgttggggggcaggggcctgcccagtcaccgtgccccctccccgtccccagccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtgggtgcagtggcccaccccacccacacccgtcacccagcacccactctgcccggccctgcgctaggtggtgctggggacacagacatggccaagaccaccccaacgctgtcctgctggggctcccaggaggaagacagacccgccctagacagtgacaacctagagtgggcaggactgggctggtggagcccagaggcggggtccgatcagtctgggggccagggagggcttccaggaggaggagacagctcagctgacagccgcaggatgaggcgaagtgaataattacaatctgaaaagaaagcagtgttgctgccataacagggtcagctagaggctgctttcagatgggagaggagggaagaccaccgtggggcggggcctctgggcttccatccggaggctgggagcagaaccagccttgtgagaagcctgggaaagggtccagaccgcgggagcagtgagtgcagtgggaggagctctggtgtttgatgctgggggt

SEQ ID NO: 91946 - DNA, 1048 bp, Homo sapiens
cggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaaggtgagctccgcggggatggcaggggcagggcggggcggggggccgatgggacctaacctgtcttccactctgctctgtctcctgtaccccaacatttcctcttcctcctcctcctcctcctcgtttcctcctcctcctcctcctttcctcctcccctgtcacccctcacctccctcctcacactgcagggttaccctcgatccctctaaacggcagaactctaaccgctgtgtttcgggcgcctctctgccccagggatccaagatcagtaagtcccgtccatgccctgttctcgctggctctgcctccctgcctgcatgtctgacctgtgtgtgcgggcattgggagggggctctgtggatgtgagggtctgtgcgtggggtctggttgttcatttactcacagaagcacagcctatggagccagactcgggggttcaaatggcagctctgccaagtgaccttgagcaagtcactcaaggtctctgggcctggttttcctcttctgtaaaatgggtatagtaataacaatacctgtctcctagggttattgtgaggactaaatgaagtgacgtatggactgagcgtagaacattgccttggaaagtgctttacatgtgtattagttattaattgctattattcattgagcccctactgtgtgcctggcactgtcctaggccctgtagtagagggtgagcaaaatgtacaaaactcctgccctggcagacccaacattctactaagggatctagacaaaaaacaaagaaataagtaaaatatacttactatatagactgctaggtagtgcgaagtaactaagaagaaaaatagagtaggagccaaatttggtggcttatgcttgtaatcacagcactttgggaggctgaggcgagggga

SEQ ID NO: 91947 - DNA, 1785 bp, Homo sapiens
gggacccattgggtgcaagtggaaggatcctggtgccccctctgtcaccatggagcacctagggaggtcaggggaggggacagcaagaatgggaaaggaagggaaggctcctgctgtgagaacggcaaagagggagtgggacagggatctgggggggccactgagccaggcagagaggagtcagagagcacggacaccagggaccccaacagagcaggcaggagacctggggtggctagaagcttggcagaggtctgggggtacagggcccagtgttagagaattgcgaaatatggaggggcccacaaaaggccctcaaagggtgtgccacccatgcttggttcagccaggttccctgggcctgtcaggattggcccagcccctgtggctgcagctgccccaacccttggctaaccccctccattcctggggcgccccccacagggaccagaacaagtacaaagaagccacagaccttctccatgatgccctgcagatccgggagcagacgctgggccctgagcaccccgcggtgagtggggccccagggagacgaagtggggtcaaagtggggccacacctgcccatccctgacctgtgcctcccccaaccccgcaggtggccgccacgctcaacaacttggctgtcctctatgggaagcgtgggcgttaccgggaggcagagcccctgtgccagcgcgctttggagatccgagagaaggtcccatccccctcaccccaccccgaggaaccccttgtcccatgtagccctccccagggatgctgagcacgtacatcgtgaccctgaccctcgggccccttgcgtttggtattgggagaccccagttggagcctagatcacccaacccatcacccttgaccttctgagatcccagtttggtcttgaccctgactgacctctcgccttacctcacacatcaccctccaactgggtccccccatagcctttccaacccctcatggccaccagcacaagcccaaccctgacctacccatctcaccctgtgccccacgtttctggaccaccatgacctctgaccttggtaatcccgttagatggtataacttgtgtccccagcccccaacctctcaggtcactctctgctttgaccctgtaatccccaactcatgaccaccatacagcagtgatgtcacgtgtcccaccaatcctgtatgatccctctgacttgtgacccctggcccccaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggtgaggcccctggggctcagagtgggccaagagtggagggtcctgccctggggaggcacccattggttggatacagggtgagcaacgtgagggtgggggggggccccccaggccgggcccttggagcaagtgtcagacacaggagctggctcagcacagaacacggaatcaggaaacgcgtaagtccacggcagccagaggacagccagtgaagcggaagctggcaggcacaggtggcagcagcagacatttattgagctcactgtggccggctcccctcttagcccggtccccacatcgctagttcttatagcgtccctatgaggtgggagctgtcgctccactttgcgtgtgggaagactgaggcaccgaggccatgccacc

SEQ ID NO: 91948 - DNA, 1025 bp, Homo sapiens
ctggggggcccccccccaccctcacgttgctcaccctgtatccaaccaatgggtgcctccccagggcaggaccctccactcttggcccactctgagccccaggggcctcaccaggttgttcttggtcttggccacgttggggtcatggggcccgcccagtgcctcatagatgctcagggcccgggcatagtgccgctccacgtcctcaaacttgccctggttctggcacagcagggccaggttgttgagctgcttggccacatctgggtggtcagcacccaggacctgggggccaggggtcacaagtcagagggatcatacaggattggtgggacacgtgacatcactgctgtatggtggtcatgagttggggattacagggtcaaagcagagagtgacctgagaggttgggggctggggacacaagttataccatctaacgggattaccaaggtcagaggtcatggtggtccagaaacgtggggcacagggtgagatgggtaggtcagggttgggcttgtgctggtggccatgaggggttggaaaggctatggggggacccagttggagggtgatgtgtgaggtaaggcgagaggtcagtcagggtcaagaccaaactgggatctcagaaggtcaagggtgatgggttgggtgatctaggctccaactggggtctcccaataccaaacgcaaggggcccgagggtcagggtcacgatgtacgtgctcagcatccctggggagggctacatgggacaaggggttcctcggggtggggtgagggggatgggaccttctctcggatctccaaagcgcgctggcacaggggctctgcctcccggtaacgcccacgcttcccatagaggacagccaagttgttgagcgtggcggccacctgcggggttgggggaggcacaggtcagggatgggcaggtgtggccccactttgaccccacttcgtctccctggggccccactcaccgcggggtgctcagggcccagcgtctgctcccggatctgcagggc

SEQ ID NO: 91949 - DNA, 1024 bp, Homo sapiens
atgtggtggtttatagctaccactacctcctggaccccaagattgcagacctggtgtccaaggaactggcccgcaaggccgtcgtggtcttcgacgaggcccacaacattggtgaggggggcgccaggggccaaagggatgccagcccctctgagtgaggcccctgcaggcctgcctgagccggctctctcccccttctccagacaacgtctgcatcgactccatgagcgtcaacctcacccgccggacccttgaccggtgccagggcaacctggagaccctgcagaagacggtgctcaggtggggccggggacgtctggcggtggtgcccgccctgcccctgggaccctggcccctgtctgacttgtccccagggttgccagccccctcccagccccagctcatctctccgcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcagggtgagccccgaccccccgctgccccccagtccctttcccgcctccccgtcgccgctgatagcgtctcctcgcagaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcaggtgcggccccagacagcgcgcggggtgggggcccggcaggtcccggttatgcagagccgtgtcctccacgcctgtagccccaggtcaccactgcagcatcaggagtgagtgagctgggcgaggcacgtgggaccttgtctggtctgacctgggaggtccgggagcaaggttggagctgatcctgggtccgtgcgtcgggcaggggcctggcaggcaacacctggctggattg

SEQ ID NO: 91950 - DNA, 1112 bp, Homo sapiens
gcgaggctatacctatagtctcagctactcaggaggctgaggtgggaggaccacttgagctgggaggtcaagaggctgtagtgagtcacaattgtagcctgggttacagagcgagaccctatctcaaaaaaaaaaaaaaaggtgatttgccttcttctttgatgttggggagactgaggcccagggagtggagaggactcaacgcccaaggtcacacactccctgttcatccaaatgagccgccagcctgaacaggttctgttccttcgacttcccagacagaggcgggtatcagcatgccccagcctgccctgctgcctatactgccagagctaagtggtcgatgcagcagggaggtggcagagctggtgggtgtggtggctagcatggggatagggatggtgctggcctgaccggttcctagtggcctagctccctcccactgggccagtgaccacagctgcccctccacccctggccacctccctgttcctcttgctaacaatgggtcagtgagagccagacctccactgaatggggaccctagggaaaggaagctgagcagtcgcttccctctaggacccctctaatctggtagagatgacccagaataagttagatgcgggtgtgaaaccgattactaccgacttcttgcagggtgaccttgaacatatgtttctgagccatgctttcttgcctgctagggtggttttgaccatcaaatgaagctttcggtgcacggcatttctcaccactctagaagggagtggcccctcaattaatttttttttttttaaatagagcctcgctctgtcacccaagctgcagtgcagtgacacaatctatgctcactgcaacctgtgcctcccaggttcaagtgagccttgtgcctcagcctcctgagtagctgggattacaggcacatgccaccatgcccagctaacttttgtatttttttgtagagacggggtttcaccatattggccaggctggtctcctggcttcaagcgatccatccacctcggcctcccaaagtgctcgggttacaggagtgaaccaccgcgcctggctggttattgttgttgttgttttaaacatatttatttatttgt

SEQ ID NO: 91951 - DNA, 1022 bp, Homo sapiens
agtgtgtcagcgccacttcccgccccctctgccaagatttaggatcctactccagaattggggcaccccttctccccaggtgggagaggctttccagagcggagggagggtcaaggggaaggggaaatgtttcccctatccaggatctccagacggtttccttcgcgtgggcgagagagacaccggggtgcagcccctgcgggctccaggactacaattcccacaggacccgaggcaaagagtcgcccgagggcggtcgcggaggctgctgggggttgtagtccaaactaagattttgaactcttgctgggacatcctttgaagatccaacccgcgctttttatcgacggggagattcgggctcagagaccctgggggatactgatcaggaaaggggatagtgcgcctgaaggggtggggcaagggctcaggagtcagtctccagccacagcgaggcaggcgtctcggctcttctgtatctccctggcctggtcgctctcggcttctgggcctcgcccttcctgtctgtgaaatggactctgggtgaatccaaatgggatcgtcttgggctacgtcctgtccctccgggactacaagtcccaaggtgctcgaggcgaccttggctccccctccccaccgggacccgcctccctccagcccaagtcacgtcgtctaacctgttcccagctcctgccccgccccgttctccgctccccaagccggagcccgagctggaggaagcccccaggtgccaggatctgcccggatccgtgagtttcaccctcctggggaccagaggccctgaaaaagcccaacacccgcgtccctgggaggattgggaggggactcggacgccaggtcccagggcggaatttggggcgcgccgacacctggatccttagaaggaaactccgttgcctgttttactggagggaaggaaagcgggttcggatgcctgaattcttggaatggagggattctaccccttcatcccggggagacgttggagctggaattcctga

SEQ ID NO: 91952 - DNA, 1034 bp, Homo sapiens
cattcgacagcagtgtgtgggttgagagtgccccagctctacttgctggggctgtggctgtattggtgtagctctgtttcctcaccccaggtttgttaatttattcaaaatgtactgaatgaggctgggtgtggtggctcacacctgtaatcccagcactttggagaggctgaggcaggtggatcacctgaggtcaggagttcgagaccagtctggcgaatatggtgacaccccatctctactaaaaacacaaaaagttgctgggcgtgagggcaggaagtgttcaggaccacaggacacgcagactggggctggagggagagggctgagctggagacagacccggggaccctttaggaaaggcctggtgccagtgggcatggaggggaggagcctggatcagaggatcagggactgtccagggttaggaggagagagaagctggaaaagaccctgccacaggtgggaggagggaggaggtgtgggaagaggtgcgaggaggcaggaggtgtgggaagaggtgggaggagggaggaggtgcaagaagaggtggaggagggccctgtggttatcaagggtcatccctattgatggcttctgcccttcgtccctccccagaggggcaatcccgtactgaagttcgtgcgcaatgtgccctgggaatttggcgacgtaattcccgactatgtgctgggccagagcacctgtgccctgttcctcaggtgagctctgcggcgccaccccagacttcaggaagggcaccccactggcctgggagggtcatgtcccagtgttctggactgttctatgagaagcctctgggcatggtcctgcaggttctgggccttggtgggaccctgtgttggaggcagggggtcttggcctggaggtgcccagtgcaacaagagctggagcccgaactcctgggtctcaggaaggaggggctgggggccggactcctgggtccgggggaggaggggctgagggctggactcctggggatctgagggaggaggggctggggcctagactcc

SEQ ID NO: 91953 - DNA, 1180 bp, Homo sapiens
gtgggggcgccagaggtgaaggggacctgcaggctggggtcttccccgcccgggtcagcggggtccctgcggggctagtctaagcgcctattattaccagcccccggggcggcgttgcactgcgcaggcgcgggcggggcgcgggcgcgcgcgcgagcgagcgagggattccctctgacgtcattgctaggataccaaacaaacactccgccgcgccggccgagctccttatatggctaattgcgtcacaggaactccgggaaggcggggccgggatcccctcccgccgagtggcccggaacgcaacccccgagacccccagggccccgagggtcatgcaagtgaccagatcgagtctagaacagacctcttgctggacagtgcgggactcgatttggcggggccggagatttggggaagtttgtccagcaaggggcgggtgacgtaagcaggggggcgggtcccgggcatataaatacaggctggcgggtctgtgcttcattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtgga

SEQ ID NO: 91954 - DNA, 1575 bp, Homo sapiens
atggatctgcgaggcccttgcggggatctagtccctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggagg

SEQ ID NO: 91955 - DNA, 2041 bp, Homo sapiens
gacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgaggtgagccggacctgccccccgacccgtccccgcccgggcgggctccgcgccccgcctttgtccccctcccccccagctagctccgggctggaatttggggacagatccttgggagcctcggatttgagctgaatccccttggacgcgccccagaaccgtcgatcacttctccacgactgactccccaagctcggggggtggtggcggtgaggttctcctgggagccctcaagatttgggggcgctcggaggactcccgaattgttaagactttttttagaggacctcaaagttggcagcgactccccgcagggatgccaggattgaggcagggctcagactctcctccccctccccccagacttcagctcgaggtccgggaaggattgtgggggaccgatttgggataccctgggacttggaagagagactgagactcagaccctgggtgtgcaggtcccccgtttacttggtgctggaaaaagtctccccaagtgggaccgcgctccataacttcgggggtacttcttaatcccctggattttgggggtcacttaggtcttcctgtggaggaggctggtgtgaaccgatccagggacctggacgcagcctccagagtctggtgggaccccccccttccccgtcgctccgcacacaatctgcttaactggccgtgcctaggaccgagcgggcgctcggagcagagggcggctccccgcctccggccataagggcggcccggctcccccacctgcgcggccctggagagggagggggcgcggcagctgggggaagggggcctttgtcttcctgactcacctgtcgagacagctggtgtggggggcgggcaccaagcgctgtaggccggctgccttccccaccacggcccctccccctttgctcaccgtccccctatccacccggagccttggggttggaggagggggagctggaaagcttcaaggtcatagccctcttccctagggacccaggcttcccagataattccagctatcttcccaggaatttaatcctgggggtggcggcccaagggacccagggatttggtctggccggggcctcccccgaactcctgggctcacctgagggcggggccagtgtgggcaggggggcccaaccatcccccctattcttccctcccctggccccccataatctctcccatggggccagagcctgacaatactatctcccttcctctactctctctgggacttcctgccccaaagcccccagcctgagcagggaggcccctggggacggttggggattaaccccgtggtgcccacatcccccgcatttcctgaacccctgccctttgacatcggagtggcgtggcattcctttttatgaccactagagaatccccctcccgcgtttgttccttctgatgtgaaaggcatggctggaaaatttggagcaaggaggacacccacagataccctcaagacttcctgcctatccgctccccattatagcaacatcccttccaagtccgccctggagaggggtcagtttagggagcgtcgctctcttccttcgccctcttcctccgggactcttctctccccttgccccccagccccgcccctccaccccccctcgcgtttccggtcccaggctcggtggaaggcggatggcggatgtccgagttagtgctgcctcactcactgcaaccgtaaaagggcaggagcggtgtctgggccggccccctgtcctccccaccaccaccaccaccaccagcaccagccctggaagccctggccctcccacaaggcccacctcttgctgtggtggtggccaagcatcccgtcttgtgggggtgctggggtggggtgcggtgcag

SEQ ID NO: 91956 - DNA, 1201 bp, Homo sapiens
tccacctcctgggttcaagcgattctcctgcgtcagcctcctgagtagctcagactacaggtgcacaccaccacgcccagctaatctttgtacgtttttgtagagacgggatttcaccatgttgcccaggctggtctcgaacacctgagctcaagcgatccattcacctcagcttcccaacatgctgtaattacaggcgtgagccaccacacccggctgtaccaagccctttaggtgcccagattcatgtgcccctcccccactgccctggaggtggggactgtcattttcccagttcacaggcaagaagaggtcttgagtgggaaggtcatgtgcctgagtcacatgaagtaggtggctcagtggggatttgaacccaggtctggggatatcagctcctgaactctgcaccagtttactgacacctcccacccaggctaagtcagacgttgccttttccaggaagtcctgcctgactctccaggctggggcaggcgttccttcagggtacccccagaccctgggctccttggtcctaaacctgggttggtaccgtctggggacagctgtgtctcccacactggactgtgagccccaggagggtggtgccggagctgtctgggtcactgctgtgtcttcatccccagccccacccaatataggccagacacagagcagggagtatctggggaatggccgctagtgccctggggagccaggcgaggggtgggcagcgggaagtccctttggaggaagagctcagaggtctgggatgggtccccaacctgctgcaggcctcacacttcccctcccaagcctcagcttcttcctgagcaggcagtggtggaggggggtgcgtagagatagggaaactgaggtcaggcaggggctggtccctagtgcagctctgggctcttggcctccttctggcccctctgtcttccctcctgccctctgctctgctaacccgcatccccccactggcattggcctcggcctcttacacccctcagcctgtctctccatctttatcttttccttcttattagttttgttgtgttgtgttttttatttttcattaaaaaagtttttttgtggactgggtgtggtggctcacccctgtaatcccagcactttgtggggctgaggcaaatggatcacttgagcccaggagttcgagaccagtctggccaacatggtg

SEQ ID NO: 91957 - DNA, 1033 bp, Homo sapiens
cctggaataggaggcggggaagcaggtcctctctctaatctcattgctgtcccaaaccacaccaactcccccaggatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaacctcaggtttccaatctgacaaatggagaaactggattgggtcaaggatgaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactacccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctctaaaaataacttttaaaagttacctgagaaggccaggtgcggtggctcatgcctgtaatcccagcactttgggaggccgaggtgggtggatcacctgaggtcaggggttcaagaccagcctggccaacatggtgaaacccatcgctactaaaaatacaaaaattaggctgggaatggtggctcacagccataatcccagcagtttggaaggctgatggggacggatcacgtgaagtcaaaagttcgagaccagcctggccaacatggcgaaaccctg

SEQ ID NO: 91958 - DNA, 1038 bp, Homo sapiens
ggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggagaaggggaggaaacttctcccctcccaccttcacctttagcttcttgaaaatgggcccctgcagaataaatctgccagtttttataaatgctaagatctctggagtgatttgaaggcctgttctgatggggatggaggtgtgctcggcccccggtgcccctccaggaagatttggtcctctgctgagaacccctgcctcctcccaggaatccaccttcccttcatcttccttcccaccctgcatattgcgcctgctcactcatcctcaggcccgcagccaggatgatctctgccccctccagcctccctccccatgccccttaggaggccacttcctccccatcccaccctgcccttcaccaccctaggggaggccagaagcagcctcactttgtgtagccttgggcaagtccatttgcttacctcaggcctcagtttctgatttgggaaagggctcataagatgattctctgcccccactctaccactctcccagcttctttcctctttttttttttttttttttttaatgagttggagtcttgctctttcacccagtctggagtgtagtggcaggatcacagc

SEQ ID NO: 91959 - DNA, 1141 bp, Homo sapiens
aacccccctttccgtggtgggaaatttgatcctaactagggctaatccagcctgtccttcagcctcagccccctattttcctgtcctcagagtccctggagcttgtactgtgtggcatgtcctttcttgccttccccaccttgctcagtagcatttctcagggacccagtcgaatccaagcccatggattcaattgtcacatccttcatcttccatccgtgtctcctaatctgtgtgctcttgctttctttcctcggagctctggactgacccgacagcctgtcttcatgtagcagtaccctcctgcctccatagcccccggtcccacccccatcctaccaattaggccagcagttggccttaactgcttgattaatttccttggactgccataacagatcaccattgggtggtgaacttgatggcttaagtccaacaggaatttaattcacacagttctggagtccagaagtctgaaaccaaggtgctgacagggacacgctccctcttccagctcctggtgattccaggccttccttggctctgcctgcagcttcacatggccttttccctcttctattttgtctcttacaagaacacctgtcattgcatttagggcccatcttaagttcaggatgatcccacctcaagacccttaattacatctgaaaaaacactttttccaaataaactgtcataagcacaggtcctgggggttagtatgtggacttgtctgttgggggcacaccattcaagccattcagcccactattcctcctcaccccaagagtacgctggcgtccaggtgcagtggctcacacctgtaatcccagcactttgggagaccagggcaggagggatctctttgagcccaggagctgaagaccagcctgggcaacatagtgagaccccatctctacaaaagtaaaataaaaaattagccaggtgcggtgatgcatgcctgtagtcccagctacttgggaggctgaggcaggaggatcacctgagccctggaggtcgaggctgcagcgagccgtgatcgcgccactacactccagcctggatgacagagtgagaccctttctcagaaaaaaagtaccctgggactcctgccaaccccgcgggccatttggccttcctg

SEQ ID NO: 91960 - DNA, 1039 bp, Homo sapiens
gcagagctgggatcccagccaaagtctgtatgaccgcgcggcttcctcttaatcccaatgagagccctagcttgcagaggaaggtgtatttggggctcataggactaattaggactaattaagagcctcctttgggtggggacgccaactcggaacgtgacatcacgaaggagtacagtgacgttggccaaggcgggcgtgggaatccacacgccttccagcatccgtttaacggcaccgccccctgacccgcctcacttccgtgtatatttgcatattcagcgaacggacgtcgctacgccagcgtcgacggggtgacgtcaggatgcgcctctgaagtttccctcgagcgtacgtacatacgtactgacgcacgcatggccacgagagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaacgtgagtctgacccgaattccctccaacctttttcctttctccaacccctgtcaggtggttgcttaggggatggacttctgtctacgaccaatcacagcccgaaccggcaaagtccagtggccaatagtggggggtttctgatagaggggcgtacgggtggcccagtagtgagggcggggcggggcgtaaggggcgggtcaaggagccaccacgcgagtaggaaatgccagccgataaaggaagagagcgcttggagactgatgccctgttaaaccaatagtgtgagagatgggagaaatttggacggggctttccaggatagaggagctaggggaggggctgaggagaaaccggacggggtcctttgcccggctgtccttgggcaacttcatttcaaaagcggcaccgtgtgcctcagtttccccactgatc

SEQ ID NO: 91961 - DNA, 1029 bp, Homo sapiens
tagctgggattccaggtgtccaccaccacgcccagctaatttttaaaatattgttagtagagacagggtttcgccatgttgaccaggttggtcttaaactcctgacctcaggtgatccgcctgccttggcttcccaaaatgctgggattacaggcatgagccaccacacctggtctaatttttgtatttttagtagagatggggtttcaccatcttggccaggctggtctcgaactcctgacctcaggtgatccagccagatgctgtggctcatgctgcctcctgggattacagacgtgagccaccatgcccggccagatgcgggtttaaaagtagatgctcctgcttacgctgcgggctgtgaagaccccagcatgtgatgccttctcagccagtcctgacaggtagaatgagccctgggaccttagcctcctctgtcttggacctcagctccgattgtctaagaaagggatgggtttactgggtagttcttccaactctgaatgtctcctcccattttctgccccaggggacccggctacctgtaagcagatcaccagtgcggatgctgtgaggaacatggaatgggccacagctacttgtgtcctagggtttggggtgtttggtgagttctggaatgagagaggtctcactgaggacagtagttctgagagacatccccgctggtggtttccagagtcttactgcttacctccagtgtgggaagctcactgctttactgcatgtgggctgtatttgtgtaagaggaaagggtagggtgagatgactcattagagctgtaataaaatgaaaccaaatgggcgtggtaactggccaggagagatccacactgccggtgccctagccacccattcattcaggcacgaatgaagcaaacacatattccctgagcagttctgtgcctgccgtgggcttggcagtgaccatgactgacggccctgctctcctgtggctctcagtccagtgggggaggcagacttgtccccagacagtgatgacccagagtga

SEQ ID NO: 91962 - DNA, 1050 bp, Homo sapiens
gtaggtggcaggtgcttgggtggttgggtgggtggaagagcagatagaaaggtcgaaaggtggggccgggcatggtggctcatgcctgtaatcccagcacttagggaggccaaggcgggtggatcacttgaggtcaggagttcgagaccagcctggccaacatggtgaaacccatctctacgagaaacaaaaaattcgccaggcatggtggtgggcgcctgtaatcccagctacttgggaggctgaggtaggagagtcacttgaacccaagaggcagaggctgaagtgggccgagatagcaccagtgcactccagcctgggcaacagagagactccgtctcaaaaaaaaaaaaaaggtggaaaagtgggtgagaatggatggacataggcttgagagttcaagatgctttcaggggtcagcataggggtggcttctccctgttgaccctgcccctggccaccctgcaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtgaggaggggcagtgggctcagatgggggtagagaggccccccccgatctcaccagggctcccaacgccagaccctcctccccacagtatgtcaccccacacccacccgtgtgcatcctactcatcttccctcttatctgtccacccaggtccctgaggactttggccctgtgcgcaccgtggcagagggccacggagacacactgtacgtggggaccacccgcaattccatcctgcagggctccgtgcacacaggcttctcactgctggtccaggtgcgcctctctcctctgcacccctcccctcttcccagctctttccctggccttccctgcatcatccactccccctccccactcccagttctcctcacctccctgctctgtcccttctctgacctggccctgacccaggaccccttcccag

SEQ ID NO: 91963 - DNA, 1026 bp, Homo sapiens
ccgagtccatgttctcaaccactctcccccacccaccccgaaagaacctgggatcgggagtccacagcccgggatgtgtgacccggtgggaccctccggctccaggggtggctgtggagggcggggcaggggcgcggcggcccgggcgcctcccagggccggaagcggcagagccggtcccggctccacccccggccccgaagctccgccacccgccgccatgagtagctttggagctgggtgagaccctttcgcagaccaccccccatctcctctccgcgctcccggggcttagatctcaggtttcacccaacccctgggacccagaccggcgtggggacacgccccttcccttaaactctccccgtttctccctctgcttgacgtttggtgtgctgggggaactgcgggtggggggcgctggggagcaccttgctgattaggagggaagggtccttggtgactcccttcttccaggatcgcgtccctgccacttcgtgctgtgtgatctttggcgatcactgcctctctgggcctgtgtcttaggctctgcaagatcaaccgagcaaagcacacggcctgcagagaggcagcgctctgccccttactcggccccgttttcatcggagacctccggggagcggtgggggtggaggaatggtttctccccttttctgaactgaatactaagaccctttttttttctttgtcctttcctgacagcaaaaccaaagaagttatcttcagtgtgggtgagtggggagatggggaagggctcggtggaagcttgcttgttggggtgacaggctggagccagaggtcaggagtcttggctactgggtctttgcctctctggcctcagtttccctgcctttaaaaaaataaataaataaagctggaagaggagagggaatagggatggggctggtgtcagtgcctgacctctgggggtgtcctggcagaggatggctccgtgaaaatgttcctgaggggccgccctgtgcccatgatgatcccagacgagct

SEQ ID NO: 91964 - DNA, 1042 bp, Homo sapiens
ttttgtatttttagtagaggcggggtttcaccatgttggccaggctggtctccaactcctaaccttgggtagtccacccgcctcggcctcccaaagtgctgggattacaggcgtgagccatggcgcccagcccgttcattcattcgatacaaaatactgagctaggactgtcctgggctgtggggagcagcagggaccaggacaggagattggcggccccagcagtgctgcctgctagtgaagagtgagggcttcgaagctggacacagctgaggccaaattcaggttctgtcactttctagctgtttgccagctgtgtggccttcacctcagggttgagggtagggagaggtaagtgaggtgccaacgtgcagaatctaaggaaagattcattccaaaattgaaggcccaccttacacttgcttggtttacctgagtccccaacctgcttcacctcattcggcctgttttctcatctctaaagtggggaaaatactagtctcagtggacaaggctgttcattcattaaattcagcaaaaaattactgagcatgtgtatatgctaagcactcctccaggcttatcacaggaatacagccaagaaccaaatggtccctaccctccagtgggaaagacacactaaacacactatagaagtaaggcatacagctgggcgcagtggctcacacctgtaatcccagcattttgggaggccgaggcaggcggatcacctgaggtcaagagttcaagaccagcctgaccaatatggtgaaaccctgtctctactaaaaaaatagaaaaattagctggatgtggtggcggccgcctgtaatcccagctactcaggaggctgaggtcggagaatcgattgaacccgggaggtggaggttgcagtgagccgagatcacgccactgcactccagcctggccacagagggagatcatgtctcaagaaaaaaaaaaaaaaaaaggaaagcatatagaatgtcagatggtgagatgtgcctagagggagaataaagcaagaaaagagatgaggagt

SEQ ID NO: 91965 - DNA, 1022 bp, Homo sapiens
cgagactagcctaggcaacatagcgagacccccgtctctacaaaaaaaaaaaaaaatttaattatgaaaaacatgttttaaacgataacgggagtggtcctagataattagtcctattgaaatgaatgttaaggggcagcgattttacgaatactgggggaggccgagcgcggtggctcaggtttgtaaatcccagcactttgggaggccgaggcgggcggatcacctgaggtcaggagtttgagaccagcctggccattgtggtgaaaccccgtctctaacaaaaatacaaaaattagccggccgtagtggcgggcgcctgtaattgcagctattcgggaggctgaggccggaggatcgcttgaacccgggaggcggaggttgcagtgagccgagattgcgccactgcacttccagcctgagcgacagagtaagactccatctcaaaacgaaacaaaagaaataaaacgaataatgggggagggaagttaggacttttagaaataattatttgaaataagggacttatcttgatcatttgagctggagacgggtgcgttttcgacttgattcacaacttacacggataacgaacgagtcattgacatgattttgcgcatttattagtgcagcagatattacattgaatgcttatgtatcagacactgcttaagctacataggatacatcagtgaatgaaacctctagtccccaagggaaaagaaaaatctttttctctttttctttttttttttttttttgagacggagccttgctctgttgctcaggctgtagtgcaatggtgcgatctcagctcactgcaacctccgccgcctgagttgaagcgattctcctgcctcagcctcccgagtagctaggattacaggcacccaccaccatgcccagctaactttcgtatttttagtagagaccaggtttcaccatgttggccaagctggtctcaaactcctgacctcaaatgatccacccgcctcgaccttccaaagtgctgggattacagg

SEQ ID NO: 91966 - DNA, 1037 bp, Homo sapiens
agaacccagaggctcccaaagtatttcactatggaacactttttattgggaagcacttcatagaactaggatacttcggccgggcatggtgggtcacacctgaaatcccagcactttgggaggccgaggccagcagttcagctgagctcaggagttcgagagcagcctggacaacatgatgaaaccccatctctactaaaaatacaaaaattagccaggtgtggtggcatgagcctgtaatcccagctacttgggaggctgaaacaggagaattgttggaacctggtggcagaggctacagtgagccaaaatcacgccactgcactccagcctgggcaatagagcgaggctgtctcaacaaacaaacaaaatacaacaacaacaaaaagaactaggatacctcagaaggtactttggaaaacatggggttttgaaagtctgagagcatctatgagaggaatgggtaagacagatctagatttaccgcagagtagttagggcacactgtctttccccttcagctgttggtacagcactgtgagatggcagtgtaactgcaaactccaatgagcaagtatttcccaaccctacctaattttcagactcagctggggtgctcattaaaaaatgcagactgggtgcagtggctcatggctgcaatctcagcactttgagaggttgaagtgggaggatcacttgagcccaggaggtttttctttttgaggcggagtctcgctctgtcacccaggctggagcgcagtgctgcaatgctggctcactgcaacctccgcctcccgggtacgagcgattctcccgcctcagtctcccaaatagctaggactacaggtgcgtgccaccacgcctggctaatgtttgtatttttagtagagacagggtttcaccgtgttagccaagatggtctcgatctcctgacctcgtgatccgcctgtctcggcctcccaaaatgctgggattacaggcgtgagccaccgtgcctggcccacgctgtccttaaggagacactttggtgcatacac

SEQ ID NO: 91967 - DNA, 1172 bp, Homo sapiens
gccggagggaaggagcgagggggcgggcccttttacctttcgcgcgcatgcgtgtgggctgcagccttctcccgccgcctgggggggctgcgggtgagggctctttgggggcgtgtgtaggtttcgagggtcacctgaggggtttggaagatttctttgggggggcggttacaagatttgggggttccttttccatttgcaaaatgttctggggcttggggaagttttaacgtgggtttaggggatacttttggggttctctcgcgcttaaggggcaccttggagtttgggttcgtttgtaatgcggaaggttcggttgtgttttcgggatcgggttccctttgtgttttggagtgtttgttgggcatagaatttggggagctcccggagagacagaagcaaagagcccgagagtaccagtcctggaggtggaatgtctgggctcgcgtcttgacttcctacctgtcttaacccggacaggagatttcacctgtgtctcatcgggaactaggcattaataacactacctgcttcctagggaccgaggaggattaggaattgttagcgcagtacctacctagtaagctcgcagcgagcgtgcagtaagcacatgtctgctattgtaacatttgtgaggtttctttgttttttttttttggctttgtgaaacatttttatggtttaagattcatcttaaagtgttagggagcttttgtgttttcaaagagttcgtctgctgttggaggcttctagtggaattgggagataatggaggagggttggggggagtataggattccgggagagtgattgtttatgacatagtttggggaattgctgtgttgggatctgtgagagattgactgagattcggcccttcagtgctggagaggatatttttaggttcggtggtttaaagtagtatttgaaagcttttcgatatttgggggaggacattgagatgctgggggtaaggttggaactgattaggggacttgagggggtggccaggttgtagcaggatggcatctgtagagactggcttttgctgtgttagcctgcctccctgggcagttggttatacaggtcaagtatcccttacccgaaaatcttgggactaaaaagtgtttcggattttggatttcttcggattttgagtatttgcattatac

SEQ ID NO: 91968 - DNA, 1039 bp, Homo sapiens
ggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagagg

SEQ ID NO: 91969 - DNA, 1171 bp, Homo sapiens
gccctcggtgtccccacaggatgaaacagtaagttggtggaggggagggggtccgtcagggacaattgggagagaaaaggtgagggcttcccgggtggcgtgcactgtagagccctctagggacttcctgaacagaagcagacagaaaccacggagagacgaggttacttcagacatgggacggtctctgtagttacagtggggcattaagtaagggtgtgtgtgttgctggggatctgagaagtcgatctttgagctgagcgctggtgaaggagaaacaagccatggaaggaaaggtgccaagtggtcaggcgagagcctccagggcaaaggccttgggcaggtgggaatcctgatttgttcctgaaaggtagtttggctgaatcattcctgagaaggctggagaggccagcaggaaacaaaacccagcaaggccttttgtcgtgagggcattagggagctggagggattttgagcagcagagggacataggttgtgttagtgtttgagcaccagccctctggtccctgtgtagatttagaggaccagactcagggatggggctgagggaggtagggaagggagggggcttggatcattgcaggagctatggggattccagaaatgttgaggggacggaggagtaggggataaacaaggattcctagcctggaaccagtgcccaagtcctgagtcttccaggagccacaggcagccttaagcctggtccccatacacaggctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccaggtcgggatcggggccggggccggggccgggatgcgggccggtggcaacccttggcatcccctctcgtccggcccggacggactcaccgtccttacctccccacagtcaactacgcgaggcagaggctcggaaccgggacctagaggcacacgtccggcagttgcaggagcggatggagttgctgcaggcagagggagccacaggtgagtccctcatgtgtccccttccccggaggaccgggaggaggtgggccgtctgctccgcggggcgtgt

SEQ ID NO: 91970 - DNA, 1036 bp, Homo sapiens
tgtagaagccctacaggggcggaacccgaggaagtggggtcccaggtggcactgcccggaggggcggagcctggtgggaccacagaagggaggttcatttatcccacccttctcttttcctccgtgcagggacatcaaacccgacaacatcctgctggaccgctgtggccacatccgcctggccgacttcggctcttgcctcaagctgcgggcagatggaacggtgagccagtgccctggccacagagcaactggggctgctgatgagggatggaaggcacagagtgtgggagcgggactggatttggaggggaaaagaggtggtgtgacccaggcttaagtgtgcatctgtgtggcggagtattagaccaggcagagggaggggctaagcatttggggagtggttggaaggagggcccagagctggtgggcccagaggggtgggcccaagcctcgctctgctccttttggtccaggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggtgagcacggccgcagggagacctggcctctcccggtaggcgctcccaggctatcgcctcctctccctctgagcaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggtaggtacctgtg

SEQ ID NO: 91971 - DNA, 1022 bp, Homo sapiens
tctctaacccctcccatctctccctctcatcttccccagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctgga

SEQ ID NO: 91972 - DNA, 1038 bp, Homo sapiens
cgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccccccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcggtgagtggccccacaccagcctgccggggacctggcaggacctttcgtgggaagaggcaggcattggcagagagagggctttgttgctgtcacagcctctggctccgtggggtgaggggaagccagggaaatcttagtgtctcagtacaagacctctcagatccttagagtgagggggtctagccctaggcagcaggcagcagaaagagggg

SEQ ID NO: 91973 - DNA, 1053 bp, Homo sapiens
gcatactgagcgctgctgtgtccgcgctctgggccctgcgagcagaggggatgagtggggaagccactcggacacgagtgacgggaatgggcaggactgggacagccacctgggggctgtgggagtcagggtagggggcatctggcccagcctggggggtcagggagagagatctggaggacgaggagagccagccatcggtggggcctgaggaaggaccaggcagggccatctcaggcaggttccctcagcagagccctggattacagacaggtagactcagaccccgagtaaatggaccattaaatgggaaggcttgggccatgatagggcagcacgggaggcctggcccaggtgccaggaagcattcccaggagatgcacagccttcgggaggcccagaagctgagcaggtgccgtggaccaggcaaagaggagggtggatgcaaaggcaaagagaccagggccctcgggactgttagaatgggtatgtgaccaacatggagggcagcagagcagcagcgggccggggccaccccatacaacacctggcagacagtgtgaggcagggagctgggggtttattctgaggccacagggcaggcatggctgggattggagccagagagggacagggtcaggatcgcactttagaaagatccttctagttgccttgtgtgttggcagtcacgggaggctggaggtgggaagtcctggtccccgccatttccctgccctagaacaattagctccccagccccggctcccttctctgccctccccggctccactgcccaagaagggacattcctgagggtccgagggggttggagaagagtgtgggccaatctgatgcccgctcctgccctgtcagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccggtgaggcccctgagcccac

SEQ ID NO: 91974 - DNA, 1021 bp, Homo sapiens
agaggtgcagtctctgcccagatcatccagccgccagcttttgaaccctgttctgttcacctccaaagctttataagcaggggcttgaacaagcagcccctgagggagggcctgctggccctgagctcctacaattcagcagggcccgggagccaggcggcctcttcctctgcagccatggccctccctccatctctggcaggatcttcaccaaggttgtgctggaggcgccactcatcacagagagtgccctggaggtggtccgcaagtactgcgaggatgaggtgaggacaggccctggtcagtgcagcccggggcaggggacagggccctgccctgaggggtctgaagggcacacagtctaaaccttgtggccgggggttttgtgagggaccgggcccttttgtccaggtacctgatcagaggcaggcaggaaagacagagcccagaggcacactcaggtgggctgagctcgggtccctttccttttgctgcagagtcgcacctatctgggcatgtccacacttcgagacctgatcttcaagcgcccgtcccgccagttccagtacctgcatgtcctcctcgacctcagctcccatgagaaggacaaggtgatcccctcctccacttcctggctgccctcagcctgcagcttgcagaggccgcctctatcctgagtaaccagcccacgtcttccacactcccttgcaagtttctctgggcccattcccttctttcagtggttttttggctatttctgtctgttttattttcattttcagtggcatcaagctgcctagaaaccagggttaccgtgcctgagtctgcctgtagtgtgtacacacacacacgtgcgcttgccctcctgggaagggcagtcccactctcgctcttagtccacccgtggtggccagcacaggctcctcgtgcagcccagtcctgtgccggggcctgagggcattgcccagcccagcaggggagccggtgtggcctcagccagcagtgaggacacagcgtgctc

SEQ ID NO: 91975 - DNA, 1186 bp, Homo sapiens
ctgattctgccacttgctggcactgttaccttcaaagaatggggaaaagtgactttttccccattctgtgaagttaattgttgattagccagtagtataggaacatactccctgagctgaaaaatatttccggggaatccagatccagtactcttccgtggccatcacctgcaccccatccctctcttcaaaggtgacaaaggcacaaatgaggggaatctttgaggatctttttctgtgcacttaagtacatgggtgctgctcctagaaactcatttttattctgtgatgatcgatccccaccctggtacccccaccccccaacacacaaacgggaccttcctaggcataagggtcctcggctggccttcctcgcttcactccttgtctgctctgagagttcctgcgtctgggtgggagaagtcgcagggcacgattgcggagtccctggattgcccaccctacactgacatgctggctcaccctcccaccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggtgagggggctgaccctgcaccctcctgtccccgagaggcttcctctcctggtgctgccctccctttctgattgcgaccacctccctcttcgtcaccccccgagtcagtcctcctcgcacccatcccaagtctcctctcctcctccccctctggaggcacgttcaaggttgtagttttgcatgtgggctccaggtcgcactccctgagctgttcctcagctctgccacttgctctgagcttgctctgcgtggctttgtcactccctctctctgccattttcccatctgtaaataacagtgctcacccatgggcctggagatagacttctctacaccccattcactacctgagttggttctgtagcttcctccctatccgtggcctccagcttactcgtctatcctccacacagcagctccaggaacattttattatataaatccttttattacttc

SEQ ID NO: 91976 - DNA, 1056 bp, Homo sapiens
agtgggttgtgttgttggctgaggaaggggcagtggatgctaggcaggcagaattacaggcatcctttttcactgtggaacaggggaggctcacttatcagggtgaccattagaaagtcatcctggcgtcagggagactagcagtgagctgttgcagcagttcagttgggggtttctggaggcaaaagtggtgattataaccctccccaagcgaagcatatgtgaatttccagaccagagatggaggaggacgaaattgtatgtatttactaaaagagagggtgagtttttctctttaagattgactgatactgatggagacccccagggtttgaagcatcagcttgtaaggcggaaagccacacgttagatctgagggtgaaggaacttttctagtagatgcctgcaagaccactgcccaagtttggggttgagaattaagactggcagcatgccatgagatcttccacaagacacagctcctgccactttcctcacagccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctgggtgagaggggctggtggggtggggcaggcagaccatgctgaaatgtttcattatttaccttaaactatgctgaatttgtatttactaagattatattatagattatgttatgtgggccaggcacagtggctcacacctgtattcccagcactttgggaagctgaggcgggcagatcacttgaggccggggttcaagaccaacctaggcaacatggcaaaaccctgtctctaattttaaaaaattataaaataattataaaaataaattacagtatttaatatgatatataaattacaatagaattatcaaaatata

SEQ ID NO: 91977 - DNA, 1612 bp, Homo sapiens
actaaattttttttttttttaatatggagtccaactctgtcacccaggctggagtgcagtggcgcgatctcggctcactgcaacctctgcctcctgggttcaagcgattctcctgcctcagcctcccaagtagctgggattacaggcacaggccttcacacctgggctaatttcttgtatttttagtagagacggggttttaccatgttggccaggctggtcttgaactcctgacctcaagtgatctgcctgccttggcctcccaaagtgctgggattacaggcatgagccactgcgtctagccccttataactaaatttttatactcattaatagtctcatagaactaatcaaccaccacattttctgtttttcccgccattcatagacatctaggtaccaggatctgtccttccttttagtcccaaaagctgctgtctccagaggcctgggaaaacggatcccactgactggttctcctctctgtctcttagacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatggtaggtcattgtcctcccccctccccctgccttctcttcactggccagtctgctctttcttttttttttttttttttttttttttttgagacagagtctcgctctgtcaccaggctggagtgcagtggtgcaatcttggctcactgcaacctctgcctccccagttcaagtgattctcctgcctcagcctcccgagtagctgggattacaggacacaccaccacacccagctaatttgtttacttttagtagagacggggtttcaccgtgttggccaggatgatctctatctcttgaccttgtgattcgcctgcctcggcctcctaaagtgctgggattacaggtgtgagccactgcacccggcctcagcctgctcattcttaaagaaatgtagctccgtggtggaccccgagcgctagtcatccatctggcaggcctgagattctctacattagacaggaatcttttggcatgtgacagaaacttgattcaggactggctttaatattgaggtatgtgggggtgaaatgacatgatgtctgtgaaatactttcaaatattccagtcctctccccccaccaaaagggaggatagatgttccaagattagcgaaatgttgatgggtacacagagactcataccattttctctgttttgtgaaacgaaaaccgagaagtctggggttggggtatgaatgcgtacaggtcgtggatctgcatttctccatctctcagctctttgtttctccattttagtttcactctctggccctttccttagggtagcaaagatggccccccatagttcatggctcccattccgttcacttagcaacaccatgggaaagagagtgtctccttcccaaccattccagcagaagtccaagggctgacggtcattgtttctgattggctgagcagagattatgagccagtctctgagccaat

SEQ ID NO: 91978 - DNA, 1086 bp, Homo sapiens
aaaggtatactttgctagctcagtgagctagttcactcaccatgttggtgagcagagagccacacctttccccattttaccttgggaaactcactccaccatctttgccatctcttgaaagtcccttctgcaatctgacctcaatcttttgtgctgcagtttgtccagaggggacacagatgtggggtcagggatgaggattattgaaaaacccatcatctctttttttttccccgtctccctattagccaatccgatctcagagtctctgagtggcctccttgcacccttctcttcagcacccagtaggtgcttaataagtgtttgctgcattggattatctccctattccttctcatttgccctctagcttcccataccttctccaagtgtcttcctccctttctttgtctggctccctatgactttctatttttttttcctccgtgtggttcccattgttttctgtcctgtctctatcttagtctttgtctgtcttcctcctttcctcaaatgtctcaactctctctccccaatttccccatttaaaaaaaaaaaaaagtgccaaacttccttggaactgagccgctctggggggagaggaccttggatagaggggaggaaatgggaccatttctctttgaggaggtccctaagaggcattgcaaaagtgtggacatggagctaaattgggtcccccttccacagccctcccaccctgagtttttcttagaatctttgtaagaaaaaaaaaaaaagacagaaaaaagctctccttttcaacttacccctatccttttgggtccccccaaattccaccagccaaggagaatcccacttgccaacttcctggcaaatctatggaaactggggaggaggagacaagctcaactcctcctctgctagcccaaggggcggtaccaactggattcaagagaaggacctcaaagctcctatgagaagagggggttcgatgtgccaaattaacctccttcatcccccatctcagggggctctgagccaacctgcccagccaccttcttctgccctgtcccagccacctctacatgggcaaggaggcttcac

SEQ ID NO: 91979 - DNA, 1034 bp, Homo sapiens
tgcatgcctgtgtctgcgtggctttgtttcattgaatcgggtgagccaagtgtgtggtggctctgtcaggccagtatggccaggtgtagagttcagtgagccatagtagggtcccttgggccagaatgcttcgtgtggtctgataggttagattggtttggtggcttccagcaagctggcatacttcggtgatgtctgatggatcagaatgttttggtgtgctcaccaggggctctggagaactagaatgttctgatggagtctgacaagccaggcggccttgagagttggtttaggagtggctccctgagtgctgtggctgtggtcagctctaaggacctgttggcagactgagatttcagggcctgacaaccatgtagactaggatagctgagacctccctctacccccacccatctccctctcttccttggagaccacctccactttctccaacccaaagcagggcgcccagtgccctggttccatcatcagcatctctgggggaggggcgccccatgcccaccctctcccccatttgtccgcctcctaggtcttccaaacccttttcttctctatgactttgggggaaatccagcctccttgtctctctcctaaaaaaggagggaagaaaagccacagagacaattcctgcccctaaagcctaggagatccctctcccttgctagagagccacccccaaatcaaaatgtgaaaatccctagaaagcaatagccttcgaggtaccttgcactgaatttcccaccccagcccttccacccgatgggaggctgtaacttgggcactggggtgactttttccatgcccttgtcatctccagggtgggaggcaggccccacttcccctcccctatcccccacttcccattgttgttgccccacccctaatctccagactgaacccagatggagatctgagtgccaaaacaattcttgatgtaactttgtacatatcttctactaccgttgggggctcttggggttagaggtgggggcggctctgtgggccattgc

SEQ ID NO: 91980 - DNA, 1060 bp, Homo sapiens
catgaaacggggattcatcctatctttggggttcaaggaaagcttccaagaagaagaaacatttgagtgagaacctaaaggacaaaagatattgactgagggggcccgggcgcggtggctcacgcttgtaatcccagcactttgggaggccgaggagggcagatcacgaggccaggtgacccagaccatcctggccaaaatggtgaaaccccgtctctactaaaaatacaaaaattagctgggcgtggtggtgggcacctgtagtcccagctactcgggaggctgaggcaggagaatggcgtgaatcggagaggcggagcgtgcagtgagccgagatcgcgccactgcactccagcctgggcgacagagcgagactctgtctcaaaagaaaaaaaaaaagaaactgactgaggggaagagaagctgccaggcacagagcatgcacaaaagccctaaggtgggaaggagcagggcacgtttaaggaacaaaatatgcactgagcctgaggctcacggaggaagatgaggaagtgaagctggaaaggtgggtggggccaagtcacaaagggtcgccaggctggagtggagtgcagtggcgcgatctcggctcactgcaagttctgcctcctgggttcaagcgattctcctgcctcagcctcccgagtagctgggactacaggcacgcgccaccacacccggcgaatttttgtacttttagtagagacggagtttcactatgttggccaggatggtatccgtctcttgacctcgtgatctgcccgcctccgcctccgccttccacagtgctgggattacaggcgtgagctaccgctcccggccgcaaagggtcttcttatactgagaagtgtccagaatttccatcctggaggcacgtaggggcaacgggcaggggaggctagatgcttgccttgagactacattaacaaaatgcttttcacatggtcaaaaaaactggtttataataagcaaggtgcggtggctcacgcctgtaatcccagcactttgggaggccgaggtgggcggatcacttgaaatcagg

SEQ ID NO: 91981 - DNA, 1268 bp, Homo sapiens
agggttgtcccagatggaggcttgtgtggccctggccggatcgtgcgtggggacaggctgggtaggtgtgtggggtgaaatggaggaaatggtgggtgtgtaaagctaggtgggagaatgtgaggctaggacaggtgtgtatgtgtgtgcgtgtgtgtgtatgtgtgccctctacagcctggatgtgtgacattagggatcaggaatatgacagcataggggggtgtatgagaaagacaggggacaggggctgggctccatgtttgagaccctccagcgggtacgtgtgacaaggaaaggtgtgtgcttgtcacccccaagggggctgtggcagagtgtgacacatgagagggtgtgtgtgacatgcaaggaggtgtgtgggggacaccgaatgggctggctctgggtgtcagccagaagaggccgtgtagatcagaggaaaggggtccagtgtgtgtgacacaggcgtggctggtgaggggatgtgacaagaaaagggtgtgggtgtgactccagagaggctgtggctgggtgtgacacatggaggtgtgcaacagtgacatcagagggggtgtgtgcaacagggaaggtgggtgtatgacgagggagaggctggggcttgtgggtgaaacgcacgagggtgtgtaaaaaggagaaggaaggatgggtccccatgtgacagggcacgtgtgcatatgacacccagctgtgtgtatgggtgtaacaaggagaggtgtgtgtgtgaaatggctgagtgtgtgacaccagagatatggggatgattctgcatgtgtttgacaagggaggctgtgtgtgtgtccgtgtgtattggagattgccgaatgtttgacaccacggaaggcagtgtgagggaagagaggggctctccctgggtgtgtgacccaaggaggtgtgtgtaccagagaagaaaagccgagctgggaactctaggtgcatgccctgccgtggggggctcagggaagaggtggggttttttggggtcctcagagccctgtcctctagctccctggtaggagggagaccccgcagcggacaagcccctccccgcggtcaccttgccaaaatctccacttcctctggccttttcctccggatgggagagggatggcttcaggcagagtgcaccctttcctctccgccaggcctggcagtgggtggggtgggggcctcctacctcctccctacagatgaatacaagccgactttcttcctcccatcctagccctcccccacctccatccaggtgg

SEQ ID NO: 91982 - DNA, 1073 bp, Homo sapiens
gttcttttttttttttttttgagacagagtttcgctcttgtagcccaggctggagtgcaatggcgcgatcttggctcactgaaacctccacttcccagattcaagggaattacaggcgcccgccaccacacccagctaattgtttgtatttttagtagagaaggggtttcactatgttggccaggttggtcttgaactcgtgacctcaggtgatccacccgcctcagcctcccaaagtgttgggattacaggcgtgagccaccgtgcctggctagcttggagtcttcttcacttctcccttttgtcttacttatatatggtctagcagatcgcattagctctgtcttcaaaacacatccagaatccaaccatgcctcaccagctcctttgctaccactctggcctcagtttgtctcctgctcttacctggtttgttgcagtggccttccaggtgggctctctgcctctcactgttagggggatactagtagaacagaagtcaggtcaggttgtttctcctttcaaaccctctcctggctcccacattacactgcaaaagtcttcaccatatccacgaggccccaacctattgggttcctcctcctccctcccctcaactcccatcacttctctcattcccctggctcactctgctgcagccaccctggcctccccgctgtcatttgaacatagcgaacacattgccatctcagggcctttgtactcgctgtccctgaacgcactgccacctcagggcctttgtactcgctgtcctgtccttctggatcaggtcttttcaggtgtctgtgtggcttcttccacacctctttcaggtctccgctcagacgtcagcttcacaaccaggcatttgctaaagtactactcaagctaaaataactcctgtcactgtatggcccttcacttggctttatttttcttcataacaccactacctgatatagattattattattattttttttgagatggactcttgcgggtcacccaggctggagtgcagtggcgcgatctcggctcacggtagcctccacctcctgggttcaagtgattct

SEQ ID NO: 91983 - DNA, 1355 bp, Homo sapiens
gtgggtgacaaggaagttcccccagactacaccagggctgccaatcccagtggtccccaaattgttatataagaggctttcacaggtggtgactggaacaaggggtccgggtacagggaggggccttgaggatgtgctcataagcctctaggacagtgcagtttttggaattgtgtgttttcgtactctgtggctctcagaggctgctgtttaccctcaggtgcattcttggcctctgagatgccacggttttaatcctccctcctcaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcagtgagtcttggaggggtgggcagctggggcgggtgggggccctcccatcatgcaccgcggggcccatgctcggtcctgtggggaggatgactgtccttcgcccaccacgtattcttttttttttgagacaagagtctcactctgttgcccaggctggagtgcagtggtgcgatcttggctcactgcagcttccttctcccgggttcaagcgattctcctgtctcagcctcccaagtagctgggattacaggcacgcgccaccatgtccggctaatttttgtatttttagtagagaaggggttttgccatgttggccaggctgatctcaaactcctggcctcaagtgatctgcccgcgttggcctcccaaagtgctgggattacaggcatgagccactgcgcccggcctctgagcccctcttctgtacctttgtgctgggtggtgctggggacatagtggtgaccaagactatcttggcactgccctcctgggactctgagtccagggagggaggcagatgtgtttgcagacagtgaaggctctgggtggggtacctgaccctgcctggtacgggaggggtgttcttggcaaagggagcagcatgtgcaaaggttggggggaggtcgagctctatgtaggcgaatccaccttcatggggtgcaccttttgtgctagcccctccctgccactcacgtagtgcccagccctgggggagatgggtgctaagtatataaccacttgagtatatcattacagatggagatgagtagggcaggaaagggagcctgtgctgtgggaggctgtcacaggactccactggggtgtagggtgggtcaggcccaggggctggggaagtgttgtaggcagagggaacagcctgggcaaagtccttgtgttaggtgggaatgcggtgagaacaaggga

SEQ ID NO: 91984 - DNA, 1233 bp, Homo sapiens
gtttagaattggaactcacatggctgtgttcccactccttcacccgcaccagggggaggagtgtgtgtgtgtgtcctgtgcgtggtggggtcatgtcctcttcgtgaggtgcatgggggtgatgtgaccacatccctcctcacacgtcgcaggggatatgataggaccctgcccctccccatggggtcagttgagactgatgagccgtgtacccccttccggggaggtgaaatgatgaggcgtcccacccccatggagtagtgggaatggggccatgcctctctctccagcgctctctccgcgtcttccccagggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggaggtgagcagcgggggcccggggcggccagcgaggcgcggacctcggcctcagcctggacctccgcgcccctctcccctcccggcagctcgaggaggcgaaggcatcggagcggagcctgcgcgcccggctgaagacgctgaccagcgagctggcattgtacaagagggggtgagagcgaggcctgccaggcgcctgggcggatgggcgggccctgagggtgtggaggctgatgaggcggagcctaagggggcggggcggggccaggtagggtggagggggcggggctgaaggggaggcggggcttagcggaccccgtctggagtccagacaggatttgggtgcagtggttaggaggtggacccgggctgtgcggagatgcgcaggcttggggcggcgttcaggagggactgggaaagggatcgtgccctagggtctcctggtgcgaaagggtgcggcgcagcaggtgggatcagggtgaggtccgctggcatttatggggtgggtggtggaaaattggaaagagtttccggggagttgtggaagactccggaaagaagggtctgttgaaggcggtgtgttgaaaggatgtaggggaatgacagaggggtgttttaggggtccaattgggtgaggtctgggggggaagatatcgagagggtcatgggcccaggagtgcacgtctaggagttgatggggtaggcctgagggt

SEQ ID NO: 91985 - DNA, 1056 bp, Homo sapiens
agagaggaagggaagatttgttcaaggtcacacaggtagtcgacaatagggctcgacgcccgggtccggctccgcgtagggcatggcgctgccttgcaaaacagccacacccgccagcgacattcacaacccaccccccaaccctagaggacagcggggaaatcccactttcagaaccgagaaactttttacagccttggaacacggtaactttgggaggagaggccacaccaggtctgtttccccgcgcgccccttctctcattccctattggctctctctaccaggggtaccgtctggggaacctctggtcaccttgtcctccgcgcgctctgtggcgaaagggacctgcgcaggcgcgtgaagggcgccttcagggcccgcgctttacgacacttgtgcggcagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaaggtgcgcccgcctggcagggagggtggacagtggcccaggctgaggggtgccgggcccgcgcggaaccatagcaacgcggagctgcagcctgggcgcggggcagacactaccaagtgaccgggcgtggggaggcccaggatggcgctgccaaggagcgacatagggggcttcggagagtgatacctaggagtggcgtgcggagcgggtgctactcagtggagagactgaggagggcgccaccaattgtggggcgagagggggactggaatgagggcgctaccaaacgtgaggcctgtagagggcgctaccaggcagtgacatgtggtgggggagtgattgatggcgctaccaaatggggagtcctggggtgggtgccgccaagtggggggtagagggggcacagccccaatagagaaggcaatcgtgggggtggggaatggatc

SEQ ID NO: 91986 - DNA, 1021 bp, Homo sapiens
cgacctctcctccttggccagatgtcacatcctgtcactccacacttagaacatcagtgtccagacctcactgtggctgcccggggcccagggatctgtcccaccagcctccctgcctcatctctcctccccctgcccactccacccagctgcctcagctctcactggccctcagacaaggctcaaccacctctgggcctctgcacctgctcttcttgctatcggagtgctcttccctcagtctgctgctagtgcccagcttggggctggaggggtgggtgggcgggtgtgtggagtcctggagactgtggccgagaggacaagccctgagctaggttggttgggacaggcaggaggggcaggctgaagagatgtctctgggctcagggtagccctcagcttccccatctgtgaacagggagactgggcgtcacccagcccagggcctgtcctcgcagggttggagcactgcctcatgcctcttcttctgtctccgcagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtgagctggggagtgggccaggcctggcacctgagccaggcagatactgagggctgggctggcggggacgggtgtgaggagccattcactcctctacttaccactcagccagccagcaagtgcctgtggggccttgggcccaggccagagtacccaggccacagctctgctcagccatctcacattttgtgaccctgagccagttaccccgcctcgccacaccttcctttccatatccgtgaaatgaggagaacaagaggatcagcctcaagggtagcgg

SEQ ID NO: 91987 - DNA, 1157 bp, Homo sapiens
ttattgagcatctcctatgtgcccggcactgtcctaggcactaggggtacagctatgaacaaaacccttcctgtccacatggagccgatattctaggagggagataagatgatgaataagtcatgaaatgaatagtgctaagtgccataaaactgaatagagtaaaggggggtgggtgaaggaagacagggaggtcaggaagaggcctctgggccagacctgacccaggaggggactcttcactcactctgtcccgctctcgacctgtgtgtccacacccaagttttccccatccctgggagcgagacccccttctccctcatagtggctgtggtcactgactctcgtgtcccgttgttcacaccctagccattgaggatgagtacagcggacccaagcttgaagacggcaaagtgacaatcagtttcatgaaggagctcatgcagtggtacaaggaccagaagaaactgcaccggaaatgtgcctaccaggtaatgcatctgtcaggtactgggcacccgggaaccctgggatggcatcacagcactgccagccgcgggcactgagcaaaacgacaggagaagggcggccatgacagccaacaccaaacaggagtcgtgtgccggacactgtgccgagggcttaccacatgatctcatctcgtcccacagcagtttggggaggtggcaggcagtgccatttgacagatgcagggacaaagggccagagaggtcaggtgactggcccagggtgaaaggtgaggaagcagtagagtctgttgctttgagttctcatcccaggctcttgggcgtctgtggctgctggttgttgcaggttgtttgggacctgctggttgctcctagtcctgagaccaccccctccccgacctaggagggcagctggccacagggtgttaactggttgagtgagactcaggctctggtatcccatctggacaaggccccctgccctgacctctcagggctacagggaccttaccatagttttggggaactgctgagatccaccacctcctgggttggttatgaggatgcgggacttcttgtgagtcaggttgacaggcaggtgactcttacaggagtgtgcaggcaatatgggaagccgccatttgataggtcctagagagccaagtggcc

SEQ ID NO: 91988 - DNA, 1092 bp, Homo sapiens
cagcagttactgagaggacaggttaagaacagggcctggcccacacctgatgctatctaagtatttccccgtgttatggtatctgctcgatgaacggccacttgtagggccactaggcctatgcattgttgagtgggagggcccgtgtcccatctcccccatggctccaggcctctctgaggagagctgaaggaggtggactgactagtccccgcacctccccgccactggctttccgggagacaggaggcagggtcctcagtgccatactactgaggctcagcggccaagctctggctggagccacggtgaggaaaggattagaaacccagatcccttgagccctgccaagtcctcactccctgggaggtgctgacaggaggcttgaggccaggcaggagcagcccatctggcccatcttctgccaccacccccaaccccaccgcaccgcacccttcccctccacgcttgccatgttttcctcagcaggacagatatttaatggtgactttgtggaccgaggctccttctctgtagaagtgatcctcacccttttcggcttcaagctcctgtacccagatcactttcacctccttcgaggtgagctgggaagtgacaaggtttgggttcattgtggggtcctgagtggggcactcactctgcaaggataatagttgcagctgtatttattttgtggactcggagatcatgcacagggcgaccttttaagattgagtatgtagtgcactgcacaaaagcatcacaccaaaggacgcgtttacatcatagatagtgtagaaatggatgtttactctgaccatttttcagcagatggcaaacaagggtgtgaggatgggccccttattctaatttgcacaagggcatgaaacaggctcctgggtggccctaaatctggcactaaagctgagtgactgagtgaacagaccagggctcgagggtgggagtaaggagactgttgacgaggcagttgtgccccctcagattcaggcttggtgtcagatttgggttctcttgattgaagtagagcccggagctgagtgtgctggttcacacctgtaatcccagcacttt

SEQ ID NO: 91989 - DNA, 1075 bp, Homo sapiens
ctggaaacttgcacatttcggatggcaggtttgggaaccgctgcctttcaggaaaggtgctgacgtgggccactgccgcttcgctgggaagcaatgggcccagctaggcccggggcgcggccacacccctgtgggggaggggaaggaggccgccccgaagggagtggacagcccccctgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccc

SEQ ID NO: 91990 - DNA, 1108 bp, Homo sapiens
aggtgacacagaaactagcagagatagccccagacatcgtccctctgccctacccaaggactggcctgcttcagtttggagccttctagagcttcttgatgaggcctccagggcaatcgttcccttcactcggcctctggggctctcactgatgagatgcaaacctgtgccaggcctcaccagcgctgctggtttggggctggggcaggcttttctcccgcccctgtggctcccacatgctgagttgagattggaagcccgtgggtctgggcagcttcatcgggccgtgcgtccagcaggcctgagtgtccagcccaccctggtacccagctttctgaatcaccagactttatcatcaggcgctggctctgcctcagaccctgactctggcatgctcctccctggcccggcgggaatggcacgtggagctggcctcactggggccgagggtctgggctgagtgaggaagatgcgtccgtgctgtccggcctggtgactgactttccccttcatgcttttacaggctgaccagctgactgaggagcagattgcaggtgagtctgctatccccctcatcttagctcaggaaagcctccacatccccagccaaatcttagccactgaggagtgacatctgatgggtgaacctgtgtatcccttgtgtcacctaacactatgccttgtgcctagaatgctgataaatgtgtgtaagagcacaccagtgccccaatgacacgaagccccatggccctgagacaggcctttaccagacaccaaaggctgtgttcctctcctgggcctgggtcatctaggggcttgatatcagtggctgcaggacgagcccaactctctctcccagcttcagccaggttggcttagaaggtgagctccctgcctccctgtggggcctgcagagctcctgtcccactttaggagccgcccaggagctggctcgtcactcccacctctgcgcttgcctgcgctttgcacttcctttcgcatgtgcctgcgcctgcctgttctgctggcggaagtgcctccccagtgctttgcatgggcagctccttcccgtcccttagctcagatgtcccctcggggaggccttccc

SEQ ID NO: 91991 - DNA, 3459 bp, Homo sapiens
gatgcctgcatttcctcttcaggccggccagaggcattctgcagcctcccctcctcgtcccagccagccaaccctggctaacacactcagacaaagaatcctttcggctctcattcactccatgactttggttcatttcatcatttcaagggagaagtcaaagccagggaccaaacagaaatgtagaatcatctaaggacagctgtcagaccattttccccactgtcttcactggctggccagaaaaatagcttcacctagcacagtgttgatgttcaataactgttgaatgaaggttggaagggctttgccctgagcactgaggagagagagctggttgcgtgggacttgaagtctgtctcagtttctttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagttggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctctctcagggtgatggatgagcccgtgtctctcagggcccaggccaagagcattctccatcctttccccaccttccagggaacgggaccattgacttcccggagttcctgaccatgatggccagaaagatgaaggacacagacagtgaggaggagatccgagaggcgttccgtgtctttgacaaggtaagcagccctctccaggggcggctctgagactgacgccagccttcaggcagacaggcggaactggagccacggagctaccacttccaggaggtccgggtcccggtgccagcctcattgccaacctgctctgccacctcaggcagcctccctcactgtgctcactgctgagggatggtgatgacagccacccctctcactgcctctctccccaccgggagaagtgcccagtgaaaggctttatccccaacccccaggatgggaatggctacatcagcgccgcagagctgcgtcacgtaatgacgaacctgggggagaagctgaccgatgaggaggtggatgagatgatcagggaggctgacatcgatggagatggccaggtcaattatgaaggtgagtcaaggccaggcttgatctctggaacaagaagagaatcgcagcttcaggaacaagcccccagatccctcttgttggggagggccgctcgccacttagcctgcccgcctgacctcctctctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctgatttggctcctctcctcctgtctcagtttctggcctgcccccctccaacacacatacacaccaaccccagcactgactcctttggcccagaggtggaagagcctctcctcaaagctggctctgaagctgtgtccagtcagtgcagcccagtggacgcctctgaaccacagttctgatcccagctagatcgcagggtcatcaacggcagggtcctgtcctagagatagtcgcacaaatggactgaaaggcggggactgagaaggctcctctgaggcaggcccatcatgccatgggagcacacagagaaggggtcagcccagtcaggtggcaggactgagctgagacctacctgaaagatgggcagtcccctagccgggtaggggaaggacggaa

SEQ ID NO: 91992 - DNA, 1054 bp, Homo sapiens
cccagagcagcaacaggtaggaagctccggtcccggccccacagctggtccctttgcctgctccgtggccaccgtctctccgcctgggaatgaatgagtgaatgagtgaatgagtgagtgaatgaattcttctgcgtctccatcagcctgtctctcgccttgttcctctctcccactttctgtttccatctctccccaacccctccatctccctctttgtccttcccttctttcctctgtccctctatctccccgtctctgttcctttatctccttggtgtctctgctccttcctccctccccccttcctccatttccccttctctctccttcgtccctccctccatcaccccatcctctcccaccccatccgtccatctcctccatcctctcccaccccacaccccctccctccatctcctccatcctctcccaccccacaccccctccctccatctccccatcctctcccaccccacaccccctccctccatctccccatcctctcccaccccacaccccctccctccatctccccatcctctcccaccccatccgtccatctcctccatcctctcccaccccacaccccctccctccatctccccatcctctcccaccccacaccccctccctccatctcccctgctctgtcccctctgtccctttgtcccctcggtgcctgtcgccttgtatcaccctgttccttgctccccccttcatttgtccctctattttctcctccatcacttcattcctcccccagtctctccctctctctattcctccccgtctcttcatttctcccgtgcctcagtctctccctccattactctgtctctgcctctgcgcgtcccgttgtccctctgtccatccgataggcctctcctcaggtgcccgagttgggctcccccagccctctgccctggctgctaatgagcagaggaggctttgaggtgaccagggctagggtgggggggctccctgagggtggcggagagggcagctgctgccaaggccctaatgaggccccctctgtgcccctcccgccgcg

SEQ ID NO: 91993 - DNA, 1278 bp, Homo sapiens
cgaggagcgccttggctcccctcccctcttccgcagccgggcctggggccctggcacgtccggcgcgcctgatgctttccagatgtgggcttggtttccctcctttatctggccccgttgagcccgcaaggggaggggggaggggagctagggtccgagacccaaatctccaccagggactcgggtcggggtcccctccccgcccgtctcccttccctgtccaggcggtgaaaaccgagttagggtgggccgactgcagtaaagatgctcctccccacctccacctcttcctagggctcccgccttctccaggtccagaaagaaccccaagccccgtccatcgggacacgcccccaggtacaccgaggggcacgcccccttagaaaccccgccccggacccctccccttcggtcgcgcctctgcaggccccgcctccgtcgtcgggtccccactggaaggcgccctctgtgcatctctttgtctctctggccgcctctgcctccatctctgtgtgtctgcgtcttcgtccctgtctctgagtttcggcttgggtgtctctctcctaccccggtctctctgtgtcctgtctgtctctgcctctcctgtccctctctccgcagcgccctccccgtctctgtctctctgagtccctagctcgctccttctctaaatctgtgtccctatagccccctgcgtctctctgactctccctgcatctccctcccctgtctgtgaatttctctgtgtccatcttctgtcctctccctccggtccctggctccctgccgtgcttcctctggtcccgagtctccccttcatctcccgcctggccctcctccctgtggccacctcctccctgcggcctctcggggcagggtgggcgcctgggcgtgctgcgcgcgccctcatgtggccggcagacgctgcgtgtgagcgccaaaaggggagtgctggggagcgggggacgctggtgttcgcggtgacactgggaaatggcgtgtgacacctggaggctgtgtgagtgtgtactgccgggagacggcgtgagacatctggagagtgtgtgagtgtgtactgccgtgatggtgtgtgactccaggagatctgtgagtgtgtactgctgtgagatggtgtacgacgccaggaaactgtgtgagtgtcgactgccgtgagatggtgtgcagtgccaggaccaggacaccatgagtgtgtactgccatgatggtgtactggtgagatggtgtgtggtgctgggagtctgtgtgtgactgattgat

SEQ ID NO: 91994 - DNA, 1003 bp, Homo sapiens
tttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacatatgtggtggactctcactgaatgattaaatgggagaaatgctctttttcctttggactaacatttattgagcaacttctgtttgctgtggatatggcagtttccagggaggtcccagggtgaatctcaacatcatcttcctaccattggctattttacatcaaggaatctaacctttgattgggttatgtttggttataaatacgatttcaggcgggatgtgatggctcatgcctataatcccagcactttgggaggcaggggtagggggatatcttgagcccaggagttcaagaccagcttgggcaacatggtaaaaccccatctctacagaaaatacaaaaattagctgggtgtggtaggtcattcctgaactatcagctgctcaggaggctgaggtgggagaatcatgtgagtctgggaggcccaggctgcagtgagccatgattgtgt

SEQ ID NO: 91995 - DNA, 1129 bp, Homo sapiens
tgagaggggggtggacccggaaacagcctggcaccttgggggtggagcccagtgctggggcgggcctactggagggatgtggctacaggaggagccgtcctgtaaaagatgggctgggactcaggcctagactaggttacttgggctggaaaccaagtgccccagaagcgctgaggacacttggaaccttaggggggctgagtgagacttggcttgtctagggtgggaccaggaaagggactggacttgagggtaccaaagggctgcggtgaccaggagaaggggctgagcctcccaaggcattggctgggacctggagcctttgggtttacgaccccaaaagggtcagccttgcaaaaaggaggcaccggtgggtagggttgagaaacaagggcatggctactttgctgtgtactggggccgtgacttgggtgaagatgggcctgaagcctggggtcggttcagtgaccaagggagccagtctagggacgtggccgtggagggtttccgaagaggtccaggaacagggctgaccctgagtcctggaagctgggagtggatgggagtggggaggagaagggagccaggactgaggcagacattgcactctgcattctggggctttggtgttgtggctgggcctgatgaagtggcaccgggcctggtgacttgaacctacttgggaatgggtctgtaactttccctgcttggaaaagttaagtcctaaggcctggagctttgaggctgggtgtgggatggcatgtttagagggccagaggcagggctaagatactggggtgtgtcagaagccaggagaacaagggacctgtgttggagccagggagctcaggaagacagatggagtatgggaaggggggggatcattcattcatttatttataaccatttattcaacaagtacattcatgtatttgtaaccattgattcaacatgttgagtgcccacgatgtgccaggcattgactgttccagctctgggaatactgtgatgacttggacagaaggggtcaggtgcagggtagctcattgagtggtccgcgaagggtggaaaggggaagggtcctctctggagggtgcggcttcatggagcaggtggagcagggtgacac

SEQ ID NO: 91996 - DNA, 1049 bp, Homo sapiens
tctcatccccctttccacatatttgtcccttccaggggcccagtgttggctgtggctatgggcagcaacagtgaatactgctacagtggcggggcagatgcctgcatccatagttggaagattccagacctcagcatggatccctatgatggctacggtgaggacaacgcctcccgccttcccctcacatccactggggcctggccgtcccctccacgcacacacacgtcgcgtccacctcttgccaacactgcaggcctcaggagtgcgtgtgacggctcccctgtctgctctgttgtgagcagcgcgatgcagcgcgtggccaagggacgagccagccgggatgggaatgatggctgtgggaggaggtggtgaagctgcctgagaatctctgtgagccggcgtccagaaggcagtgctgaggcagcccaggctgggagcagcccatgcacaggcgtggctggccctggcagcctctgctctgccatgccgtgtactctgtgtgtggggatccgccagggtctctgcgtggttgaggggagggcatgtccagagaaagcagagaaggtggagttagctgggccaggctggagcgcgttggggctttctctttggagcatctaagacctaagtagggaagtgaccagactgtcacttctgttcaacatctgtccccctgttctctgccttttttttttttttttttttttttttgagacaaagagtctcactctgtcacccaggctggaatgcagtggcgtgatcttggcttactgcaacctctacctcctgggttcaagtgattctcgtgcctcagcctcccgagtagctgggattacaggcacgcaccaccatatccagctattttttgtatttttggtagagacagggttgcaccacgttgaccaggctggtcttgaactccggacctcaggtgatccacccaccttggcctcccaaagtgctgggattgcaggcatgagccactgcgcccggctctgcctccttgatcatgcacctggccctgtgctccaccttgtctgggcaga

SEQ ID NO: 91997 - DNA, 2376 bp, Homo sapiens
tggtcccccccatgcaggtcagaggctggcccctcactggtgcccgagaggtgtcgccaaactcagcctggggggctgacatgtggaaggggtcagccacgccctggaggagttcacagtgggcagagcttggccttggtgacctagggcaagtgggttcctgctgctcagcctgtctcctggcctgtaatgtgggaatgataatgacagtgttcacggtagctgttcgcagggttgggggttaagtgaagtcgtgtctgcgaggggtagtcagtggtcattcagtgagtggaatttgctcttgtgccagcacggctgctggtgctgtgtttatcgctgcaatgctgtggtccattcatcctcacttgtttgcacctccgtatattcacacacggacaccagtgcatatctgccctccctgcaggcagattgttgcattatctgacttttcttcatccgaggcaccttgctgggggactggagcaggctgagccctggctaggggaaggactgcgtgagggtggggtcaggccgaccggccctagtggtagcagctgtccaaggcccagcagggggcgctccagggcagctggctggcggctgaggcagccccatgaacagaaacgggcccagagccccggcttacctgttcctaggcacggaggtggcttagtctctggacaagaggccccctgacttgtctggctttctccatgtgccagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctgggtgagctgacgttttctggccagcccccgcttgccttccccaccgagggggtgggagcaggctcagctgcccgcagctgcttcctgtacagggtctctctaccggacggatatgtttcctgagaggagggtagccaaggagagcaggaggcccaggtcatggccgccggcccctcaccccttccctggaaaatccccatggagacgcaggcagtcctggctcttcctgaagtggggccgccagccctccagggcgggcgtccagctctggctggcctcaaggagggaacaggatgaggacccagtcggggagaggcaggtgggagggccgcatcttcctccctgtcctgtgactcctagctaggagggctctcaggatacgtgggatgggtggctggggcctgaggcctaggcaaggcagtgacctgcccactgccccacggaggggcccaatcaacctcctctcctctgcccattccccccctcccccagggccagagcttcacagccccacagagtggcagggggccctcagtgtggggaaggcgtcacctatgccagactgggttggaactgctgggtgactccggccctatgcctcgaccctgcagaaagccgtcgggtcaaactccaaggcattctggctgacctgcgggatgtggatgggctgcccccaaaagtgactggcccgcctcctggcacaccccagccccggccacatgaaggtaagaggcaccccccacctggtcccagtcctgcgggcccatggcagagggaggctgcagagctgagcccagggcttctgtgtcttcagggtcgaggcccagcctccagtctgcagcctccctgccccaaaagttcgtctgtctgtctgtctccctctctttttgtctgtcctgccctgtctgtctctctgtctctttccagctgtgattcttcatcttgtcctctccccgtctctctctcttgctctttatctctttctctgcctctctctgtcattctctctctccctggccctctctgcccctccctcccctccccctaccaggttcctttggcttctcctcagacgtcttcatcatggacactatcgggggcggggaggtgagcctgggggacttggcagatctcaccgtcaccaacgacaacgacctcagctgcgatgtaagttctccgggtgccccccacactgtccccattggcattgcgcccagggccagcccctgcaagctctgactgggtgccgcccgtgccctgctcatcctgtttcacagaggggtgcagatgtagacagtggagggacttgactgcggtcgccaaggcgcagggcctggaagactctggagcctgtgttttaatcacagttccacggctcctccactctgcccctcccaccctggtgatttggaatgcaggaagatgacctgtagccaccccctgctctgccaagtcaggccaatctagtgtgaatgggcagctgggctgaaatgaa

SEQ ID NO: 91998 - DNA, 1596 bp, Homo sapiens
ggtaagaatagtgggacgccacctccaccagcagccttagggacagcacctgccagagggcgtcaggggtagtccagggcggtgaatgcccaccctcctctccactgccatccctgacccgacttccccccaaaggcagccaccaggtgaggcccaggctggccccattgttatctcaggggttaagggctccccttcggccctcgttgtgggtgacgtggcagggggccctggaaacagatccatcctgtcctctcagtgctccctgaaccctggcttgggatctttgtgcctgaggaagtggctgctgcccattactgtggggtgactgtgggctggcactatacctgggtgagtgatagacacaccggcattgagcctgagccccattatctccctttgcctcctgtctgccctcccaggctcaggtggccttccttcagggagagaggaaagggcaggagaatctaaagacggacctggtgcggcggatcaagatgctagagtatgcgctgaagcaggaaaggtgagccttcatcctgccctgggcctgccttctgggtccgtctcaagcacagtgtcaggaggccaccagccacgcctccttccagctaagggagatttggggtcgacattcttttccatcattccagtaccataagattctaggggagaaacaggacagagtaggtgggatttgggttagacaccaggaacgatattcacgatgctagtggcccactgtgcgccaaatatcgtatagtccttacctccgttatcccttataccttccaatagcctaacgggtattgttagccctgtttcagataaggaactggggtttcaagggctgatggtttcctcaaggacccctgagagcaacctaggttgcctgactccagggagtggtttcttccaccaggccaggggtgtggggggatgcttcagcctcagtagtagacgagctgggggaggccctgtgatttggggtttgggattctggattccttaggtaactactgaccctgtctactctcccgcatctcttattcattaatcatttgctcttttagggccaaatatcataaactgaagtttgggacagacctgaaccagggggagaagaaagcagatgtgtcagaacaaggtacccaccctctgatgctcgcactgtcggcaccctcccgcagaagctgagtgttctggagaagcaggaagatggggtgcctctttctcactttgctccttagaaggcagaatcggccccggggctggggaggggcggaatctcactctcagagccctccctatgggctgccaggtcccgtgctggaccctgggggccagtcccgcttgggtccccctgtgcaacagaggcagacacacgagcagctcacgggatccctttgcgaggagtgggcgccagggctatttatagagtgctggggacggtgcgggaaagccggggaagacgtcactgaggaggtggcgtttgaacagggttgccgttcaatcgttcatccaaaaaagactttatttgtagggtacaggctttgtatcacagatcaggaatacagcagagagcacgggagacat

SEQ ID NO: 91999 - DNA, 1011 bp, Homo sapiens
tgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttgga

SEQ ID NO: 92000 - DNA, 1343 bp, Homo sapiens
gcctgggcaacagagtgagatcctgtctcaaaaaaaaaaaaaaaaaaaaattctggaattaattattggcaatggttgcacaagtctgaatatactaaaaaataccaagatggacacttttaaaaggttaattttatggtaggtgaattataattttttttcgagacacagtctggctctgtcacccaggctggagtgtagtgatgtgatcatggttgtgatcactgcagcctccacctcccaggctccagcgatcctcctgccccagcctcctgagtagctgggactataggtgtgcactaccatgcctggctaattttttttttttttaaatatatataaagatgggatctcactatgttgcccaggctgactccaactcttaatttttactttttagattccagggggagagaggcaggaggcttaggccttggccctttccttccctctcaccctctcccctcccgcttactttgctgtcatttctacccctttagcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaata

SEQ ID NO: 92001 - DNA, 1306 bp, Homo sapiens
ccaagggacagactggggacgtgggtgggacttcggctgggcaggtggtatgggcaggatctggtgggcggggctttggctgggcaagtggtatgggcgggatctgggtgggcggggctttggctgggcaggtggtgtgggtgggctctgggtgggcggggcttcaactgggtgggtggtgcaggtcagacctggagggtggttgggtgacagggctttgcttaggcaggctctggtggggatccactgggtggggtgggtggggctttggctggttggggtggggtaggcgaggcctcacctgggctggacctggagggtgggcggagccccggtcagcaggttaacctaactcagctcccccatcccttgcagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctgtgagtgtcagggggctgcggatgggacccccggacccctgttgacccccatcttctcccacaagacaggcatctgcctaacctcccaccttctccctcagggtcacggccacagcgtccagcgtgggggcagcgggcatccctgctggaggtgtcctcactctggccatcatcctcgaagcagtcaacctcccggtcgaccatatctccttgatcctggctgtggactggctagtgtgagtgtgggtctggagactggggcagggccaggggtacccctgggaaagaggatgagtgagtgagagtccttagagcctctggacagaagaggaagagaagaaggaaggaattctggaggaaatggggggaaccttgagcattcctgagggcaaggaatggcatctttgtggctctaagagggatgtcagaaaagtagagcgtctgtgtggtgaatacagcagactcttcagccagactgctcaggttcacatcccagctccaacattcactgttgtgacctcgggaagtgcttaatcttcctgcgtctcagtttctccatctgtaaaacggggagaagaacagtctctccctaaggattagataacagacacacctcccttagagcagcccccagtaagcagtaattgctacataattatttgctatcacgattaagctattaagagtataaagattggaaagcagccaggcacggtggctcacacctgtaatccca

SEQ ID NO: 92002 - DNA, 1227 bp, Homo sapiens
tttttttttttttgagatggagtttcactcttgttgcccaggctggagtgcaatggcatgatcttggctcacagcaacctctgcctccctgattcaagcaattctcctgcctgagcctcccaagtagctgggattgcaggcatgcgccaccacgcctggttaattttgtatttttagtagagacggggtttctccatgttggtcaggctggtcttgaactcccgacctcaggtgatccacccacctcagcctcccaaagtgctgggattacaggcatgagccaccgtgcccggcctgcacggagagttttatctccgggctgctctacctttgaggggaaagagagcatgagattggcatgggggcttcaggggccaggcctgggagtggtgcccatgctgaagcacacattgctggggcttctcctgacctcaggaaggcaggaagatgtgggtagggtgctgagcctcacgcctggccactgggcccgtggaagaggcaacaagctgtctcctgtgttactgatcaggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccaggtacggccttggggtgggctagggtgggatgtttaatccgctaagcggcatggagcggatgaaattttctctgcccgggacattgtatctgggtacaggggccatacttcaggagattctcataaggtcctggatttatccccacccttaaaaagataggaaatgattgccctagagatttatttccctctttcttacactgcctccccgtggccctggaggcactcttttttttcttttgttttaaacaatggcgtctcgctctgttgcccaggctggagtgtagtggtgtgatctcagctcactgcaacctctgcctcctgggttcaagtgattctctgcctcagcctcccgagtagctgggactgcaagtgtcccccaccatacccagctaatttttgtgtttttagtagagacggggtttcgccatgttggccaggctggtctcaaactcctggcctcaa

SEQ ID NO: 92003 - DNA, 1080 bp, Homo sapiens
ccctgccagcccgcctggctgcccatccttaactagtgaccctgcccagattattctactctagccacagtagattatggctcttctttgaatgcccaagttgcactcatttctaggctgttgcacattctgcttcctctctgtagatctttctaccacccttctttacctggttcactcctcttgtcctccaggtctcagctcagatgctccttcctccaggaagtcccccctgactgccccctactccccaagctggcactgccctctcttggttcccacactcccctggactcccttattccagccccacctactctgggccatccctgacgactaatatatttcccctggacctggactgggagccttgggaggaaggggtctgagggctgccttgtctctgctgggtcccagtggtgccaaggacaggccctcagtgactgtgcaggtagactgagtgtcctttccaccccgatctgttccttgcccacaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtaggtggtgggagaggaggctgggggtgggtggggttggagggtcggtctgctgccagaggcaggtgcggggcattctgtttgggatggggcaccctctattcactctttggagccagatgacctgcatttaaatccagcattgaccattccctgtctatgtgattttaggcaagtgattttccttctctgcttcagtttcctcatctataaaatgggaacggcactttgggaggaggtgggtggatcacttgagatcaggagttcaaaaccagcctggccaacatggtgaaaccccatctctactaaaaatacgaaaaaattagccaggcatggggacacgcacctgtaatcccagttactcgggaacctgaggtatgagaatcacttaagcctgggaggcggaagttgcagtaa

SEQ ID NO: 92004 - DNA, 1029 bp, Homo sapiens
ttttttgagagagtctcactcggtcccaggctggaatgcagtggcttgatcttggttcactgcagcctcaacctcctcgggcttgagtgatcctcccacctcagcctccagagtagctggaactacaggcacatgccaccatgcctggctaatttttgtattttttgtagagacacggtttcgtcatgttgcccaggttggtcttcaactcctggctcaagcgatctgtctgccttggcctcccaaagtgctgggattccaggcaagagccatggcgccttggccttagctactattttcatcttaaggcagacactgtcacacaagagtaagggtagccttgtaaacacagatgcatattcatgagatatgaagccgtcccttttctccctccccgccaccgcctcccaacacacccagatcctcccccatactctcagagccgctggcaggccctccaggaggaagtggctgatgcaagctgtccagggtattaagtttgctgcatggggtggagctgaggcccggggcgacctgccctggcctgccgtgggaggccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactatggtatctaataaccctctgtgtgtctgtctctgcagaaatatcttcccttccaacctggtgtcagcagcctttcgctcagtgagtcctcaggggtgtcctgaggggatgggggtggacagggagggatgccagccagggggagcccttgctacctgattttggttagttcctggaaaaatgcatgtcaatgagaatacgggctcagagcctcctgtgagttttaattctagctgtgtgact

SEQ ID NO: 92005 - DNA, 2602 bp, Homo sapiens
aacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgaggtcagctcccgctcccccgggaggtggggaagagtgttacggatggcgggagtggtcacgtggacaggacggggctttggggcccctggagcagagacttccctctagagtcttaggaaaactcgacaggatattgaggggaggctccagccctcgggagtgtgagtctagtctcctggggaaggggtttctaaatctgggggcctgggtacataagtggggtcttatagagggagaagaaagtgatttggggagacataggagggtctgcctaggggagaaagacactgaggggaggggaccccaggaggaacttttgcggggggaatctttgcgtggtcaagggccccaagatggggcttctagatataatttggggccagggttggagagtttgggtaaggagcccctggaggatctgagatctgagtaactcccaccaggccctcttcccagccctggggcacccccacaccacgtgtcactcggacataaccaggctctgtttttggcctccgcttcccgcccatttcagctggggtctggccgcttcccctttatcttttagatcagccctgccacccctgcctttccctcccgtttcctcctctgtctgggccaccccctagcaggcagcccagaagaggaccagttagaaaggggagcagattcttttccttctcctggcctctgccccgcgcccccaagaatggcctcccccactttgaggagggcggggggcagaggcccccttgcgcttgcctttagggcttgctcattcagtgtctccacgttggggacttcctggaagttgggggaaggaaatgatgagtcacggaacagggttctccagcctctggggcgtcagtgcaggctgagatgcgagactggggcaggcttggtgtcccgagttgaagcctgggagcaccttctggctgggggagattagctgggtcctggcccagcctgggcctgggtggtacaggcggaccttcaggcaggcacacccactccgaggctgtttatgagcacaggcctcccctgcgtgccaaaacagctgtagctcacacttggcctgccacacaggcttataaccaaatgacatacagct

SEQ ID NO: 92006 - DNA, 1049 bp, Homo sapiens
tggtgaagaggaggctgaaggagccagaggagggggacgggggggacccgtggtgcactagccacccggagcctctgctgaggtctgtgtcccagctcgaggggcatcagagccccagcttccagggtccgggccagcatcctggggggcctcgtctcaccccagggtctcccctcacacaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtctttgagcccttgcctgtctcccctgggaaccagatacctaggatgccttgccttcagtccatcagtcagtcagtcaacaaacgcccctcattgtgctgagcaaggtgagacacccaggtgctcttcagacctgctcctgctcaccaagggcccccaggctggaaggggtgatgggtttagattccaggcacttgctactaaaataacaatactcagctaatgctgaagggcactcaccctctcccaggcattgttctaagcaattgacatgtcttaccttacttaaagctcactagattataagtctgggactattttttttttttttgagacatggtctcactctattgcccaggctggagtgcagtggcaggatcatggctcactgccgccttgacctcctgggctcagttgatcctcccacctcagcctcccaagtagctgggactacagatgtgtgccaccatacctggtta

SEQ ID NO: 92007 - DNA, 1041 bp, Homo sapiens
tagagtagctgctcaggaagtatttgttaaataattgagttaattaattccaggctaagggatgtgactgtctccagaggtagcaggaagtcacagaagggagtggcaaggttgcatggacactattgaacacgtcaggctcccgcccagccccgggcttttgctatctgcttagaacattcctgcctatcctccagctctcagctccgataccccctcctccaggaagccctcctgactctccaggatcagagggggttaggcaccctctttgggctctcacagcccatcctgtccattctggggatgcctgcccccgctgcactgtgagcagggttagggctgtctcggtcactgctgtgaccccagcacagggccaggcacagagctgggcctcgggaccacgtatggagtgaaggagtgaatgttttggccccactctgtctggcacgttaggtcctggcaatctccgttgctgacagcctctctgttctgcagttccggaactttaagatcatttaccgccgctatgctggcctctacttctgcatctgtgtggatgtcaatgacaacaacctggcttacctggaggccattcacaacttcgtggaggtacggcgggagagggatgtaaggtggggaggcgggtgggcagccctggagtggcccccaaggcctgggaaccctccctggtccctcctgagccctccctctgcagtgactgggactctccctctccatttcttttttttctttttctttttttttttttttttttttttttttttttgagacggagtcttgttctgtcgcccaggctggagtgcagtggtgcaatcttggctcattgcagcctccacctcccaggttcaagtgattctcctgcctcagcctcttgagtagctgggattacaggcacacgccacgatgcccagctaatttttgtatttttagtagagatggggtttcaccatgttggccaggctggtcttgcactcctaacttcaagtcatccttctgccttagcctcccaaagtgctg

SEQ ID NO: 92008 - DNA, 1229 bp, Homo sapiens
ggcctagaggggcagacaaagcagggcacagtggctcacacctgtgatcccagcagtttgggaggccgaggtgggagaattgcttgagtccaggagtttgagaccagcaacgtagcaagactctgtctctacaaaaaaaaaaaaaaaaaaaaacagagagagataagaggtggtggaggagcctgggactcggggccctggagctgactccagagttggagacttgtggaagggaagtcactccacaggggtgctggagggacccgggatgaagcgtgtggccaggccggcctggcttgggtctggggagcagccgagacccctggaagtcaggcagcagggaggccctgagccctatctcccctctgggtggatgggtggggccgttgggcagcacccaacccgccctctctgcctctctcacttcctccttctcctcctgctgcccccagatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtgacgcccgctccatgcctcctgcaccccgctgcttcctcgtgccctacttcgccactccctgcccagcttctagttgcaagaaccccttggaccctctatccatcctatatcattcactcaacctgctttgagcttgcttgcttcttcccttcctttacttgtacttttcattgtgaaaaatcataaacatacagattagtacaatgaaagaaaagtagattggagattcgtatacctactacccagatttaatcagtattaatattttgcctttttgttctgcattgttattattaattttttttgcctacgattaaaaaagaatttttttttttggtcaaattttttttgctggtgcgtttttcaaacttcctatagaatgttcaaacacagaaaagtagagagaataggccaggtgcagtggctcatgcctgtaatcccagcactttgggaagccaaggtgggaggattgcttgagcccaggtgttcaagaccagcctgggcaatgtagcaagaccttgtctttattttttatttgattgaattgaattaattaattaattaattaattaattactttttttgagacagagtcttactctgtcacccaggctggagtgcagt

SEQ ID NO: 92009 - DNA, 1178 bp, Homo sapiens
cccctgttcggccaggcactgctgccccaggtcttccccttggactgaatcccgttccctcgtgggccctactacccgcatttcttgtctgccctctcgcagagcctgctgcaccccgggatgcccctcggctggctttctgacccttccgtgccccagctcattcccctgatcccctcggacttggctgcaccgtgcttgcctgttccccttctcagctcttgttcccgtttaccattcagaccctttcctctcttccagacctttctgcctctcagctctgccccttgcccgacctcagatcttgctgcgctcccctcacctgcttgcttctgactctgccttcccgggaagcagcctcctcccccttctctgactctgcaggtctcccatttctgctattcacttaaatgatgtatccctaactcagactgccttcagtttcagcccgtgttctcttggaggtttcctctcttccccacctcctttttggcactcctctgagctactgcattcatttgcttctcctttctttggcctgtctctccttcagttctctgcctgaaaactgcttcctgtcccctctttgctccaattcctctcctccccgttttagcccttagacatgccctttaacctcactatacctctgatacctcccgggctggtcacccatccccttcctgttctgcatctcacagacctgcccctagatccattttgtacctacactttcttctcgtttttttcaattctgctccatcctctttatttagtgtttccctccccagctcggctccttcggagctgtccacttgcccgcatatttttagaccggtttttaacttctgtattgccgtcctttcttggagcggtcctttaacactggggttcttgtcactgtgtcccctctctgttccctcccgagtcttttaagttttccacatgacagtctcttccccccaccattttgattcagccctcacccttcactctgctttatttgcccaccctccactgttctgcctcttgtcttcttttggagttctcactccaattgtgacattacgatgtcttcttaatcattctttcctatgtattcccccccaccttcctcttggagctgcctcagtgctgtgatagattatcactcccctttgatatccctctcccaattc

SEQ ID NO: 92010 - DNA, 1037 bp, Homo sapiens
cctgggtcacttaccaagttagagttggagcttaggactaagctcctgttgctactctttgattcctctctcacctgccaatccccaactgcctgtcatcaagtcccgtaacccagagtctgtgtagggggctctttccctgggagatgcagtaaaatgaactggattacctttgttgtatactttttcagatataaaataaacactgcctgtttttcaaccattcacatggagattactttataatttagggggatggggttatccagattatattagctacataactaaaaccatatacctcttttaaaaacgatatggaatttttcaagctgagtcattgttgacctaggctctcaaacagcaatggtctgaacagcacttgtattgctggcattaagaaatgcaaacaaataattcgtgttcatcttcccaaaacttttgatccagtgctttatcaggcttcatctataaagaattcttgaagataacttttggcatctgtcaatctaattttcatttatttgcttctctgatactgagaaatgccattaagttgatatattagcagagaaccagatactttcagccatgaagtatcattacaggaaagtaatatttattttagttgaaaatagccagacttgcctatctctctcatcttcctttattgaaacgaacattttctttttatgtactttgcagcagttgtgactgttgtattatagatctgcaggtatttcctgcctcttttgctctcctgatatctctgcattcttacttggatgatgccctcgtcctggccactgtagtaaactggtaattgcatttggacaattgagaggcggcttcctatgatgtaaagaacattgaagaaacctgggtcctagccctagccctgtcatttactagctttgtgactagccaaatcattttcatttctctggactacagttccttcatttgaaaaatgaagggattatactagttggttcccattctgccttattttgtggctaataatacttgattgtcat

SEQ ID NO: 92011 - DNA, 1028 bp, Homo sapiens
atgtgaatcaagattgtatacaaaagagatgttaactatgttaactatatgaatgtttataaatttaaaaaaaaatctaaatgttttaaccttaggggaatggtttgctttgtggaaaggttatggagtcattaaaaaagtatgtttttgagaatacttgacgtgggaaagtgcacacaaaataaaattaaatgtgggaaaaaataggatatagaactataaacagcatgagtccagttattttaaaatatatatgtgaaaaagtggaagaaatatgctgaagtgttattagttaactctgtgttgtaggattatgggtgattaaaactttttttttaattttcccaagctttccacaatgattttactatttctgattcagggaaaaaaagattaaacaagttttttttttttttgtagtgtggttgtgttgtgtttggtttttcttataaacatatgaaagaaaaattgagctgaaaagcaagaaattcatggtaagatctgttggactctagtacctttgaaggtaaggcattcaccctttcttagagaataatcaaattaattactaataaggctgggtgaggtggctcaagcctgtaatcccagcactttgggaggccgaggcgggcggatcacaaggtcaggagatcgagaccgtcctggctaacacggtgaaactccgtctctactaaaaatacaaaaaaattagccgggcatggtggcaggcgcctgtagtcccagctactcaggaggctgaggcaggagaatggcgtgaacccgggagacggagcttgcagtgagccgagattgtgccactacactccggcctgggcgacagagcaagactccgtctcaaaaaaaaaaaaaaattaattactaataatattaccaaataataacaatgaactgtttattacataccagaagactaaaaaatgttatctcattttctcctcacaataaccctctggggtaggtggtattcttaccttctaggtgggaaaccgaggttgcagagaggggac

SEQ ID NO: 92012 - DNA, 1050 bp, Homo sapiens
caacttctgcttgggattgttttgaggatcaaatgagaaagcactttaaagattataaaacacacttaccttgtttattatgaatacttctctccccccttggttttgccccccttggttttgacttaggttttttaaaagtttaaaattgaattgtaccaataggagtatgaactaatgatcccagggtttaggtagatttggggacttaaatctttcaataagtgatcctttagctagattgggatgtaggtttgtaatatcatcttcaccagtgaaaaatgtattgggggggaagtccatttatttatggatattttggatattttgtttctgccttaacataagttcgttcgttcgttctttctctttttttttttttttttttaagatttcaaactgtctctgccattattcttaaatacaactttatattggtgaaggctgcttgtcagggaaaaaccaaacttctctactgatttgggatttttttttaccataaattcagggtgcagttgttcttgaagtggttccattttgtgattaggctgagtatttttaagcacaactctctcccttgtccttagaattatctccagtatcctcaaaacaaagagcaaatgatgcaattaggatgcaatcccttgcctgtggatttcaaggaaaattattttccacactacttggaagctcatggacaaagtcaagctttctttagatctggtgaacttagaaaaaataacttgatgaagtgagattcttaccttgaggttagtttttgagagtggatcaatgatgtgaaatttctaagatattcttgatttataaatatcactttatgactcattccttggagcagtttttattttttcctttgaaaaactttagatgtaattgactttggtttacactctatcctgttttttggtttttttttttttttttttggagacggagtcgctctgttgcccaggctggagtgcagtggcacgatctctgctcactgtaacctctgcctcctgggttcaagcgattctcctgcctcagcct

SEQ ID NO: 92013 - DNA, 1043 bp, Homo sapiens
ggaggctgaggcaggagaatcgcttaaacccaggaagcagaggtttcagtgagccaagatcgcgccactgcactccatcctcggtgacaagaatgaaaccccgtctcaaaaaaaaagctataaggaagcccagcacagtggctcacacctgtaatcccaagcactttgggaggcctaggtgggaggatcacttgaactcaggagttcagaccagcctaggcaacatggtgaaaccctgtttctacaaaaaattagccaggcgtgatggtgtgcacctgtagtcccagctgaggtgtatcaccggagcccgggaggtcaaggctgcagtgagtggttattgcgccactgcacctgcactccaacctgggcaacagcaagtccctgtctcaaataaaagctaagaaggcaagttttgtaatagtactttgagcagcataaggtacatatacaaaatattgtgggaaatatattatgaagttttgcatctaggtacataagagactgtttccctcacagtggagagctttggtaaaagagcaagtggattagagcagttgtagcttctgttttctccagaaagctcacgctgtgcagcagctgtttttgtccattctggctttgcagcagtgcagtattggggttaagccacgtgtgtgggcctcagaggcaggcagctggggccatactaagccgggtgatcttgaacgagtctcttgacctctgcaagcctgttttctcatctgtaaaatggggattataatagtagctgctctgttgggttactgtgagaaatgcttaatatggattgtagggcatgatttcctatggtaaggtttttagaagtaataatggaccagctaaaaatgttcaagcatttatctactgggcatgttgtctttttttctttctttcttttgagacagcttcttgttctgtcactcagtctggagtgcattggcgcgatcttagctcactgcaacctccgcctcccaggctcaagggatcctcccacctcagcctcccaagtagctgggactacaagc

SEQ ID NO: 92014 - DNA, 1075 bp, Homo sapiens
tttgaagaatgcttttttgctttctgttagttacgatgtatatttccatttatttcccctattgagattaaggaaaattgtgataacaagtattttacttcctttgcttgtagttctgtatgaaattatttccttacagtgttactagttggtggtgttctgtatgtgattatttgaaactcagtgtgttttcagaagttgttgaatattctcaggtggagatggtcatttttattatggataatggtggaagatttttgtcttagggggcattctagattacagagcacacaaacatttcctacttcggggagagagggatgaggttgctgtgttggaagagtgatacacacgctgtgttggaagagtgatacacacacttccaggcgtatgctgatagagctgttgacagtatgaactttcccagtcatagtaaatctgggatcacggtggcatttctaggtcctacaaaaatgtgtgctatcttgggaatgttaccacttcttgccctgagtgtttcatagaggtgttaaaaaagaaaacaccctccttctaccttccagttgcggcactctggtggggaccttgtgtcttggttaaacaaatcacaaacaactctagatgcttggtgacagtctgaagaaggcacgtagatatttgcattatgttttattacagcatgtatttgtgactgagaaaccaaaatacttctgaagtattttcctctctgaagtagttgactcttggcataaaatgggaaactttgaagtcctgtgtttctgtttttctaatgaaatatctctgtacagctcaaagataaaagtaattaccatttttaaaggatccttctttcccctctgttttaactcttccatttaaaaaggattagcactggaaaattattagaatggacattcagattctgttgtgtatcttagttgcctgctaagaacactggttcccatcacatttaaactctaaagacattgtgaagtctggatatgcccggtctcctactttctctttctttgtggccttcagatcattaaatttagtgactcagctaatttttttt

SEQ ID NO: 92015 - DNA, 2906 bp, Homo sapiens
ccatacttaattattgtggcgctcaaattgtcccagagttggccagtgggagccccttcaggctggcttctgtgtccttgtgagatgctccatcgttttttttcttgcataaaaagatgttccaggctcattttgtccctatcctgccctaaccctggaatcagccctttttccagggagccctcacacccttgttttagcacttagcacactgtttacttatgttttcctccactggactagattgtacctctctggggacacatagatgtgagtcttacttgctcttgtatcttcacccagcacaaggcctgacacatgagatgtttactaaatatttgttgaataaaaaattaatttttactgtagttaattgattaaaatttggttctaaaattatgatgctgatgggttttctttttttttcccccatctaggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggact

SEQ ID NO: 92016 - DNA, 1300 bp, Homo sapiens
cccgcctcggcctcccaaagtgctgggaatacaggcatgagtcaccgtatccagccacttcttgacattctttctagcagtttttataccactgcttcccttctggaagccttactgatgtttaagttacatgttgatactcactttgtttttgtgcttccctttctctttcctggacagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggtaagagtattacctcatagcagtttataactttcactgtctacaggatgcttactggagggtcaagccatctggagattctggaatcagttgttgttgattgtgagatgctcttggagaaggagctgagcagtcccaacagttgtcagatgtgtagattctccatttgtgtgcagttttgaggctgtcgttgggcatttattaggccttggcctacgaaggagctgttctgtgctcaaggtggcagctatggctgcttgggcgctttctctgtgctacctcacccaccagagcatcagcactctgtcagttgcctgcccgcctgtgttccctgcagatctgtgaactccttgagggttgtgctatcattgtgtcctcagtactatagtggatacataatacattttggtttagtaaaattaatacagccctcagcattgttcggatgcctgagacccatgtattgataggatttttttctgaggtaagaaaatgattaggatgtttgggatatcttctggttatgccgctcctctgacaacttgatgctatcacaaaggtagactgtcttgggaaatttttttgcattgttcttgaaataattaagttttacttgtgttgaaaccatttgctttattcatttgagctctcatgtgtccctttggccttccagtttcactaaggtgggttcttgagcattcggagttgggctcaggaacacaggcttaaactaatttgaaactaaggtagggattacagccttccaatctgttctttctaactctgatattatctacagtggtattaagtattgtgtggtgtggacagcctactaggctctgctgataatttcagcagcatcgtgtgaagctgagtgacagtgttcatatttacttaggatgttgtaaagcagggaagatggctttatttattattttatttttatttttatttttattttttgaaatagagtct

SEQ ID NO: 92017 - DNA, 1809 bp, Homo sapiens
tgtggtcaagaaatgaccagagagtagaacagctttcagattgatctgcagatgcttttaggacagcccagccccggacaccctctgtgcttgctgtgctaataggatattcgactttcactctctcagctccggttacatggaaaggctggatgagggcatgtcactgccacagctgctctgggaccgccactgagagtgggaaggaggcggggttgagggggagcttaggaggcggggttgagggggagcttaagagtcagactaactttctatttctagcttgaatgctttttttcctccagttttcatctttgtggaaaattggttgaggcaatggagtcactgctcccttctgcagcagtgtggctcctaatgacagagaacattggccaagctcatctgagctctctgatgcacagcaggaagtagaattattcaattcagtgtacctctctggaatggggcaagaggttacttttagagctggctcacaatcctcctgagaataatttctcagggtaaagtacactcttgatagctcatggtggtcacaagactgaggttttaaatcctgggtctcagggccaaatttgagtcaagccttcctaggattcaagaaatctgacagcataggaaccccctgaggcagcttccaagtgtcgtcacacctgcccacccgggacggtctcagcgttctggagacagaatcctagtgccccacttgccttggctctgctgtgtgtgttcccgggtccccagcctctcctcagcctcacttgctatttaactagaaatagcattctctacgcatgctttctttgaataatatgtgaggccagacttcgttccctgtttctgtgatttttaacctctgcttttggcagtgtgagaggaggcatggcaacagtgaggaaatgatttccctggccccagtcctttcttaattggtttgcttactgagatgaccaaccctccacatctctagccagtgctgtagaggccgagaagaggaattgtgcctagggagaaacagttttactggggcagaaggcacccatcttctctcttgagttatgatgtattcaaactattctatataaataactgccaggacacagttttgttagtgcagctgactttcagttagtccctctggaatgaaaagctgtctgaagtcaaggaaggcctggcaggtgttccctcaccccgctttctgttccatacatgtttcttgagcgttgatatggcctaggcctggctctgggcactccgtcatatatgatcccataagagatggtgttttgctctaagaacatgggtgtggtaggaagctagcccttgggaggggtcagggtacatctcagtcctctgtcactgtggggaggacctcagtgtcagtaaagttcagggttagtctggctggaaaaaaggtggcagcattgatattcccttccctgtatataaaaccttgagaggagtcctgcataaaatccggtggcagaacccaggctctgcctctcagggcagcacctacctgtcatagtaatttagctgaagttcacatttattttctttttcttattttttactttttttcagaaatggggttaccctgtcacccaggctgcagtgcagtggtgcaatcacagctcactgcagccttgaactcctgggttcaagcgatcctcccgcctcagcctcccaagtagctgggactacagaagtatgccaccatgcctggcttggtttttttgttttgttttgttttgtttttgtttttgttttgtgtgtgtgtgtgtgtgtgtt

SEQ ID NO: 92018 - DNA, 1113 bp, Homo sapiens
cttgtggtggtgtgtttttgtatcttcggggctgaaggagtgattctggcagggtgagtgtgggttccccaaagctatcaccacattcttgccccagctggatcgttgccatctactgaggcctggctggccctccattacctcgctgtggctctctctgtggttttgcattgagtctgtggtttgcacacatcttgatgaccccatggtttttacctgccgggccatcataggacagtgctctctgatgaaatgctggccatttgtggcacagagaagtaggtgtcaacaagaacacctagcagtgagacaagtcttcaccaagactccaaaatgaaaggttcagccttgtgggcagtttgtgaggagaggaaagagagcaagtcaagaaatgaggctcttaccccagtccctttacagggcgaatgtggagcccggcagctgtggaccagtttgtctccatcatttgcaggtcagaggttaccctcagctcctcagctgcaaatggaagccctctatcaaacggcctttgccagaatacttaggctgtgaccttccccctatgcagctcatttgcctgggtaaatgagtagagtgctttctgcgtggcagatttaaatttcaccactaattgatgctagcgtcttcaggggaaaatgcttgccattagatcacaggcctttgggagacagcctcataacaaatacatccaggacagggggcggggatggggaaagtacagaatgcagctgtaccgaaaggaactgtgggacgtgcccagagaaaccaactgagtacttttgaggcatgcccttggggactgcgcatgtgcatggttgtgccatgtgtgttttgatggcctttttttttcttgctagtgtatagtatgtacaggacaaacttggagccaaactgtctggaatcaaatcccagctctgctgcttacaagcaaatatttaacttctccattgttagtttccttgaccataaaatggggataatgatggtactttgagtcatgagatgattcagtatgttagagacctcataacagtacctggcaggttgtaagtagtcaatttgctactgttgttggtgttattattgaaatga

SEQ ID NO: 92019 - DNA, 1095 bp, Homo sapiens
cgaaacaaacaaaaatcccagctctgccacttggctaaactctttcacattgctgagcctctgttcttcctctgcaaaatgcagctaataataatgcccaccttattaggactatgaggattgtttttgttttgttgtgttgtgttttgttttgtttgagacagggtctccctctgttgcccaggttggagtgcagtggtgcgatctcagctcgcagcgtgcagcctcgacctcctgggtctcaggtgatcctcctaattcagcctccagagtagctgggaccacaggtgtgtgccaccacgcccagcagtttttgtattttttgtagagatggggattcgccgtgttgcccaggctggtcttgaactcatggccttgagtgatctgcccaccttgagtgatcccagagtgctgggattacaggcatgagccaccatgcctggccctacatcactctttaagtggtcctttgtgcatttatttctctgcctggctccagagagctggaggactgtgaagacactccttttttcgcatattcagcaagtatatattgagcatcttatactatgtgccatgcactgtttaagatgctggtgatacagcattggaccagacagacaaaatcctcaccctcgtgtggcatacattataacccggggggagacagataataagaagtaaaatgtaaagaaccttagtgattagtgtttgggaaggaaaaaaatgaagcaggaaaggtggggtatgaaatgtccggggtgaacattaacattttagataaggagggctggggaagagtggcttttgagaaggtcctgaaggaaatgggggagagaaccatgccatttcctggggaagaacctttcagacagagagaacagcaagtgcaaacgtccagaggccaggacattcctgggaaagagcttggtttttactctgagtgaggtaagaagccattgaggggtttggagtggagggacaggacttggcctttgcttaataaaataactggctgctctgtagagaacagtcctcgcccttgaggacttgtgtgttcttgttctagctgcctttctgcaaatctttctccat

SEQ ID NO: 92020 - DNA, 1113 bp, Homo sapiens
tagctgtccccttgtgttagggatactgtttctgtctgtcactccttagaagaagagacaggagggagcttgctctcctccctctgccatgtgaggacacgagaaggcagctgtctgtatgtaagccagcaggagggccctgccagaaaccaaataggctggcccctcgatcttggacttcccagccctcagaaccatgagaaaaagagagctattgttgaagccacccagtctgtggtattttgttatggcaacccaagcagctaagacagatggcaaggtgaccaactcaggcatcagaacacctgagagccttaaggcaggggccccttctttcctgattcatgtgtccccatgggacctggctctccagagtcctccatcagggatctttgtgtccacatgaccagaacacagcaattgggtcagcagaaatgggaattgaggcaactgaaagtcagaagggctgagacaggtggacgaagacgtggacaaatgccacttgagagccgtggtctgaagagatgagctcacgcctttgtgtagtgcccggctcccaggtggtttactgtttgaaatgtaagctgactgggtatcagacaactgaatcccactttttcaaacaaagatggtgcaaggccttgtgatttcaccccagtttgcgttctttcactcttggctggcatcctttggctatttaaattcgtagcctcccaacagtttttaaaaaacaaacaaactcacacaatttatcttttcatgtaagctgcaatttggttgaaacaagacctttctagtacatagtccaaagctcctgataactgaaactacaatcagtgtttctgttctgtgatctgttttttgttttaaaagccacaacagaaaaccttttcttctgttacggctgtcaggagccgtttgggcttaatcaataatgaggtgtttcacttcctggggctgggctatctgtggagagcacttacttctccgtaacccatgaagccagtgaaggaccctgaatctgggtaaattcaaaattcttctgagccttggatagtcttaggcatagttctggcagggtctgacttgaaaaagtaggttgtgtatttatta

SEQ ID NO: 92021 - DNA, 1049 bp, Homo sapiens
ccattgttggatctgtctgctacaagtgttactgggctggattcgaggactttgtttttccatctgccctctgtattttcctaggaatgcttctgtgaatacccccctcccacctgccaaggcaagtgaggcagcagcaccaggagagctggacccctgcacacaccaccactgccaccacgctgcctttgctccgctgcctggcttctctgtttcccctactgaactgtgaggaattggggcaaagactgcctcttctttccattacctgtgacccatagtaggcactcgggtatctattgaaggaattagtgaatttttctttccacggattgaattagattgggacaaagaaagaaagtcatggggtgcagggtgaattcttggggcttgatcacttcaagatctcatcttggcttaagtctgtcaacatttttctttttccttacccagccctaagctatttccattggcaatatattgcacacaagctgtgtttcacttcttaatgctatgggatattgctgctacaagagccatccttggtgtttgcagaaatatttgtgatttgaggaacccagtgcagtgtagagcaggtaatgtgggggagagcaaactcacacccctgcagtctctaacttgaaggactgtgcaagcaggcatgttccttacgtaggggtgcttaacctaaggtctgtggataggctatggaagtctgaactcctcaacattactgcggaaattttgtgtgtgtgcacacacacccaggtgtacacttgccctgtggatggtgcagagtctatacccttcatcaggagatcagagtgaggggcgtctcctcccctgaaaaagttagagatcactgttcattcacagcgtttgtggaaactataccactgatcgagagcaagccaggacgatgatgcagccttgttctcaagggatttataatctagtaagggtgaagatttcaccctaaaccatgtagagcctacaaaaggaggtcagggaggccagggagggctgggaggtagagttgttgggactta

SEQ ID NO: 92022 - DNA, 1054 bp, Homo sapiens
acgccaggctactttttgtatttttgtagtagagatgaggtttcgccatgttggccaggctggtctcaaaatcctgacctcaggtgatcacccacctcagcctcccaaagtgctgggattacaggcgtgagccaccgctcccggccagctaagtgtttagaataagtaatatgcatatattttcagctttataactaactgagaacaaattgcagtgttgtcctgatgggacacagcaggacaaaaggccaactatttcttgagctgatttcctacagctgctggtgaactaactcccagattgcttaatctaactgggaagtgctctttctttagacttaggcgtgcggcgcacagcctttcgtgagaggtacgaaagcagtgtctgcgggcagcatgacagatgtggccctgagcgagttccttcactcctgagtctccctgtccttgattgaaaaatgaagacaaaagtagcttccttgcaaagtacttgcacatattaaaagagataatatgtaccaagtgccaggctggagctcacattgccaggccctgtgctaagtgtttccatgagtctcatttaagcctcatagcaaccatattagatagctgtgatttccaattttctcttaagaaaaatgggattcagaaggatgaagacagaatctgggattcaaacccagagccattgcctgctagccacactgccttcctttactggagtgaattgaagcccacagaagacagatcaggtggagtcctggctactcacagagcaatggaaacaggcagatagtattcaaccctgttcccctgcactgaagatttacttccaaacctctcttaactacctgaggattttttttcttcctgacaaatctgtacattttcttttcttttttaaaaaaattgagacaggtcggctgcagtggctcacgcctgtaatcccaacacttcgggaggccgaggcaggcagatcacctgaggtcaggaattcaagaccagcctggccaacatggtgaaactctgtctcttctaaaaatacaaaaattag

SEQ ID NO: 92023 - DNA, 1051 bp, Homo sapiens
tggtgcttaggccagagggcttcacccaagtgtggtgctgcttctgagaaacgggggtgctgtggtctgtaccccagcctggtggattaataggaagcagcagaagcttgagccaggtgtcttctggaacactaaggaggcaggacagtggcagagtccccggactcagaccactctgcctcttagcagctatgatctggggcaaggacttcacctttctgaatcttagtttcctcatgtgtgtattctctacctacccaatagctcttcccatgaggtgtgggagattaaatggcatcatcgtttatttaataaacaagcaaatggtggatggggacaaagcacctagctcagtgcacagcgtgtgaccactctgatatggaaagtgccagcactctcccaggcgagtacagcagtggcagctcctttgtaactaggcgttgcttggtaggatgtccctggggttggtccattaacctccttttctctcggggaaagggccttggtgcaattaacagcttttaagccagagaattgatgcctcttgctccagtgttcttgaagcctcaagaagtctgggacccccagaaaacaggcaggccagttgcttttatcttgcctgatggctgtctctccagaggtagcagtgacaataacaaccaacacgtggctctcggaagcctgactgactccagggcccggtgctctctactgtcggcactgtttctgttgtccaggggcagcacccacagtgcttcctctgtgcaccttcagcaagacagagtcgctcaaagccagtcttcagaagggacccagggttgctttagccatgagaccccatgtcagttttcacagtgacttcactgtcctttcgacaaagtccttgagatcttgatggctcacagtggacttcgttcccaggacagggtgagtggactcagtagacagcttggaatccactctaagctgaacagtgctcctctgcccacggtaggatggggagggagtgggagcccatccttcccttgatattttattctaacttacgtat

SEQ ID NO: 92024 - DNA, 1292 bp, Homo sapiens
tggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctctt

SEQ ID NO: 92025 - DNA, 1073 bp, Homo sapiens
cgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcggtgcggtcggtgcagcgtggccaatgcgcggcgcgcgcgggggacagagcaggaggcggtctgtcacctcggccactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgtaaaaaaccaaa

SEQ ID NO: 92026 - DNA, 1264 bp, Homo sapiens
tgcctctgggccacttgaggggcctcaggaagtgtgtgcttgtggctgcatctgcccgtctccctggcccaccatgtggctgcaggccaagctcttcattgctgaccatgaagagacctagttacctgccaagggattccccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtctttttttttttttttttttttacacaatcattaatgagatttgtcttcagccaccagtgttggccttgaagcagagggcacagcccttggtgtttgtaaaataagtatgaatacacagtgtggcagtgttgtggtttttgttgttgtttttcctctccttttgagaattttcttttgtaaaagaaaaatattttttaaaccgaaatctgtggatgaaatagaagctggagccctcctcttggaatattcagcctaagaacctcataggactatgaattcacccgaaattctcatttgccatcaggccgagcttttaaagaaaaattgttctctaaccaggattgtaacaaaagtgtaaatactgtttcagagttgagagttggtggtgcaaatatgtatataatgaactgtatttttacaatgatcgccgcatgactatttcacaccctttttatactccatatctgtcttccagaaacgtcacctgcctttctcctgtggtctcttaatccagtaattgtattactgccattaaaggatgcagttattttaaaaagcttgtgggtctggtctctccaggctgccccagaccatcccttgccctgggaattaacgagggtggaaggtggctggggggtgaaacaaggacctattctctcagcggtcggcctcagggtaacatgaggacactgagggacaatttgtgcctccaaacagtgtcagctgtcctcagtggatggcagtagatcacctactagcaacatcccaaggtccctgagcttctgtgcgggccacgctcagcatttgggatccaggggtgacctgcacagtcctggatctgcccctgcagtgctcatagaaagaccattaacacagacaggacagctgggctggcttccagggacgggacgagctttagcaggcaccctacccatgtgatagccaggggtatcct

SEQ ID NO: 92027 - DNA, 1750 bp, Homo sapiens
ccggaaactggtactcaagtgatgaggatgagggtggaagcagtgtcacctccatcctgaagaccttgaggcagcagacgtccagccgacccccggcttcagttggggagctgagcagcagtgggctgggggacccccgcctccagaagggacaccccacaggaagccggctggctgaccctcgcctcagccgggaccccagactcacccgccatgtggaggcttctggcgggtctggcccaggtgattcgggaccctccgatcctcggctggctcgcgccctgcccacctccaagcccgaaggcagccttcattccagccctgtgggccccagcagttccaaggggtctgggccgcccccaacggaggaggaggaaggggagcgggccctgcgggagaaggccgtgaacattcccctggacccactccccgggcaccctctgcgggacccacggtcacagctgcagcagttcagccacatcaagaaggacgtgaccctgagcaagcccagcttcgcccgcaccgtgctctggaatcccgaggacctgatccccctacccatccccaagcaggacgcagtgccccccgtgcccgcggccctgcaatccatgcccaccctggacccccggctgcaccgcgctgccacggcagggccccccaacgcccggcagcgcccgggcgcctccacggattccagcacacagggcgccaacctccccgactttgaacttctgtctcgcatcctcaagacagtcaatgccaccggctcctcggccgcccccggttccagcgacaaacccagtgacccccgggtgcggaaggcccccaccgaccctcggctgcagaaacccacagactctacggcctcctcccgggctgccaagcccggccctgctgaggcgccctctcccaccgccagcccgagtggggatgcctccccaccagccaccgctccctacgacccccgcgtgctggcggccggtggactgggccagggcggagggggcgggcagagcagtgtgctgagcggtatcagcctctacgacccgaggactcccaacgcggggggcaaagccacagagccggctgctgacacgggtgcccagcccaagggtgctgagggcaatggcaagagctcggcctccaaggctaaggagcccccgttcgtccgcaagtctgccctggaacagccagagacagggaaggccggtgctgatgggggcacccccacggacagatacaacagctacaaccggccccggcccaaggctgctgcagcccccgctgccaccaccgccaccccaccccccgagggtgccccaccccagcccggggtgcacaacctgcccgtgcccaccctcttcgggacggtgaagcagacacccaagacgggctcaggaagcccatttgctgggaacagtccggcccgcgagggtgagcaggatgcggcatccctgaaggatgtttttaaaggcttcgaccccacggcctcccccttttgccagtagtgtccagccagagctgcggctccagccacccttcctagggtggcattcagggcagcacccagggtagggaacttgggggcaaggggaggcaggctgggtgttccttttttcttttctttttcttttgctttccgtctcttttatttttttttaaagtagtactttctttgagatttgtaaattgtatataaccatcttaagttctggtcagtgtggcgggctcaggggctcctgctgagcaa

SEQ ID NO: 92028 - DNA, 1097 bp, Homo sapiens
acgtagggaggctccatgctgggtttgcctattgggtcaggtcttcacagtgaagactgcagtgggaaggattgggaccacctgtcgtcaggctgtgtggaaacgggttatggtatgagtcccctggatggtcaccatccttcaaaaaggagcagtgtgtaggtggggacagtgttcattgttccctacctgacgctctcctgccctctcctctgcgcattccagtatggagagagtgaggagccaatgggagacgacgactatgacgagtactccaaggagctgaaccagtaccgccgctccaaggacagccgaggccgaggtgggcaggggcctggagaggacacgctgggtggggcagggattccagcagctgctggaatctagtcctgggggtgggggagggggtggtcagcaggtcttcacacaatctcccctccacagggctaagtcgaggccgtggcaggggctcccgaggtcgagggaaaggaatgggtcggggccgaggccgaggtggcagccgaggagggatgaacaagggcggaatgaacgatgacgaagacttctatgacgaggacatgggcgtgagttgactccactctgatctgatgtttgggccaaggtcccttcttagtcctttttccctttaatgagtcattctgtgaagctgatccttgctgccatcagccaccccccaaagggctggccagtgttgaccagcataaccagcgacaactagagttatcctggggagatgcgctgctgctgagaccctgtgtttaaaaccatgtcattagcagcacctgcagccatacctaacacatctctgaggttcagaaggttctaggtgaaccatccaattagccctggaaggttttgcagggagacccatgccaccacctctgggtgtggtggacgtgttcctgcacagttgtgtggaacttgaggtgtaagtggctaacagctctaaaggctagagcttttcctcaccaggcagcaacaccccacaccgtggggcttataaggtgcacgcagcctccgtgttagatgcagcctgcccatcggtgctcttgtgagatctgaagggacccctcatc

SEQ ID NO: 92029 - DNA, 1043 bp, Homo sapiens
taaatcacaggtccaaactacagggctagcttgtcttgtcagacttcaaggctagcatcttgtagtttggaccagacgtgttagttgcacattagcccatgggctggtgtttgccatattggacagtgcagttctaagtagacaagtccctgtgaggaaggggagtgagtactggagtagctgtgtgtctggggtgctgagggacccccattgagagaaccagagggtccagtagcctacctggggcatctaggaaggcttcttggaggaggaggaggaggagaaggaggaggaggcagctgaagtgattgacctcaggagcaaaatgtgggttgtcttctttcttgctggtggcatctgctcctgctggaggctcactatctgaatctccatgcaggcagccgaggccggggccggggctacaggggccgaggaagccgtggaggatcgcgaggccgcggcatgggcaggggcagccgaggcaggggcagaggctctatgggaggagaccacccggaggatgaagaggatttctacgaggaagagatggacgtaaggtttcctctggccctggggacgtcggggtgaggctggtgggctttccggggcgtgagcactgctggtagaggctgtgaggccaaggtaggaagacatacggcccttctgaaggaagggaagcctcagagcgcagatgtatgtgtttaaaaatattcatttatcattttggaatagataaaaccttcacgtggtttaaagtagaaaaggtatcggctgggcgcggtggctcacacctgtaatcccagtactttgggagcctgaggcaggtggatcacgaggtcaggagatggagaccatcctggctaacacggtgaaaccctgtctctactaaaaatacaaaaaattagccgggtgtggtagcacgcgcctgtagtcccagctattcatgcaggagtctgaggcaggagaatcacttgaacccgggaggtggaggttgcagtgagccgagatcgcaccactgcactccagcctaggcgacagagcaa

SEQ ID NO: 92030 - DNA, 1183 bp, Homo sapiens
ggagagagacttctgtggtcaagcaaggtttagaagtgccccaagtgcttcacagcagagctgtgtgggtttctggactatggggcttcctggaagttgtgcagcgttaagcattatgaatccccaagatggggctcttcctgcttatgtgaccacagcaccttgtcggtttcttcttctaagaacactagttctgttgggaaatctggcgtagatgtgtcccggtgttagtggtaatgcccttaaactcctacccctcccccagccaggttagactggagcaagcacagttctttcagggggaggataagggatggaacaagaggccatggcccccatgtcctcccagggtctcacttcgctcacagcagtcaggccttcggttcctgtcagccttggccagcccagagccctaggaggtctcctctcaaaccctgtgttcatggtgggattggggtttgtttgtagggaagatggagagttggaagaaggtgaattggaagatgatggggcagaggagacccaggatacctccggagggcctgagagaagccggaaagaaaagggggagaagcatcacagtgattcggatgaggagaagtcccacaggagactgaagcggaaacggaagaaagagcgggagaaagagaaaaggaggtcgaagaagaggaggaaatccaagcacaaagtaggtcggagatcccctgggactgccactgcctggcattgggcctggctgagagccccaggggctgagcttttgctgtccaccccagagggcactcttaatgcctttgcttatctcaaattggataaagaccttttttaaaagagttggtagcttatgcttcattgccactaagtgccccaggtgaggtgtttcaggtgaagcgcagagccctgcggcacatgccagcatagtttgtcctgaggctgactgtgcccgagtggcctgcctgtggcaggttgctgagtctccttcccctgtcattacagcgccatgcttcttctagcgatgacttctctgacttctcagatgactcggatttcagccccagtgagaaaggtcaccgcaagtacagagagtacagccccccatatgcgccggtgagtgactggcatgcactgctgagctctggggccgggaggagttcaactgcttgtgtttcttgagcacttgctg

SEQ ID NO: 92031 - DNA, 1955 bp, Homo sapiens
tgaaatgtcacagtactgccttttttccccccagactgatgtaccagtattagttaaaaatcaaattaatggatgttgcaaaaaaaaagaaaagggtgtcactcagaatccctgatttaataacaaatcttattatacacttacaaacttttacatttttattttctctgggtgagagatttaacttgaaagcaaatcaaagtctcctagtagaaaaaaagtctgttgtgaccatggaaatatggatgttctcgtcataaaacccctttattttttaaaactcctttatttttttaattcccctcaaatttgctctttaaaagaaaaaaatgcggttccccaaaatgactaattcatggcctgtcctctcccccaggtacaattttgctctgctctgaaggtttaaatttttgatttctttataagccatagttttctctaagtagagccagctattttagtaagccactgctgtggtttttccacagccaggaaggctgatcccaggggagaattgttttgtacctgtggacctggctgttcaactgcctggcaagttaaagatgaacggttttgactcttgcgtttccatacagttgaatgtagagcaatttcatattgggcctggttagtaatttatttaacggtgcctacacctctgcttcttgctcttagatcttttaccttcttccctgatgggagagaaatggctgtctgagggtccttcacttccttttgttacatttttatggctattgggcctgtagaaacatctctccatagaggtcagatccagttacagtaaatacctctggtgaaaattgctaatgaaactatttccaggtctccgtggatagctatcaagtcaaaccagattctagagaacttaattttggtccccacgaacagtaattctagtgccagagcaactgggtccgattcacaccgagagttgagtgacagagtgaatagcaagcaaagtagctgaattgagccaggcgcttaacctgtgccttggcagcacagctaagaaaaaaggatgactcctgagatttctggcaattggtatttattcagcagatcagagactgtaggagcagcctcattggtggagggactcctctccgaataacatggtatgaagccagtttcataattaaaacctaataggatggaaaagctgccagtttgtctgggtggcatgtcaagttcatggggataagttaaagtaaaaatgagattgattggggggagccaaacttcatgggtttgactcccagtttcttggccttgtctttgctgcagaacgcttttgcttttaggagttaatgcagatgcagttttgaagacattgtgtacagtttcactggtgatgtaatgaggtgcgataggcagtttattttaaatagatttctggcacatcacccattggggtgactcttagtagttgttgacaaaaatgaagatacggcctcttggttggtgctagatttagttgtgtcctgttactttttttttttttttttcttaacagaacgcaggattatttgctgagagcatagtttgctgcttctggccaaactggtctgcataaaggatctttctcgtgtattttttttgccatttcgcatctgtgtgaataggtgactcagtgccctgtttgtcaggcaagtggtgacatctttttgaatgtcggaggtggcaacaggatgtggaggaagactgtggactttggagccagataaaactgttcaggcctggcttctccccggcagtgtgcagtaggcatcgagtataaaatgcccacttctcagggtccttgtggtcaaatgagtgcatttggggacacccacacaatgccagcattcagtgaatcttcctgctttccctactagagaagaatttgaaacagaacttttacagttggtgtataaacagaagtaagaataacatct

SEQ ID NO: 92032 - DNA, 1137 bp, Homo sapiens
ttaagtccgaaacgcgggccccccacgcccttctctggctggcgggtgataatggggtcagcccggcgcgtttcagggcgaggttggggccccgtttccttcccctgctcgagcagaaggagttggggtgcagggttcgcccactgtttcctggtggggcgagagaagaggcggctggagagtaggtttggacacggacggtgggtttcagccggcaggaaagcgagtcttggagggaatgggggtggagaggggaagagaacgctctggacagatggctactccgtcgcagccctggctggggagccgctgaggacccttccttagccggggggtctcagccagggcttcccttgccaggctgtacgtacgaccccttctccccactcccacctcccctttcccctttctccttcacagaccatactttgccttttaaaagaaatgccacccacattcagagacacaagtgcagcagtttggtgagcttttacaacattttttttttctgttttgttctaattaaatgtatcgtcctgggaatcgcagcccatcgcagcccgactccagttcaaggaaataaacagattagcaaaggtctgttcgctaagccctcgttgggcttccgggccccctctccgggggcaggtgcattactcaaaggtgcttacacgctttattcgacctctaaggagttctcttatgtcagaagtgtatgtcttacaatgggttgggatggtaagtagcctcttttattgagtaattcaatgatctccctctttttctccctttactgcctgccttcctcctcgcctttagaccaaagtgatgcttgagagtgaattgatatgttcgaatcaggattctaaccctgttgagcccttttagacttgcacatcctttcaatgtttaatttttaaaatttgacgtacacagttttctcagaaaaaaaagtgtgttactgtaacatgacaaaaatcgatgtaaaaggcccgtatgttttcagacccttggcatccttctttccatttcaatccattgctttgtctccagccttcatctttgaagaaagtggatacttcaagtccatttgtaggagacaagcttactggatttgatttatgatgcaggtattca

SEQ ID NO: 92033 - DNA, 1023 bp, Homo sapiens
gtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacc

SEQ ID NO: 92034 - DNA, 1744 bp, Homo sapiens
cgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgag

SEQ ID NO: 92035 - DNA, 1060 bp, Homo sapiens
tcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgtt

SEQ ID NO: 92036 - DNA, 1072 bp, Homo sapiens
ggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattg

SEQ ID NO: 92037 - DNA, 1190 bp, Homo sapiens
ctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaac

SEQ ID NO: 92038 - DNA, 1052 bp, Homo sapiens
tcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagt

SEQ ID NO: 92039 - DNA, 1008 bp, Homo sapiens
ggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaag

SEQ ID NO: 92040 - DNA, 1028 bp, Homo sapiens
tagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagt

SEQ ID NO: 92041 - DNA, 1061 bp, Homo sapiens
ccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaat

SEQ ID NO: 92042 - DNA, 1267 bp, Homo sapiens
ctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgc

SEQ ID NO: 92043 - DNA, 1372 bp, Homo sapiens
tgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcc

SEQ ID NO: 92044 - DNA, 1334 bp, Homo sapiens
ggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccag

SEQ ID NO: 92045 - DNA, 1057 bp, Homo sapiens
tactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtggg

SEQ ID NO: 92046 - DNA, 1498 bp, Homo sapiens
gctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggt

SEQ ID NO: 92047 - DNA, 1115 bp, Homo sapiens
tgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggc

SEQ ID NO: 92048 - DNA, 1134 bp, Homo sapiens
gagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagt

SEQ ID NO: 92049 - DNA, 1388 bp, Homo sapiens
gcaacctgcctggtacttttcagaatccttgttctttgagttggaatccccacagcaaccccatggggatagatgctgttctcctacccatactggagataaggaaacaggctcacctcacaagcaagggagagatggaaatggcgctgactgggaaagctgcggtgcggggcactcagtagagattcatgtagtggcacggcttgttcgctcagtgagaacaagattttgggcttcccttcacaagtccctgagacccagtagtcactggaaaacatcatgtcggccttcataaaagagggccttcaactaggtccaaaagggtgggtggatttggttcctaagcttgtacgatattcaagcaatatacaagcataaagagaagattcctctccgctgcagggcacagcctgtcagcacaatgttggccacataataagagcagctgacttcacagctaaactgcattttggagagaaatatgagatgctttttggacatgttagctgtatccactttctttttttctttttcttttttcttttttttttttttaatagacggagtcttgctctgtcacccaggctagagtgcagtggtgtgatctcggctcactgcaacctccacctcctggtttcaagcaattctcctgcctcagcctcccaagtagctgggattacaggccccggccaccatgcccagctaatttttgtacttttagtagacagggtttcaccatgttggcctggctgctctcgaactcctgacctgaagtaatccacctgcctcagcacccaaaatgctgggattataggtgtaagccacagcgcccagcctagctttatccactttcatatccactccccggaggtcacccctgttaactgttgagagtgaatccttccagactgccatgttcaaacctagactctaccactcagccatgtgaccctcgctacactactttctgttaccccatccctaaaatgggtagaatagtggcacattcctcagatatgtggggattaaaaaatcagtctttgaatcaatattgctcaatgttagctgctattttacatattcataaataactttttctccaatgtgcttttttctcaatatgtcttggagatccttgtcagtatttcatgcatcaaattccataaccaaaacaggtgaaccattaactattgaatcagtctgctgctgtgtgacattgtgcacacttaggaaagacttcccaaagccaagttccagggttagcaagtataaaaatgcattttaggagttggttcttgttttttattttgttttgttttttgagacagagtcatgctctgttgcacaggctggagtgcagtggcgtgatctcggctcactgcaacctc

SEQ ID NO: 92050 - DNA, 1117 bp, Homo sapiens
tgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtggatactctttctgcttgccttccctgcagcctggccttggagaggcttctgatcgggggctctgctctgtgagccctgcttgtgagtgggtgggagaggtgggccctggcagttgtggctccatcagaagaaaggctaaggggcctgggcttctccagaccgggacgctcctagccttcatcatccccattcccggtaaaagtgaagcttggcctggtgccatggctcatgcctgtaatcccagcactttgagaggccgaggtgggtagatctcttgaacccaggagttcaagaccatcctgggcaacacgatgaaactccgtctctacaaaaataaaaaaataaaaaaaattagccaggcatggtggtgtgtgtctgtagtcccagctactcaggaggctgaggcaggaggatcacttgagcccaggaattggaggctgcagtgagcgatgatcaagccactgcact

SEQ ID NO: 92051 - DNA, 1063 bp, Homo sapiens
actccctggaggaggtgacaggagtgcaggcggagagcagtgtgggcgccctgcctccccacaccgcgcctctccaaaccccgcgagggaccctgggccagggtcgccgggtgagaggcggctcggcgttggggcgccggtctgggcgcacaggtgcctcggcggtctggcgggtttgtttacaaacaatggggtgcgggctcggcagcgccccctggcggccagtgcggccccggggaagagggtcgaccccaggggtgccccagcccccaaagtccgggaggggcgggggggcggcacggaggggcggccacacccagggcgcgcgcccgctgggggcggcgacggggggcggctcgcgggccgtggagtctgcggctcctgcgggcgggggctgcgccccagcaacagccggttattggccccgcgctcgcctggcgggcggggcgggcgcacgtggcggcggtggggggggctgtgacagcggaggggggtgtctgggaccgccgtgggagcgcgcgtgtgcggggttgtggatctgcaggtgtctcgcctgggtgtgtgcgcgtgtctggctccgagtttgtgctgggttctgcagggagtggtggtgtcgatccagaggaatgttggggtttctgacccgtcggggtgtctgcgtgagtccccgcgcctgtttgtgtggggttctgtctgtgggtgccctgcttgtggggtgggtggacctgcgtgtgttgtcggtgagagttgtctgtgtgtgctgttccgggatgatactgggggtctgtggtgcctgcgtgtgctggggtgtggaggttgtagtgtgtgtgtgttgctggagtgagctgtttgtgtgtttatgtgtgtgtcttgcccgagcgtgcgatatgtgtgcttgtgtcttgcctgtgtgtttctgtcttggctgaggccgtctctgtatctccggggcatgtgtcttttgcccagcgtttgtgatgctgcgcctgctaaatgcaaatgtctgttttctgtccaggtgtctgtgtgagttgtcaggtgtgagtgtgtgtgtgtatgtatg

SEQ ID NO: 92052 - DNA, 1089 bp, Homo sapiens
ggtggtgggtgcgaggaggtgatactggagcccagagaccaaggaggaagctggggctggaaccctagtgggagaggaggtacctggctcagggcagggctgttgagagggactcagttactgatgggcagttcagggcagggggaggaagagggaggatttaggacaaggctgctgagtaggtgatgtggctctccctgagatgggatctgggaggtggcatgggtttcatttattcattcttcatgtattcattcattttaaaaaaggcatattgaatttcccttgtgggccaggcagcgttctagacttgggatacacgtcagtgacatacatcactgaaagcagacagacattcctgtccccaggcagattctgccgtagtggaggaagcagacagtgagcgagacgcatatggtgctgggtgcaaatgggatgagaacagagagggtggcaggggagctggtttccacagggtgctcagggaaggcctcacgagaaggcagcattggagcagagacctacaggaggtgaggggttggagggtctctgggaaaagtgttcctggcagagggatccgctggcgcaaagcccctgaggcaggtttcagcctggtatgttgtgggaatagcaaggaagccggagtgatcgtggggagagggtgagagatgaggtcggggaggtaccaaggccagaccccacgggtcccacaggctgtggggaaggctgttactcagaggggcaccacaggaacgttctgagtggggctgcaacgtgctgaggtttgagggatatgagcggccttcttgttcagagtccaggagagaggcctgggctggggccagacttaggaggagttcaggggtctgggagtccgtctggcagacagggcacctgatgcttccctaccccggctgtctgctcctaggagattgaggaagaccgtaagaaagctgaacttgagggagtcgcagtcacagctccccgaaagggccgctcagtggagaaggagaacgtggcagtggagtcggtgagctcgtcactggggtgtgggaccctgaggatggggaggggcagagggttgaggcc

SEQ ID NO: 92053 - DNA, 1062 bp, Homo sapiens
ggccagcagccgcagaaggagaaagagcagtcggccccaggccaaggcagcgcccagggcctacaggtggggcaccccttctgcgggcttgcatacccccagggctctccgcagggcgttctcttctttggcttgctgtgaaggtgtgggtacatctgtctgtccctgtctttgtcttggccctgtctatctcgcaggtccgtggtttgaggggcttgggatctggctcttggttttaccctcatctgtcccctttctgccgtcacccatctcctctcctgctacctgccccactttcgttctgtccttgacacatggggacacacatccgccattccctcagccctccaccatgccagatgctctgggcagctcctccctagggagggtggaggcaggaagccccttcctcctgtctactctccacccaggcatcacccctccctctgttccctctagtgaccatgatgaccgctgggagacaaaagaaggggcagcatccccagcccctgagactccacagcctacttcccccgagacttcccccaaggagacacccatgcaggtgaggctgggctgtggttcagggcacgggcctggggtgggggctcaggacctgtgccttgccctgacttgcctgtgtccccaaagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctgg

SEQ ID NO: 92054 - DNA, 1107 bp, Homo sapiens
ctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtgagtgggacgcaccaggtttccgatttttccagcgtgaccttgggggaataggttgcttgtccatatggcagtatcaataaaaatgaagcacttacccttggacccagcgatgattcttctagaactttatccacagagtggcttgtctgtggtctacatgacaaaggagctagcattaaccagtgtagcactttaacagcaaaacaatgggaaatgtcctaaaggctcatcactttttttttgagacggagtctcactctgtggcccaggctggagtgcattggtgcgatcttggctgactgcaacctctgcctcccgggttcaagcaattctcctgcctcagcctcctgagtagctgggattacaggcacccgccaccatgcccagctaatttttgtaattttagtagagacggggtttcaccatgttggtcaggctgggctcaaactcctgacctcaggtgatccacccacttcggcctcccaaagttttgggattacaggtgtgagccaccacgttgggctgcgagggtaattcttgacgatcactgcaatgcaaactgccatcttggaaggccaataatagtccttctgtctcatggtggtcatgaggatgaaatgggttgatatacataaagcacttagagtggcatataatgtcctggcacatagcagggactcaaga

SEQ ID NO: 92055 - DNA, 1224 bp, Homo sapiens
cctctactcctcctcagagaccaggggtgacagagacagatcttgaaaaccttgggacaagtgcccttgggctgcagggttgggaacggggggagcatggccagcctatcacctggtgtgccctcaggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgagtctctcttcctcctcacctctgctacccactctgcccctgggccagtcaccagtccctctcacactcctggtcccccagactctgggcgagctcttgggaggtcaggcgcatgcatccttgaaacacgtgtgggctgggtcagtttctaggtgggggagacccagggacggtgggcctggggaggagctctggcttgggagtcccagagcgcccatcttgatctttctctgggttcttggggtccaggggccttgatttcctcaactgggatgcacggtggtgatgccacccctcagagccagtgggagggtcgaatgtgacggtcctcatgactgctttgga

SEQ ID NO: 92056 - DNA, 1109 bp, Homo sapiens
agctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaaggtagcacaccccacgcccgcaggaccaccgcaccaggccaccatgtgcttatctccaggccaggtcccgttgcccccgaagagggacgtgctcctccctcacgtctggcccctgccagccagcctttggatgagaagtgtggttctcacagctgtgtttctgtgctggcatcacctgcccacccagccctggaggcttttgcgggtccagctcctgcctcacttagtgctctttccttcatgggtgcactttttgaatcctcactgcaccccattaaagtcagcaccattgtcaccgcgtcttatgggtgaagatggtgaggctgggacgagagtcccttgtttgaggccacatgactagggacctgcagccccagtgttccagatctttgtgactcctgctgtcgtggctttagctgtagctcacacatgcccacctattttcaggacacttggcaaaagaggggccaaagagggcagtgggagggggcgtggccagcgggaaggagctggagggttggcgctagattttgcttggccggagtttttttaccattgcctggcagaagcacggagtccaggatttcctggtgtccctggctcacggcctggggtggtggccccacacaccccacacacacacaccccacagagccctgccctgctgtgggcaccggtggtgggcaaaagcttgggctttgtcagaccaggttcccattcccaccccatgtctcaccgtgccctgggcaggtcactgcccctctctggatctgtttcctcactttgaaaagggggctcaccgtcatttgaccctctcagggtcctcaagaagcaccagccccaggcctggcatggaggatgtgctcatttgtcccctgccccagctgagccaggtgggaggaggcagtgggtg

SEQ ID NO: 92057 - DNA, 1015 bp, Homo sapiens
aggtctcaagccctccctcccatcctggtttctccagagccctttgccaagtggctctggactggtccttccgcctctctggctgttatcagaggcttcctaagggccagggccttggccaagtgctcgtgctcacattctctctggtgtcacaccatctgtgccctcgtggatgggatggaattaggctaaggccctggagtggcttgtccaacatcacccgctcagcccagcacgcatagccaggcctctagtgctggggccctcccttctcactcctgtgttcccccacctctcgatcttcttcacacctcaggtcttcttcatacctcctcacaggcgtggctgaggggtgggaacttgaagggtcataggtcagcaggcaggcacgcaggaggtcatgagtcgcaggcagccccttcctgtgtcccctccagggccgattcacgattgcggccaagcaccacatctccattgctgagatctatgagacagagttggtggacatcgagaaggtgagtggcagcagggccctgcatgggctggcagccaggaccagtgctgctctctcttcttcccaccaggggagtcctctggtgtctgagtgccgagaagggggcatggggcgccggcagagcttggagaatggggtctggctgtgtcccaggcaggcagggcggagggtgtggaagcttcacggaggcctcctctcccttccctgccctcccctggaacccatcccccgtgtctccccaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcag

SEQ ID NO: 92058 - DNA, 1009 bp, Homo sapiens
aggctgaagggggctgacaccaggcagaggggctcagggctagatgatcctaggagcggtgagccgcgtctgaagtgtggggggtgcatggggtgagtacggccctggttagcagtgactagtttaaggacagctgaacggaggaacccgggatgatggagtcaagactgtggaggtctcagcactttgggaggccgaggtgggcagattatctgaggcggggagttcgagaccagcctggacaacatggtgaaaccccgtctctactaaaaatacaaaagttatctgggcctggtggcgggtacctgtaatcccagctactcgggaggctggggcaggagaatcacttgaacccggaggtagaggttgcagtgagccgagatcgagccactgcactacagcctgggggacagagcgagactctgtctcaaaaaaaaaaaaaaaaaaaaagaaagaaagaaagaaaaaagcctgaggaggcctgggttgaggctggagactcctgggtgggggaatgcgtggtggtggcttggccaaggagatggagggataacagggagagacagggggactgagagaaccaaaacgggggatcaaattcctgctgtgtgatcctcgagtaatagggatgacagagacatgctgagaagagggatgggaaaaggcctgggagacagaactaacacatatgacgtggcataaaactcacgttagctcctaaaagctgacacgaccatcctgtgataaattgtagtggcttagaagtgccaagagcccaagtagctctgccacttacttcatgactttgggtaaattgtttagtctccctgctaaaggagatcacaaatcaaacctacctcccatttgctatgagtgttagaattgagcctggcgtggagttacatctctgagagtgttagctgttgttaatgtgacttccagaaggaaacaggttcggagcgtgcagagagctgatgggggttcaaggtggacgcccgagcggagaggt

SEQ ID NO: 92059 - DNA, 1727 bp, Homo sapiens
gtttcaccatgttggccaggctggtctcgaactcctgaactcaggtgatctgctcacctaggccccccaaagtgctgggattacaagcatgagctatgcacctggcctttttaactttttgttaaggaaattttaaagcactcaccgagagttgagaaaatagcacaaccacccctgtgtaaccatcaccagcttctgcaaaaattttctgctgatctgatcttttttttttggccattacctactgtgcacatatattttttcttttttgccaaggtattttaaagcaaattccagatatcatatcatttccattgtattattattgttattaatggtggtgttatttctgggatccagaatttgtttcagcacctccagagtctgtcctgttctatgaagaaagtggcattaggcccatttcataggttgggaaactgaggcagcagggagtgggctttgatcaggtggtcctttttctgtgatcccctttttgggactgtggtgaattccctgtcttggccacaccaagcctcaaaccctgtgggttgtttctgattacacaggtttgggggtcacacctgggtgcatgcagtgtggggtacaggttctgttactctgtgcagaaatcgtcctcataaaggaagagttgaagtggggctggcagcaggggatggacccctaggatgaccctggaggtgatgggcaactgggtcagctgtgtgggttaaagtcctgtttctgctccttctaaccctgtgacttggtggcaagctatttccctcctttagtccaggttagagaactggaagtacaggagagataataaatacttatttggatgaccttattgttaaataaggtctagcgtggaaaagatgttttgcaagtgcctggctcagagtaaacggtcactattgttagtgttgttattgcttctgtgtatactcttgaggttggggacaaaaatgctgtttctaggattgcagaggaagggttgatgccccttgaccccccagcccggccccgctaccttcattcccttgccatgcccaccctgtccctctgcactctccctttgaagtgcttgcctgtttagggggctgccaacttcagcgtggcccctctcagcctcttatgtcctctgtgtcccagcctggtaaccttgggaacggagtgagcgggaatatctgtctgaggctgtgagacccttgctaaagacccttggggtccttgagggagcgcctggtggcctctgctgcctggaggcagaggatggcccagtgtccagggacacctgcaggtgaagctccccggagccacctttccagaggctggatgccaactctcgtccaccgtgtgaggctgggcgggcagatgtccacagcgcctgcctcacagggtggctgtgacagttagctggactataacctccatcacctggcacgcatagtgtctcattgacctcagacacttggcgcccggcctgggtgcgggagttctccctgggagaagtctgagctcacagcttagcaagctcttgctgtactgcggaatttctctccctagaacgtgcgcggtgatctcctacttttgtgtgtatacttactctttcgtggacagtgtatatatatatgtatatatacatatatatatacacattttttttcccaaccccttttttttttccttttttttgtgtgtgtgtgtttgagatggggtctcgc

SEQ ID NO: 92060 - DNA, 1028 bp, Homo sapiens
tttgccccacaatgagccaggaaaaaagaaaaggatggctttagagatttttggaggttggaattgcagattagggggccacagacctaaaatgcctaccgagtaggatgagtgggttttttgtttgtttgttttgttttgttttgttttttgagacagagtcttgctctgttgcccaggctggagtgcagtggcacgatctcggctcactgcaacctccacctcccgggttcaagcgattcttctgcctcagcctcccaagtagctgggattacaggcgcatgccactatgtctggctaatttctgtatttttagtagagacgggatttcttcatgttggccaggctggtctcgaacccctgacctcgtgatccactcatgtcagctcctcgaagtggtgggattacaggtgtgagccaccgcgccgggccagggtgtggggtttaattgggatgatatgttgtggagtgactggcacatgacaacatgacaaggactttgtcattgctggttgctattactattgactgttgttgctattattattactaacccctcttcggtctgtatgggctggtgcagacacattgggctgtgatgcagatccacagttttctagacttgcacaccagttcctgggggatcctgttaccacgtgagttctgagtcagctggtgcagacactttgcatttcttaactcccaggtgaggctgctgtggtcaggggcctgccctctgagtagtaaggtgtccagtggttttccaggtgtttctgagttactttcaaggattctgcaaatggaggggaggcattggatgccagggtcaaaataagattccttagctcttagctttggggtttgccaatttgcagccaggtctgtgttaatcattacatatggaaaaaagtcatataacacgacgaaagtctttgcaccatctcctcttctttccttttccaaaggtgacctctgtggggagtttggggctcatggtctctctctgttgtccaggctggagtgcagtg

SEQ ID NO: 92061 - DNA, 1048 bp, Homo sapiens
tttttgtagaggcaggaactcactatgttgcccaggttggtctcaaactcctggcctcaagtgatctttttgccttggcctcccaaagttccgggattacagatgtgagccaccgcactcggccgatttatgtttattataattattggtatggctggagggcagtggtatgatcccggctcatggcagcctctgcctcttgggttcaagcaattctcctgactcagcctcccaagtagctgggactacaggtgcacactaccacgcctggctaatttttgtatgcttagtagagacggggtttcgccatattggccaggctggtctcaaagtcgtgacctcaggtgatccacccgcttcaccctcccaaagtgctgggattagaggcatgagctactgcgcccggcctttccctgcttcttttaaatggaatattttagtgttccattttatctccgcttttagcctggtagcgctacctctttattgctctagagtttccattctctgtctttgactaggactttggctttgaatctgagtgagatgggagccatgggagggctttgagctggggagtgacccgacctgacatttttatatccataccttgggttgcttatgcaagagtgtttccaccggccagattcctggaaaaggaattgctgaggcaaaagggagcgagcatttagactttggtggccccgccaagttgcattccagaaaggcttcaccattttcactgctggcaaacagcagccggagcttttgagtggctgttccatgccaggcctgtgccggactctggggaccttggcaggagtcagcctggggctggctgcttcctaattctcagtcctcgagtcctacctccgatctcaagaaaaggtgaggatttcagagaggccataaaaaggagaagcaagagatgattgtgggtggctgaaggcggcctggcacatcccaggtgatgggagagctggctgcatccgatggtcccaccgcagggagcgtgaccaggaggtggagtgtattggactgggaaccg

SEQ ID NO: 92062 - DNA, 1047 bp, Homo sapiens
cccagcctccagcaaccacaagtctactttctggctctgtgaatttgcctattttggacatttcgtggaaacagactcttacacgacgtggccttttgtgcctggcttctttcactcagcgtgatgttgtcaaggtccctccgtgtgtgtcagtgtctcatcccttttcatggctcagtaatactccattgtatggataggccacattttgtttatccgttcagttggtggacattggaggttttttttttccagtttgcactgttctgaatgatgccgtatgaatgtttgtgtgcaggcttttgtgtggacacttgtttccatttctcctggtttctacatgggagtggaattggtgggtcacagggtaactgtgtgttaacctactgagaccagccagactcttccacggcagcggcacccttgtatatcgcccagcaatgcatgagggctctgatttctctatcattttgatgattcatccattgtcctgttgataggatctgggttgtttcagtttaggggtgctatgaacattctagaatgtgttttgcggtccacctctgccccgctatgcataaagttgggattccatagacagtaggtcctgttaggtaacaggaaaaatgatctgtgggctcctctctctccttggcacgtgtgtgtggcccacgttgcatgttcttgtagaatcctccttcccgggtgaggattggaagccatgatcgcctgcctctgttgctggttttagtctttaacccttgctctgtggacttgagaaatgtgcttttccatggtgcctgtgaccaagatgtccgcatcgttagtgaagaccctgctatgtccttgaccacactgcacggggatcctgtccacgatggggggtgtcctgttgggcttgagtgtctagatatggagaccgtagttcgcggggggagtggggggccgtttggcatatttgccctggcatttggggttgtttattgggggtgggagtgctcctggcatttcctgggcgggaactactggtgtagacctactggatta

SEQ ID NO: 92063 - DNA, 1317 bp, Homo sapiens
ggcgctgtgccaggcacagtggttttagagttgggggaatttgggccttgctgaagagggtctcaccaagcctatcctgaggattggagggtccagggtgcagtctggtgcctggcaggtagtaggtgctcactgcacacagctcctcccagctcggtcggggggtcctcatcctaaccccgcgggttttctttgccccgattctgcagacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttc

SEQ ID NO: 92064 - DNA, 1058 bp, Homo sapiens
cccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagaca

SEQ ID NO: 92065 - DNA, 1035 bp, Homo sapiens
aaaaataaaaaattagccaggtgcggatgcacccttctgtggtcgcagctactcgggaggctgaggtaggagaatccctgagcttaggagttggaggctgcagtgagccattacccttccactgcactccagcctgggggcaacaaagtgagaccttatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcgggtacgttgggcgggacttccgggaggtgggacggttcctgcgcccaggtgcaaggccaggcgtgcttgcgtggactcgtcgggggtcgggggtcgggggtcgggggttgggggctcctgtcccggggaccgccgaggaaatggagagcatgggcaggggactcagcatgggaagctggagagcttgatagagttaccagatttagcagataaatatacaggacgctcaattaaatttggattttaggtaaacaatgaataatttttagcataaatacgttccatgcatccaccttagcttgctgttttctaaatatgtgtgtgtgtg

SEQ ID NO: 92066 - DNA, 1060 bp, Homo sapiens
tttttagtagagacagggttttgccatgttacaggccaggctggtcttgaactcctgaccttaggtgatccacccgccccggccccctaaggtgctaagattacaggtgtgagccaccacacccagcctaatttttgtatttttagtaaaggcagggtttcaccatgttggccaggctgctcttgaactcctgacctcaggtgagccacccgcctgggcctcccaaagtgctgggattacaggcgtgagccactgcgcctggcagtccttcctaaatactaagttctgtaaactgctgggcgaagccttagcctggaagagtccggtggcgggacttgactaagcggaagatgaaggctggacctgccaggttaaatctctttcctctccaacatctctggctgatgttctgcatttctgtcccccagtggcttgttgtcagaggccccaaatgaaaaactcttcttcgtggacactggctccaaggaaaaaggtgaggagaggcttttgtggtgtggaatggcggttattcattgttagtcagcttacggtagcctctgagatctgtgttaatgatgtggcttggaaggcaaatatctgcggaaacaggtcaaccttaatataaacaaggggacctcaaatgggcagaaagcaagctggagacgaacttagagaaggcaggtttttcttttgagatgtcagtgatctccatgcacagataagctgctgggagtctgccttgatgaataagttagaaacacattaaaggatctctttttagcttgcagaaaagcaagtcaaggacctgcttaactcagtcctgccggttgcggtgagtcacgcctgtattcccagtactttgggaggctcaggcaggcagatcacctgaggtcaggagttcgagaccagcctggccaagatggtgaaaccccgtctctgctaaaaatacaaaaattagccagttgtggtggcgggcacctgtaatcccagctacttgggaggctgaggcaggagaatcacttgaacctgggaggtggaggttgcagtgagccgagatcgc

SEQ ID NO: 92067 - DNA, 1061 bp, Homo sapiens
gagggtcagagcttgggcaccttgggccccatccttaggggcctctacctccaggtaggagcctggggacctccaagtctcctggggtgacttgggattcaggtctgatggctcccatggaggtgaatagggtgggtggtctttggcagtgggtagggctgaggccttgacttgttctctttcccattcttagggctgacaaagaagagaaccaaagtccagaagaagtcactgcttctcaagaaaccccttcgggttgacctcatcctcgagaacacatccaaagtccctgcccccaaagagtgagtgtcccagcatccctgggcccttctttcccaccagactctggtcctaaagggtttccggggctgggggctggtaggtgagggtcatttgaagggtagggcaggctcaggtttgggcttcggagtgcagattagagggagggagtctgggtgccctggtgctgggccgaggcaggtgaggaggggcctggacccagctgggggcttcggggttggagaggaggggctgagtgggaggcgtgttcaggaggcacatcaggtgggtcttggggcatgagcgggtgagagggtggacagctggccttcccctgagatggggatgtggaggagtgggatttcgggtgatgctgaggttggttttgacgtggtggtgtgaggtgcctggggtatgtccaggacggggctgttgcttcgttgagtctggggctcagaggggaggcctaggctggagacagacgtggggagaggagttctctgaagagggggcggagtgccaccttttggagagggggtgctgaagctgccttaatggtggaggaagcccgacggggaggaggccctgctgccgttcaggctgccacctcacctgctgcacttgtgccccctctccccgaccagcgtcctcgcccaccaggtccccaacgccaagaagctcaggcggaaggagcagctatgggagaagctggccaagcagggcgagctgccccgggaggtgcgcagggcccaggcccggctcctcaacccttctgcaacaag

SEQ ID NO: 92068 - DNA, 1014 bp, Homo sapiens
ctcaaaaaaaaaatgtgaagcgtgcaggtcagactgccttcacagacgtgcagagcaggtgtgagggcgagggtttgaggtgccctctggctctgtgcagggtgggtgtgctggtagacggggtgtggggaggaaagcctgggccggggcgggatccacgggcactggatgagggacagatgggaggtaagagggtctagtctcagtgtcccaggaggggttcagggacccatcctcactcccgcccctcagaccctgctctcagcggcccacgaggtggagttgcagcggcagaaggaggcggagaagctggagcggcagctggccctgcccgccacggagcaggccgccacccaggtgagccccgcacctgcccactccctcccctccccgggcctcctacccacccctgacactgcaccccgcctccccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctggtgagcgcctgggccagcggggcctgcctctgatgcctcgcccccttccttccttcctcccaccatgggctgccctgggtgctgcgggcagcctgcacaccccaagccccgcatgtggcctgtggtttgggctgtttgggatcctcacagctgagactcatttcccagcctcttccaggcagggctcgggctggggtgggacagggtccctggcgcttctgtttgaggggcggggtggggggaggtttctgcaccgcagaccaggggagatggatgacaaaaggggcttcagcaaacagctgctgggaaggcactggaggggccgctgatgtgacggggttaggaagggcctccggggacaggcaggtttgtgcagggaaggctccctgtgtagaga

SEQ ID NO: 92069 - DNA, 1411 bp, Homo sapiens
aaggcccaggtggccctgaggctggcggagctggcgcggcggcagaggcggcggcaggcgcggcgggaggctgaggctgacaagccccgaaggctggggcggctcaagtgagaaccaggccgggggttctgggagaggctggggagggggccgggtcccaggtcctgacaccttcctgcctttgttcaggaactgcccaccccccccatcgggagaccacctcttcccccacaaaaccccacattctcagaggccccttcttctccaggagggggctttggactgggtgtcctgggccccgcgggggtgatatttctgaacacccgccctgttctgcaggtaccaggcacctgacatcgacgtgcagctgagctcggagctgacagactcgctcaggaccctgaaggtgctcactgtgtcctgccgtggagccccgtgcccagtgatgacaccatccttgctccccgtgccccccaggggctatgggcgacaccatggctgcccctgggctgggccagtggggccaatgcccaggggctgagggcacgggatgctgggatgagatcccagggtgaggggccaggctaaggtttgagtccgggaccctaagaaggcctttccttccagctggtccctgttgcagtcccggtcacctttaggactagagggaccttcctgaagctcagaaccaaccctgtccctcccctgctcggaacctgctgtggctccccagtgcccctgaggaagcccagctcctctgtcagccacacgcctgggccgacccggccgtggggctccagccagttgtgctcatgagcggactgtgccttctccctctgatccagcctttgccctcgctgtccccttttctgtgtcgtcaccagcccacttcccgtgactcctctaagcccagcttagagatggccataggttggtggctgtcatcccaacactgagccccagcagctgagggccaggctgagtccctggtgcccacaggctgccctggggggagactgcatggggctgagccctgccaggaccccgaggagaggtccaggcccttgggcttctgccaggccctgctgaggcctccctctctgtcctgtagcccgagggcaacatccttcgagaccggttcaagagcttccagaggaggaatatgatcgagcctcgagagagagccaagtaaggggcggccggggctgctgtggggcgagggcatctgggattggccccgggcactgattgctccattgtccctgctccaggttcaaacgcaagtacaaggtgaagctggtggagaagcgggcgttccgtgagatccagtgagtccacccggcttcggcgcaaggaagggagcccttctcccaccccgtggtgcccaccgagtcccagggccccttccaga

SEQ ID NO: 92070 - DNA, 1777 bp, Homo sapiens
gggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaaggtaagcagagtggatgcccggggggcattcctgggagctggggaggggtagagtgcatattgggagggggctgactggtatgacccctgctgtgacctctcaccgcgttttcagtatcttcagctcaagaagaagttagaagatgagttccccggccgcctggacatcgtgagtcttgggatggggagaaagacttgagcacagccactgtgtcggtccgttaggcctggatggcactgcaggggggttaggtcagccctacgcccttcacccatgttctcatccccctgggaaggggagggtctccccaagaggacatcttagcccctccaacatctcccctaccccctttcctcagtgcggcgagggaactccccaggccaccgggttctttgaagtgatggtagccgggaagttgattcactctaagaaggtatgtctgtctgtccgtcctgcctggttttggggctagcatggggttggggctgaggttggtgtctcggtcccagctcaccccttccctcttcctcccctccctagaaaggcgatggctacgtggacacagaaagcaagtttctgaagttggtggccgccatcaaagccgccttggctcagggctaatgcgccctgaaggcagaggtgagggggcccactagacagggacaccaccctttggatcttctccctgccccatgctctgactccttggcccagggtggagagcctgggagatgggggggacatcacgtgtgtccccagagcgagcgggataaagttagacccggttggtggaggacaacaactgagatggggtcagaggtgtgcagggtgacagctgagatggtgatgggtcagagatatgcaggatgacagctgagatggggtcaaaggtatgcaggatgacagctgagatggtgatgggtcagaggtgtgcaggatgacagctgagatggtgatgggtcaaaggtatgcaggatgacggctgagatggtgatgggtcagaggtgtgcaggatgacggctgagatgctgatgagtcagaggtgtgcaggatgatggctgagatggtgatgggtcagaggtgtgcagg

SEQ ID NO: 92071 - DNA, 1050 bp, Homo sapiens
cctcaggtgatccacccgcctcggcctcccatagtgttgggattacatgtgtgagccaccgcgcccagccagaaaggtgttcaaatttgagtgtactgaattagaggcattggtggctctctctaatggaggtatctgtagctggtgtattgcagagagacacatcacagctgagatagaggctcatagagttttgagatcaattgcaaaatggaaagtactgaaaaagcccaggaattctgcataactaaatatatagcgatcctagagtcatgcaatcagttctgagacagatagaaacagaatattaagagggttttggaaagaggcatcagaaaaaaatggcggaaggtcaggattgtgttgtcccggaagccagtgaaaagctaacttccagacatctagcattaggagactagaggagaatataagtttcctgtgctagtattggaggctctagagacttagaaaatagctaggatggtttatcatggggcaagctgaggggccggctagagttctgctgctatgcgggagagtaagcgaacttagcaggtttggcctccaggggtggtggagcctttcaacccatgggttggtgagatgtagagatgtgaggctgggtgtcaaaagaggtcggctagaagactccaagcacccccatattttgtgaaacactcaccagttccttgacaaaaccattcaaaatattcttcccatgactttggtttcttaataaacttcatgtttttccagaaaaaataaccagacaccaaaacatctctgggatttctcatgagataaatcaccttaaatggaaaaacgggagaatgaaaaatcaatacagtcaatcctcactctttttgatcttcacaaaaatggagaaaaagccaattcctggataatgcctaataatatcaatggattcttttaacaaattacttactgcactcactaatcaaatttgatgtgcctatgaagtagtcactgcactaggaatatatcaatggaagaaggaagcatcgttccttccctctgggatattacagt

SEQ ID NO: 92072 - DNA, 1050 bp, Homo sapiens; identical to SEQ ID NO: 92071

SEQ ID NO: 92073 - DNA, 1053 bp, Homo sapiens
acacctctagtcctagctactcaggaggctggagcaggagaatcacttgaacctggggaggtggaggttgcagtgagccaagatcgcaccaatgcactccagcctgggtgacagaatgagactgtgtctcaaaataataataataataataattcacacacctataaacaccttccaggaaagtacaattctagaagcagtctgagccatgcaaggtcctggatatgccttgtccctcttgtgatcacccctctgccccatgggagatgcatgtggctgctgatatcaacacatatttacacacagtaagacgaagtgtgtacagagcccagtcctggccccggggcagtcaacctggatacaggcattgattgatgaacatgctgcttcccataggaacacctctgtgtcttttctgtggcaggaggcatttgttgaattcagattggctaattattttttagggcaaccaaaggcggttatctagtatataatatggctatacattctgattgcacttagaacctagttttctaagattctgggttagtgttttcaccctatccctggtttaaatctggctggggtaatctgtggaatggtctatatccttgaactcaaggacagttctgggagcagccacataggtgtcacctaatacggaatctcaggtctcaacaacacagacctgttgaaggagaatgcatttcagcaagatctccagatgacttataggcatatcagtgtttgaaaggcactgatcaaacacgtcttaaccattatgcactgaccttggccttggaactgaagaaagacttggggaataactggatggggaggtgggaggagaataaacgtggactctccgtttcactgagtgctgtatacccaatctcactctctacccagggtgatcgctcccagatgggcacagattggatccacttggcatcccccttggagtgcatcaggcagagaatctcagccaaccagtttgttcctggaaaaagaaggaaaaaaatatataaaatgtaccatctcagccggacatgg

SEQ ID NO: 92074 - DNA, 1053 bp, Homo sapiens; identical to SEQ ID NO: 92073

SEQ ID NO: 92075 - DNA, 1895 bp, Homo sapiens
atgatcttggctcactgccacctccatctcctgggttcaagtgattctcttggtcagcctcccgagtagctggaactacagacgtgcgccacagcgcctggctaattttttatttttagtagagacggggttttgccatgttggccaggctggtgtcgaactcctgacctcaggcaatccacctgccttgacctcccaaagtgctgggattacaggtatgagccaccatgcccagcctgtcaaccacttttaagcctacggtttcgtagtgttaagtgttaagtatattcccagtgctgctcaaccaatctccagaggatttttgtgttgcaaaaccgaaactctatgcagagccagcaccgactccccatttacccttctcttcagcccctggcagccgccagtgtactttctgtttctatggacttgatgactccaggtaccttatgtaagtggaatcacacactatttgtatttttgtgactggcttatttcatttagcataatgtccttgatgtttatctctgttgtatcatgcatcagaattttcttccttctcaaggatgaataacattccattatagctatataccacattttgtttattcactcacctgtcagtggatatctgggttgcttccatcttttggctatttgctgaaatccctcttattatgttcccattgctcttggcctctcagggccatgccacttccaatgtcttcagcctcaatcctcaccgcatccgcagtgctcttaccgccctccacccacagccccactcccagagacatatgatcctcatctttcagccccttgagattgcctggctcttttgtggttcctggccattgccctgatgattctcctatctgaaaatagccctccccccaagtaatttcatactcattctttgcatttccatttaaatgctatttcttctttcaggacatcattggtcatcctcagccatcctccctcccactgccaccaaacaaacacctgaatttgccttgggattcactcctgtggattctcctaataccttagattacccctctgaacactcatcctactgtgtaatttcctgactaaatccttttctctgattgtcaatggtattaggcattcctctcttccccttaaagcattgtacactgtctgacataaaggaagaactccaatcatgcactgaatggacaggaacacaaccacagcctttctcagttcacgattctgcctccttacctgatttggggtaagtcaatattattacatcttcatcccttatcacaaactcatcacgtacttttcttaaggtttcggatctgaaacccatagtagggaaagctatgccttcaaaccataagaaatcgtccgacatgatgatgacctcttcctgcgtggtgtgagggtttcaactgtagccaccgctggaggctgtggcagctacaggcagatcagcttttacagcaaggataaaacgatctttaaccttgtcccagcatgtcacatgtttgttgtaaagtttacttgctgataaagagaggtataatgtgacccatactcaaaagattgaagatgttgagcaatcatgaacttatctagagaccattttaggggtcatctgagcttgcgttcctgagagtgaactgcaagatcgaataacaaacacgaggacaaatattttttttgataatatgggtgaatttatttcttaaggtttgagtgcaaacttaaaaacaagaacaaagcttttcatcaagcataaacacaaaatctaaataatcctgcaatcgtgcattttaacagaaagtacaaatatgaatacattataatttgtaactgcatttaaaaattaaaatatgtctctccaaatccaaaagaccacacag

SEQ ID NO: 92076 - DNA, 1895 bp, Homo sapiens; identical to SEQ ID NO: 92075

SEQ ID NO: 92077 - DNA, 1071 bp, Homo sapiens
tttgtgtgtcaatgatgtatgggggatattcaagtcatgaggctttataagattcctgtgtcattcaggattcagtcaggagacagaaacgacacctgtaattcaaatggagaaaaatgtaatataaggatatattataaatggtgaaagggtattaactagaagggataaagagaatcttaagaaccctaaggaacagcagattgtaggaagaagccactacctgtaaggcagggagagggggagagagagagagagagagagagagagagagagagagagagactttagaatgtatgtgtgtgtgtgagagagagagactttagaatttatttgtgtgtgtgtgtgagagagacttcagaatttatttgtgtgtgtgtgagagagagactttagaatttatgtttgtgtaagagacagagagagactttagaatttatttttgtgtgtgtgagagagagactttagaatttatgtttgtgagagagagactttagaatttatgtttctgagagagacttttagaatttatgtttgtgagagagagactttagaatttatgtttgtgtgtgtgtgagagagagagagagactttagaatttatttttgttttattttatttttattttatttttgagatggagtctcactctgtcactcaggctggagtgcagtggcacgatcttggctcactgcaacctccgcctcctgggttcaagtggttctcctacctcagcctctggagtagctgagatcacaagtgcgcactaacacacccagctaattttcgtatttttagtagagactgggcttcaccatgttgtccaggctggtctcaaactcctgacctcaagtgatccacctacgtcagcctcccgaagtgctgggatcacaggcatgaacgactgcgcctggtcaactttagaatttatgagaccagtgtcttattcttctctttttcagatatgtgggttggttgttgttatcctatttctgtcccaacattgtatcatgatatgttggggaaaaggactaaaatgtgtatttttagttcagaagtctccaaataag

SEQ ID NO: 92078 - DNA, 1071 bp, Homo sapiens; identical to SEQ ID NO: 92077

SEQ ID NO: 92079 - DNA, 1071 bp, Homo sapiens; identical to SEQ ID NO: 92077

SEQ ID NO: 92080 - DNA, 1307 bp, Homo sapiens
gatccacccgcctcggcctcccaaagtgctgggattacaggggtgagccaccgcacccggccaacaggcagcatttcttgagcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccggagcaggccaccaccagtgctcaggtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattctcttgcctcagcctcccatgtagctgggattacaggaatgtgacaccacgcctggctaatttttgtatttttagtagagatggggtttcgccatgttggccaggctgatcttgaactcttggcctcaagcgatccaccctcctcagcccccctaagtgctgggattacaggcgtg

SEQ ID NO: 92081 - DNA, 1050 bp, Homo sapiens
cggaccctgacaccatctctgtcccactctttggttctctctctccattgccctctctctctacatctctgtccctgtcccactgtgtctctgtctccttcctccaggtctctggccctttctctgcctctttttgtctttaatgtcctgcctcagcccccagggcctttcatttctttccatctcccattcctcccaactcccacctttctcaactttttacttcaagggggtcttgtttcttttcccttctttcactttctgtttctctttctatttctgtttacttcaagggggtgtcttgtttcttttcccttatttcacttcctatttctgtttacttcaagggggtgcctgtttttttcccttcctccctctccccagccctccaacacttggccttgactttgagattccagaccctctgttcctctcttcctctgctcactgcaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtgagtggcagaggacctggccgtggccctgtgtgggattctgggcgggcacacagagagcagagtagggaggggaccttggctcacatctgctcttccaggtaaggatcaggaagatgagcttgcattttatttgagtgtcagataaaaagatcaaaacattttttctttaaaaatgggccgggcatgggggctcgtgcctgtaatcccagcactttgggagaccgaggcaggcagatcacttgaggtcaggagttcaaggccagcctggccaacatggtgaaaccccatctctaccaaaaatacaaaaattagccatgtgtgatggcgggtgcctgtagtcccagctacccaggaggctgaggcaggagaatcgcttgaacctgggaggcggaggttgcagtgagccgagatcacaccactgtactccatcctgggtgacaaagcaagact

SEQ ID NO: 92082 - DNA, 1030 bp, Homo sapiens
tttattttaagacggagtttcactctcattgcccaggctggagtgcaatggcacgatcttggctcactgcaacctccgcctcccgggttcaagcgattcccctgcctcagcctcccaagtagctgggattacaggcacacgccaccacgcccggctaattttgtatttttaatagagacggggtttctccatgttggtcagactggtctcgaactcccgacctcaggtgatccacccgcctcggcctcccaaaatgctgggattacaggcatgagccaccgtgcccggccccatttgttcttatttaaacctagaaacccttcccatgtccagtctcttcccaggggccatccttggggttccttctggaagttcccttcagacttacttctagtccctcctcagtccactgaggagcccctccccagcagtgagggccccgccttgggcgctcccccttctcatctcttgcctccccttctcccagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctgg

SEQ ID NO: 92083 - DNA, 1052 bp, Homo sapiens
tcagtgaaaacttttggaattctaaggaaaggaggacttttttttttttttttaattatcttggggatgaggctggatgcagtggctcacgcctgtaatcccaacactttgggaggctgaggtgggtggatctcttgtgatgtgcacctgtagtcccagctactcgggaggccgacgcaagacagtcgcttgaattcaggaggcggaggctgcagtcagccaagatcgcaccaccgcactccagcctgggcgacagagcgagattccgtctcaaaaaaacaaaaacaaaaaacaaaactgatgagatgcccgtaaagtgttaattcaagctccagcaaggccgcagccccccgtctgatgctcctgaagtcaccgactctaaatggtgtcgggccctcttgccagtgactagccccatgctttaagctctcagaatccttctgacatcagggttcttccctctcaaggctttccacgaaccctgtcactagttgtgacccgcacatgtcctgttcgcctcacatttagggcttattgtctttattctcacaaagatgtctcatctctcttctccctgccggccctgcagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaaggtgagggtgctcacttttctctcctgaggtctgcagcttgcgctgaccccggcctcccagcctgtccccagtcctggaccgtttgaccagaatcctgcctgctccggcgcttgtgagccagggcttcccaaggaccacgcttctgtgtctccctcagactcctgcgaggggctgatggtgaagaccctggatgttgatgccacctacgagatcgccaagagatcgcacaactggctcaaggtgattctcgacccccaactgggccttctccaccccgggtctggaggtctgtcccagctaggcagtggatttcgagcc

SEQ ID NO: 92084 - DNA, 1280 bp, Homo sapiens
ttcaagaccagcctggctctactaaaaatacaaaaattagccaggtgtggtggtgggcgcctgtaatcccagctccttgggaggctgaggcggaaggctctcttgaacccgggaggtggaggttgcattgagcagagattgcaccactgctctccagcctgggcgagactccgcctcaaaaaaaaatcagaatgagatctagagcataatgacatttaaacaaatcagcacccacatgcagcaaggtgcatgtgcctacatggggagaggtgtagggattggaaatgaagaagaaaatgatggtagggccttccagagcagggctgggaggtgctgttggaactgaggagatgattcgctcaagtctctgcaccagttcctcctccagagcttccagaaccttctaccagtgcaggtggggtcagaagagaaagctgaggccacatgaggggactcagctgatttcccctcccttctcccatcgtgacagatccacgccctggaaggcggggaggtgaagatcttcagcaggaatcaggaagacaacactgggaagtacccggacatcatcagccgcatccccaaggtgggcgtctgccacacacttgcactctgccagggtctgtggtcaggggtgcaaaggcctgaggcccatctaggccagtgtggcacagtgcggggtttattgggaggagatcaggttgcgtttggctgcaaatgacagagcactcagtcctgcgtggtgtaagcccatatgattttttctcacatctagaggtgggcaccccagcaccgacttggctgagcactgatgtccccctgaaccaagcttatcgctacctctatcccctgctgtccttggctggttggcttttagtgccaatgcttgtccccttagagtttcccaaacagatgtcattcttccagacagaaagagggaaaagggattctagcttgagttaacactttcctggacacctcccacccacaacccctcccccgccgtggactgcagctgggagtcactgtccagcactgggttccatggccaccctagtgcaacaaagcctcggaaagccagagtctaactctgcagcctctccagccaggaacgcggggaggaggagtcaggacgagtttggagggggccagcctgtggataggccccaagcctcagaaatagcagctcagagtcatacagggctgggcctcacaggccccagagttggggacttctctgcacccagtaggggtctcgtgcctgttcgaggagtccccta

SEQ ID NO: 92085 - DNA, 3551 bp, Homo sapiens
aggtgcagggactcgccacaagcacacacagctggagaaaattcatccaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgctgtgagtggggcgggccgctcatcccggaccccagacatcttggggacctgaggccacgcgtgtgtcaggaaggcttctgggtagaccatcagctgggtcgcatcagtccttctcatggggtgcacagcttcctctcctccttcctgcacccaatcctaggggagtctcctcttcagagtctagcagacctaatgccatggctgccacatgacaggactcagtaaatacttcctggataaagggagagggaggcaaggaggagagctagctcgttcttactgccctaagagtgggcggccatgggagctgggacatggggatggggtgagggaaggagggcaggtattccaaaatgcagggcagcagcacggctggtggggtggaggtgtggtccctgccttcaccaggcactgacggctcttcccctgactctccagtccacagccaagaagatagacatcatcaaaggcctctttgtggcctgccgccactcagaagcccggttcatcgctaggtaagcgtgtgggcctgtgaggctacagagggggactgcaggctcggaggtgaaaggagggagggactggcagctggaatcatcacaaatgccctgaccatccttggatgagaaaagcatgagcaggaggcccagcccctaaagagtgggaagggacaccatttcctttcacaggccagcttctgtcccttggtagtgctgtctagagaaggcccctgggcccctgtgggtgaagcatgctgtgattgattggtgaggtctgcctcggcttgggcgcgggccctgcagcaggaagccagggtttgtttgccatgacagtgagagcaaatccattgagggctcacatcatggagcatttcttgggagccctgccctgtgccccgtgccttacctcatcagttcctaccagcaactctgtgagactggtcttgttaccctcacctccagtttatagaaggggaaatggagacatggggaggcaaactaagccacttgtctcctgccactggctcaaagcaaggaccatgctggggtcctgaccattacagtcaccagggcgggcgccaggctcagttctctccctgactcatcctcctcaagcctcgccaacccctcagggcagctgagatgggaggtgctggtgcacctacttgtgcccctccccagtctatgctagtgggcaggatcattactgcctggctcagtttcctcatctgtcacatggggctgtgtgatatctggggtcccttccaggctctgaagattcttctggtttttgaggagagggtctacatacatcaaggtcgaggagatcagagaagggaggaggcaagattggggaggtgcagacaagcccccttccctggcctgctctctccccaggtccctgagcggacggctgcgccttgggctggcagagcagtcggtgctggctgccctctcccaggcagtgagcctcacgcccccgggccaaggtgagctcctgtggcccgtctctgcatccctcgctggagttacctcaggcttcccccctcctcttcagaggcccatgcccgccccttccccagcgggcccctgccataccaggctcctctctcctgggtgggggggagggggcgtcttgggccgcggcatctgcattccttgccatacagcaaaccacccactgcaccctggtgtagccaaggatgtgggtgccttccaaagcctctggtgggtcttttcttagaattcccaccagccatggtggatgctgggaagggcaagacagcagaggccagaaagacgtggctggaggagcaaggcatgatcctgaagcagacgttctggtgagagctgggcagtgggtggagttgccaggggctgtgggcagagtgccagggtgggggtggagccagaggagcagtgggtggggccagtgaagtgacggacaggcatcacgagtgccggtcacggggtgactgagagcagaggtggtgatctagacaaggctggtgcttgacacaaggatggtgacaaagatcaggaaggtggcaaacagtgaagggtcagtgaccccaggagaggtatagaaagacgctggcagcggccaggcacagtggctcacgcctgtaatcccagcacttgggagcctgaagcaggcagatcacttgaggtcaggagtttgagaccagcctggccaacatggtgaaaccctgtctctactaaaaatacaaaaattagcctgtaatcccagctacttgggaaactgaggcacaagaatcatttgaacccaggagttggaggctgcagtgagctgagatcacgccactgcgttccagcctgggcaacagagtgagactgtcttaaaaaaaagaaagacgctgacagcaagggagggcagccggcaacatgaggtttctgagtgccagacagggctgtgcatgcagaaaggccttaagggacccagagaggagcaggtgactgacacatggtgaagggtcttgacagtcatggagaggacatccgtggagcggccacgagggctccagagagagccatgtggagggacctaggccagcagctgacccagggctggtgactccaagatcatgactgccccagagaggatgtcagaggcaggagggccgatggcagttccacagatggcctcagagcacctgctctgggccagggccccccactgggtgctgagcagagagtggtgaacaggcccgggcagcaagctcaactctgcctgcacgtggggctctatcagctgctgacctcaggcctaccccacaccagctacatcaaaatctttgtaggtggaacctagccttgaaaacctttgtctatttttattttgtttgagacggagtctcgccctgtcatccaggctggagtgcagcagcacaatctcagctcactgcaacttccgcctccagggttcaagtgattctcctgcctcagtctcctgagtagctgggactacaggcgcgtgccaccacccccagctaacttttatatttttagtaaagatgggatttcaccatgttggctaggctggtcttgaactcctgggctcaagtgatgcacccacctcggcctcccaaagtgctgggattacatgcctgtaggcatgagccaccatgcccggccaaaaacctttttttaaaaactgtattcttgagtggtctcctgtgtagccgagtagagaatcgctggtctcgtggtgacagatagggaacaggggcaaggccagactaag

SEQ ID NO: 92086 - DNA, 1005 bp, Homo sapiens
cttaggcaaaaaggggtcttttccagaaagggctattaccaatttcgtttcagagtcaagccacgaaccaaattccttcccaaagttagttctgcctatgcccaggactgaacaaggacagcttaaaggttagaagcaagatggaatcggttaggtgtgatttctttccactgtcataatttcctcagttacggttttgcaaaggcggtttcacctccagcaatctgtgattgtcctcatggctccaggccccagagcctgggactgttctgagccctttcctcttctttctccatttctttctagtgtccacccccttaaacccaccccaccccgacaccacactttgaccttgaggaaccacgtgttcatacccccgtcccctcctccaggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtaagggggactgtggttggagggaccagaaggacaggagctcagccagagaaaatgcagaggtcaggtggatcggagagatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagagacagcaggatttgggggctgagatggaaggttggggcttagagaggtctgaaaggactttgactggagggattggaaggagtgggaggaaagaacatggtgtgtggggggccagcagcctgaaggggcccagccgccagtgctgggtggaaaggctggtgatgcg

SEQ ID NO: 92087 - DNA, 1017 bp, Homo sapiens
cccaacatgagtggagcatttcaggctgttcccagcactctgtttttttttttttttgagatggagtcttgctctgttgcccaggctggagtgcagtggcgcaatctcggctcacttgcagctccgcctcccaggttcacaccattctcctgcctcagcctcccgagtagctgggactacaggcacctgccaccatgcccaactaattttttgtgtgtgtgtttttagtagagatggggtttcactgtgttagccaggaagatcttgatctcctgacctcgtgatccgcccacctccgcctcccaaagtgctgggattacaggtgtgagccaccgcgcccggccctaattttgtatttgtaatagagatggggtttcactatgttggccaggctggtcttgaactcctgacctcaagtgatcggcccgcctcggcctcccaaaatgctgggattacaggcctgagccaccacacccggccctcttctgtattttgtaaggatgctttttggattcagagcctaccttcattcactatgctctcatcttaatctacaggtacatccgcaaagaccttctttccaaatgaggtcatgttgtgaggctctgagtggacctgaattttgggggggctgttccatccactgcaccatccaatggtggcttttgcctacaatgattactgagggatttccctgatgttggtttttgtatttcttctctgcaccttaaaaacctcggtaatgagacttctgtaggaaaaacccagcttctgtttctaatgaggccccctaagtttttcagtaacaaagccattctttccagctttgaagttttagacagaaacacggttttcgttttagaggtggtgcagcttggtggctgggagcacagtcctcaggcacacggccttggtgtacatctcagcttcatacttactcgctctgtgaccttgggcaagccacggactctttcggtgcctctgtttctttatccgtaaaatggaaataataatggt

SEQ ID NO: 92088 - DNA, 1003 bp, Homo sapiens
ccaggaggtggaggttgcagtgacctatggtcgcaccactgcactccagccttggccacagagcaagaactcccccgcctcagacaaagtaaaagataaaaagtattcatagctttcagaagtcataggtgtaaattaaatgttattaattaagttagacaaccaaactgagttacaggattttagaggctgaagttaccctctcagggtggtccaagtgtccatgaggcccctgtgttagaaacaacacttgccgggagaattttagggatacagagttgtatctgattttctgcagctgctgggaggagtgggaatattttcttctcatgacgatgagatttctttttaccactattcctaagtctcctatttcaggccaagtgctagaattccgctagttagcactgaggagtagacagcaggcctgagatctcagctcaaagctaacagaaaggaaaagggtaggtgtagttatatcttccatctgcagggtcagaatgatcttgggggtaaaaaaaaagaaaaaaaaagtctcagggtcaaagagtttgcatcaccgtctgagctctctcaccgcagaagcagagaccccgacggaaagcgtttcagagcctgaggtggccacgaagcaggaactgcaggaggaggaagagcagaccaagcctccccgcagagctcccaagacgctcagcagcttcttcagtgagtttcccttgctcaccccacctcccggggttgtacaggcaggaggctggtgagcctctctccagaggcctgagatgctgcgaagacccttcttcctttcctgctggttggaaagtcggccttgtctctaccagcctgtctcccatctccctgagcactggggtggtgctgggtgcagaatggatgggaggtgggggctaccggaaggagaaaagacccactgttttctgtcttcattcctagccccccggaagccagcagtcaaaaaagaagtgaaggaagaggagccaggggc

SEQ ID NO: 92089 - DNA, 1049 bp, Homo sapiens
aggctcaagcgattctcccacctcagcttcccgagtagctgggattacagacacaccaccacgcccagctaatttttgtatttttagtagagacagggtttcactatgttgaccaagctggtctcgaactcctgagctcacatgatctgcccacctcggcctcacaaagccctgggattacaggcgtgagccactgcgcccagcctgtattttgttcttaaataaccataattacttgtgggaaatgccttggatactctgtaacatcttaaacagtggaattcaattgaaaactgccaacgtcatttcctgttctatgttgatttttgtacagtacttgatttttatagcagcaacctatgaaaacccagctttgcagagatgcaatgtcattgcaaggaatgtgatttaatactgaaaactgaaatacctcgaactagtagttcacacactggccagcaggtgtcgctgggtttcctttgaaaaatctaaaatatcttgcagcgcccagtgagttccctgcatgttggtgaacccaccgaaaacagccataaagatctgatcgattgatcatctggggcctgcatgagattacaccaattgcagcctttaacgtcatttggttttttgtttctgcaaacaaataaaaggtccattttccagggcagatttaaatttggttaagatctgatttcttggccaggtgcagtggctcacgcctgtactcccagcagtttgggaggccgaagcgggtggatcacttgaggtcgggagttggagaccagcctggccaacatggtgaaaccccatccctaccaaaattataaaaattagctgggtatggtggcatgcgcctgtagtcccagctactcaggaggctgaggcatgagaatcccttgaaactgggaggtggaggttgcagtgagccgagattgtgccactgcactctagcctgggcgacagagggagactgtgtctcaaaaaaaaaagatttgatttcttattgacaatttttagtacaaattttattgtaaactacacttttagcc

SEQ ID NO: 92090 - DNA, 1060 bp, Homo sapiens
tgtaaatgctccagagtgacccccgagatgcgaggcagctggggtatttatacaccaactcctgccgatcgtggggtgagggcctctcctggggctagtttattccctgccacttccagacttctgaggttccggggaagctgtctggaacacttggaggcagttaagatctgaggggagcagtggggagctcaggggacctgctggaatcggtactgtgccaagtacattacatcattgtttactcgtggggattatttctattctgcagtcgtgagagagcaaagcacagagaaattaagtaacctgcccaaggtcacacagccaggaagcaggagggattgaagggtgcggcctgcactggggcagtgactgtgtgcaggcagagaaggggagagggcccagagccttccagaggctacatcagtgggtgtgagctctccgggatgggagcacacgagccagcgaggtcagatacaccaagccctttgcctccccagctcggaagcagctcccgaaacggaccattcaggaagtcctggaagagcagagtgaggacgaggacagagaagccaagaggaagaaggaggaggaaggtgagcccccagaaggagagaagtgtgtgtgtgtgtgtgtgtgtgtgtgtgaagccaagaggaaggaggaggaggaaggtgagcccccagaaggagaggtgtgtgtgtgtgtgtgtgtgtgtgtgtgtgtgtgaagccaagaggaaggaggaggaggaaggtgagcccccagaaggagaggtgtgtgtgtgtgtgtgtgtgtgtgtgtgtgtgtgtgtgtgtgtgtgtgtgtgttttggatctgcaagggcaggggcctgagagctcaggatgtttggaccctgccgatttgatgcctgtgtccaggcatccaggaattccacctaccaatatgggaacttttgttctgaaaacattgtgggatatatttgtttggacatcttaatttagtaataattcaggcacagtttcccatttttatttgctatttttatatttatttaatggaaactatttttcctcta

SEQ ID NO: 92091 - DNA, 1734 bp, Homo sapiens
ctccagcctgggcgacagaatgacaccctgtctcaataaataaataaataaaaataaaactatacgaagaggtgtacatcatttcccctgacatcccattgtgtagagctggccaacatagtgaaaccccgtctctactaaaaatacaaaaattagccaggcatggtagtgcaggcctgtagtcccagctacttgggaggctgaagcaggagaatcgaagattctgttactgtagaaaacagaagagctatgggggtccttgatgggaccatgatcctgcactggagggcgggatgatggcccaggtgagaagaggccacccctgagttagggctgagaccatagggtcagaaaggagggtagacagagaggtttcagtcccctctactctcaacttttggaaaatggagtccctccttcccccgctcactctagaactgttctttcctcttccagaagcctgccctggactgctcacaggtctccccgccccgtcctgccacatctcctgagaacaatgcttccctctctgacacctctcccatggacagttccccatcagggattccgaagcgtcgcacaggtgagaacacacgggcccctgccccttcagtcgcctgcctttctttttctcttttttttttttttttttttttttgagacatagtctcgctctgttgcctaggctggagtgcagtggcatgatctcggctcactgacctccgcctcccgggttcaaacgattctcctgccttagcctcctgagtagctgggactacaggagcccgccaccatgcctggctaatttttgtatttttagtagagacggggtttcactatgttggccaggctggtctcaaactcctgacctcgtgatccgcctgcctcagcctcccaaagtgctgggattacaggcgtgagccaccgcacccagccagtcgcctgcctttctccccacttggattcccatccaaggtagtcatccttacaacagctctggtcttagtgttgtggttaagagcacgggtccaccatccactggctgtatgacctgggacaaatgactgaccttctctgagcttaggttgctttatctgtagagatgatgataatgatagcacctaccgcacagaaatatctgagttagaagataacacgtgtacgctgctcagaactgggcccagccctcagtcggggctcagtcattgtgggtcattgtgactgtagttatgcgctgagatggaggcctcacagctcatgtgggaacacaagcgcggggccatggctcaagggagacttccagaagagaggctaaccaagctgagccctttaggacaaagaagaggcaacaagcaaaggaggaggggagcatgctaggcaaggggaacatagaaattgagaaggcctgggggctgctgagggcctggtgtgctggcgtgtagagcgcaggattggggatggtgagcaatgaggtgagaaggtcctggaaaaccagcttggggaacagcgtctttgtcctaagggggacttggaatgtttgctgtggggtaagaacagggcgagagacccattcgtaatgcggggcagtgtgagcccttgccgtccggtctagcctattgagcgctttagcgtggtgagtgtgacaggggagctgaatctttcatgttagatcctttcagttgaatttacatttgaaagctaatatgtgattcagtgcgtaaagactttgcactt

SEQ ID NO: 92092 - DNA, 1057 bp, Homo sapiens
ggaggcctcttatctttttctctgatttggagcttttattctgcaccagtaaatctcaccagcaaattattttggttcataaaaacaggagtttctttttgaaggggaaattcatgtttctgtttttttttttctttctttcttaaagaaagggttttatgtgtgtttagatctctgcacaaccaatcacctcaacaagtgtttggatttctgttccaggagcagctgacagacgaagaaaagtgctggacaggaagggagaattctgacgccaacatgcagcgaagtatcatgtgagcaccctcccttgcccctgagtctttccttctccaagtcctctgtttctttctctaaatctgtacttaaaaaaacaaacaaacaaacaaaaactcttacgttagattttgagttggaatttccaggagtcaagtagtatggaaaatgagccgtgggatatggaagacagtgtattgaacaacagtttttagttgcaaggagcagaaaccctaacgcagtggttctcagtcagcagcaattttgctccccagggaacatctggcagcgtctggagattttttttttttgagttggagtcttgctctgtcacccaggctggagtacagtggcgcaatctcggctcactgcaacctccgcctcatgagttcaagtgattctcctgcctcagcctcctgagtagctgggattataggcacgtgccaccacgcctggctaatttttgtatttttagtagagacggggtttcaccacgttggtcaggctggtctcaaactcctgacctcgtgatccgcccacctcggcctcccagagtgctgggatttcaggcgtgagccacggcgcccggccagtgtctggagatatttttggttgttacaacctagggacagagggtttgccattggcatctagtggctaaaagccaggcatgctgctaaacatccttcaattcataggacagcccccccaacaacacagaaccatcaggcccaacatgtcaatagtgtctaggttgagaaacctcgtgttaatgcagtccggc

SEQ ID NO: 92093 - DNA, 1114 bp, Homo sapiens
cactgcgggataaggggtgcggggagcaaggtgcgggatgcggagtatggggccctctttcttccaagacacagggctgctctgcttctgtggtttccacaggagctctctactgtccatgatcagatcaaccaagaagctccaggctcagcctcccggctggggccctcactctcactgtaggccaagcacagcgtctcccctgacatcttctcttctgggctccgcatctaaggatgacctgtcatcccgccagtcactggctagacccccagcccacccttcctgtcccacctctgtgccccctgctcaggccctcttcccagcctccagttggtcccttccagcccattccccattctacccagtcctgccctgcccctcctctgggcacagcctggcaccagggaccctgcttcccagcctcactggacacaatccttcccctcgaatctgcgcctcagctcctcctgcatgcttgcggcgcccccaccctgccatccctcgttctctgcctttgcctgtgctgttcccttggactgaaatgccctttcctcttgttgggctggccaacccctgctcacccctcaccctcagctcagaggctgcctgctctgggaagccttcccggatgtcccaggctggggtggtgcccctgtgggttcctccataccctgggctctactgtgaagccccttagcccagcaccaagcaggcccatggggcagcctggggagggatgttgaactggtgcccctgagatgcagcagcccgatcctgccctggagggagaggtgtggggtccctggacacaggcagtcggtctgtaatggaggcggcagctggcacagcaggagcccgaggctgcatctgctcgtccgcgagaggtgatgtccatcctgagccttgaggatgaggcagtgaacattttccaagaacacaccaggggtggtttggcttgtgcctgggcctggaggcctgagagagcaggacctgttcagggtaaaccggctttttcagcatgcgctgcattcacaggggaggagcaggaggtgacagggagggcctcgtgtgccgggccacggagcttggactctgagagcactggggagcc

SEQ ID NO: 92094 - DNA, 1125 bp, Homo sapiens
ttgtgccactgcactcccgcctgggtgacagagtgagacaatatctcaaaatagaaataaaaataaaaacagaaataaaaaatactaaaatctccccaaattccacattttagtgattttaaactgcagtttttccaaagtcatgttttgtcatctctgaaattgggatgtaatttacaggtggtggtgtgacatcatttaattggcaacgtattttgtttttagttgcttcataaaataatcaggtagagtcagtggcaccttagattctaggaaatatggtaaagatgacttctacgtgaatggcactgtgttagatcatgagcccttgtgcagtatacgacatggacaaccatatgtgacagccctgcctagatggtgaatggggataagtgggaaacgggggaattatttaggggcaggacatctgattctggtatcctgccctcaacactcctgcccatgttcacccgccactgcttccttcatccccccggcaggtgacagtaaatttggatcagtatgtctacattcacttctgggccctgggccagcgagtcgggcagatgcccctgaagtccagcgtgggctccaggcgtggcttcttcaccaagctgccccctgcggagaggtgaggcggcccttgttccccagctgcagcaagagggagcaaggttagagtcaagaggggactgacaggtcagtgtctggtttgggtgtctgggccccaggcgggaagttgagaaatgggaggcgtgactcatccaaatgctgtcttttcttctcaagggaaagtgagtactacacttgattcccaggggaagagaaaggatggggacagttctccccattttccaataaggaaaactgaggctcggagagggaggtccacattctgaagatgcggcacggccaggattccaacaaacaatctgcacgtccaataccagggatcgatggcgcgattgaaccgatcccctgtggttggacacagctgatccctggtttcttccccatgattactgagtcgcttttaagatggttgtgcgactgtagagccagagtgagcgtcctaggattggagggggctccccgggcagtgcagtcccgatcctgctcctgcct

SEQ ID NO: 92095 - DNA, 1039 bp, Homo sapiens
aggagttcaagaccagcctgggcaacacagtgaaacctcatctctattaaaatacaaaaaatatatatatatattacccgggcatggtggcgtgcgcctgtagtcccagctacttgggaggctgaggcaggagaattgcttgaacccgggaggtggaggttgcagtgagcggagaacgtgacactgcactccagcctggcaacagagcgagactctatctcaataaaataaataaataaataaataaataaatgaaagtatctggagagggatgtccttagatgtccctagaatccttcatgcagagacctatcccatctttttctctctgactctcctcttaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtacttggctccctaggagaacaaaactcccaggaggcctctagggtggggcagagcctctgagaggcatgggctgctgggagttgtagtcctgagcctgggactgtggcccatatggcgcacttggtgaactcagagaaggggctacttttggctggatgcagtggctcaagcctgtaatcccagcagtttgggggtccaaggtgggtggatcacctgaggtcaagagttcaagaccagcctggccaacatggtgaaaccccatctctactaaaaatataaaaaattatccaggcatggtggcaggtgcctgtaatcccagctactggggaggctaaggcaggagaatctcttgaacccgggaggtggaagttgcagtgagctgagatcgtgccattgcactccagcctgggcaacaagagtgaaactccatctggaaaaaaaaaggaggtgctgctgtctcaggtcacttcactgccatctgttggaaaagtatcata

SEQ ID NO: 92096 - DNA, 1064 bp, Homo sapiens
gagcggagatcacgccactgctttttgcactccagcctgggcaacagagcgaaactgtttctttcttttcttttttcttttttttttttttgagatggagtctggctctgttgcctgggctggagtgcagtggtatgatctccactcactgcaaactccaccacccgggttcgagtgattctcctgcctcagcctcctcagtagctaggattacaggtgtgtgccactatgcctggctaattaagattgtttcaaagaaaaaaaatttacttaacttttctaagccctagttttgttatctcagagatgggacttgcagcacctactgtgagggctgttccttactatgagagtccatcagtgcctcaatagcatagggcctatagtggggtgctcaggaaaaggtggtgtcagcatttgctccgttgtcttgtttccccgtctgaccccttccttgtcctcccatctcccgcactgtgtctgggagttgagagctcctggctcctgtcacccaggggcacagtcgggccatgggagggcctcaccccttcgaagacccgcgtgatggtcttgggccttctcagaaactgcacggcttcgctgttggccagctcctggaggcttttggggatgtgcatggcagctgttttcctttggggccactgggaggtgggagccagggtgctgggcgctgcctgctgggcactgccgtccgggggcttcaggccagccctgggcttggctgctgtgggatgacacagatgggggatgccagtcaggggcacggggtggaagggctgttgggggccccaggattgggggacatggggtggggatggggggggtccccggaatggagttgtgtggggtgaggggactgctgagcctcttaggagtcagggtgtggggtgaatgggctgtcaggggccccagaagtcggggacgtaggatgggggtgcaggtgggtcccagggaatgaggttgtgtgtgctgagggggcttctgtgggccccaggagtggggggcataggatgggggtgctgggggtcccaggaatggggttg

SEQ ID NO: 92097 - DNA, 1100 bp, Homo sapiens
tcatgcctataatcccagcactttgggaggccaaggcaggaggactgcttgagcccaggagttcaagaccagcctgggcaacatagtgagatcccatctcttcaaaaaaattgaaaaattagctgggagtggtggcacacacctgtagtcccagctactttggggcttgaggcaggaggattgcttgatgccaggaggtcaaggctgtagagagctatgattgtaccactgcactccagtctgggctgcaaaacgagatgccatctcggaaaaaaaaaagaaactccaggccccgttactgaatgtgcgctgagtgaaggctgcccctcctggatgtggccctgttcccactattcccttaataggcgcttcacccactggggtttcctgcctggctcctacaggtaggaacgtttgtggcccgtgcctgagtcccccgcttaccactggggttctcctggaatgaaaactcctcctccccaaagatattctttgaaatatttgaagacaagggtctcccttgaatctcattcgcggactcagcaccccgttccttcactgactcctcacacgccatggtttttagtctttggtcaccatgaggagtgaaagggcttgggcttgagtgacagggctgggtccccttgttggcccttcctcttggtgctctctccacgggtggaagcattttctctctgaactttggtttcctcaactgtaagaggaggctccttgtgcctccctcccctggccagtgtggggactcaaggagtagtgacttgacaggacttagtgtgtaacaggcctgaagaaagtgcttcctggccgggcacggtggctcaggcctgtaatctcagcactttgggaggccgaggtgggaggatcacaaggtcaggagttcgacaccagcctgaccaacatggtgaaaccccgtctgtactgaaaatacaaaaattagccaggcgtggtggtgggcattacaggtgcgcacctgtaatgccagctactagggaggctgaggcagaagaattgcttgaacctggaaggcagaggttgcagtgagccaagattgcaccactgcactccagcctgggcgacac

SEQ ID NO: 92098 - DNA, 1712 bp, Homo sapiens
gaaagaattagttgggcatggtggctcatacctgtaatcccagcactttgggagactgaggcagggagatttcttaagcctaggagttccagagcaacatagcaagaccctgtcactataaaaaataaaaaaataaaaaaattagctgggcatggtggtgcacgcctgtggtcccagctccttgggaggctgaggtgggagaattgcttgaggaggtcaaggctgcatggagctgtgactatgccactgcactccagcctgggctacagagtgggaccttgtctcaaaaaaagaaagaaagaaaattgccagtagtgagaaagggtaggaaggaaagaaaccaggaatgtatctgtgagtcctgggggacctccctccctgtggatctgcccatctagcgtgcctgccctgctctggctgtgggaggctgtcccctccctgcaggggccccagcggtaatgccctccctgttttctctcctcacagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctttcttttgctgctccttgccactctgtccctggtgtgtatggggtcccgcccccgcccctctttctgcttctgcttttgccttattgactatctgtaggcgacgaggcctaggaggagcaggaagaggagaaactgggtctcccaagactctcagctgtgcagttcctcgccgtgctgctgggaagaggttttggagagaatcttgaagagtcttcttaccttggcacagaacttgtctgatggttctccaaaccctcagggttgcagaggaccttcaggagaattggctgggcatggtggctcatgcctgtaatcccagcactttgggaggctgaggcgggcggatcacctgaggtcaggagtttgagaccagcctgaccaacatggcaaaaccccgtctctactaaaaatacaaaaaaaaattagctgggcgtggtggtgtgcccctgtagtcccagctactcaggag

SEQ ID NO: 92099 - DNA, 1050 bp, Homo sapiens
caagaggcagaggttgcagtgagccgagatcaccccatggcactccagcctgggtgacagagtgatactccatctcaaaaaaaaaaaaaagaaaaagaaaaaggaagggaaatttccaaggcaagattccaacccagcctgcctttcagagaggcgcaattgcaaagtgttcatgagaacggactgcgaatccttggttcgaatcattgctctgctgcttgctggctacatggtcttgggcgagtatcttaccttctctggtgtcagtttcctcatctgtagaataagtgtgctaatcataggatctcctcgccgggccatggtgatgattaaatcagaggtaccagtaactcgggcagaactgtgtctggcacttggcagcacctggatcaccttccttctctccaccttcgcggcacctgtaactgcaatgttgtcctctgccttttctcccgccctgtcccctcccacctcatcatgtccccggcctctctgcagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaaggtagctggaatgtgggacggctggaagggaacctcctatttctgcagctcctgccctccctggggactggggtctccttacccctgtattatgcaaagaagggagcatttcttcgccgggtttctggggtggcaggcctaccatcctcctaggaattcagaccgttagcctctgcctccctaagggctaaggagtttctgtccttagcccccatgtcacttggagcgtaggccaggcagggcagggactcagcccactgaaattcattcatttattcatgcaacaaatgtattgagtac

SEQ ID NO: 92100 - DNA, 1343 bp, Homo sapiens
tcttcctttcttccttttcttccttttcttcctttctttcttttttcctttctctttcgacaaagtctcgctcggttgcccagactggaggcagtggcatgattctggctcactgcaacctccacctcccaggttcaagcgattctcctgcctcagcctcccgagtagctgagattgcagatgcccaccaccaagccaggttattttttgtatttttagtagagacagggtttcaacatattggccaggctggtctcgaattcctgacctcaggtgatccactctcctcagcctcccaaagtgctgggattacaggcatgagccaccgcgcccggctccaaatctgctagtttctattagcatgatcccgtgcatgtgacttgacctctctgtacctcggtttccacatttgtaaagttgtgatcaggtcattgtgagaatttactgagactttgcagcactgcctggtgtcaaaacacataaagactctagaatcagagtgtaaggatttggaccctgcctctaccatgtagcagctatgggattctgggcaaatcacataactaccctgtgcctcagtttcctcatctgtaaaatggagataatcagttcctatgtcatagggttcaaatgagaggttggtattaataaagcacagtatctgggatgaggtaggaagtgctgtgtcaatcaatgttcaatgactgaagtgtttagtcccatctctgatacttttacttttaaatgttcgctgttaatgatttttattccatggtgttttgctgggacctgtacaaactcctgggaggaattttgcgagagccagtgctaagtttgcgatctcttgcctcctggggcctggcaggaatcataaattcagggtaaccttttcttacctgtgcccactcctgccttataggaagataggcctgggtggccagatgtgctgatcttttcaacagaagccataattcaggagttttcaggcaagatgtctcattttaaaattttagccacagattcagactatatttcttttttttttttttttttcttttttgagatggactctcattctgtcgcccaggctggagtgcagtggcacgatcttggctcactgcaacctctgcctcccaggtcaagcgtttctcctgcctcagcctcccgagtagctgggattacaggtgcttgccaccacgcctggctaatttttgtgtttctagtagagatggggtttcaccatgttgacaggctggtcttgaactcctggtcttaagcaattctcccatctcagcttcccaaagtgctaggattacaggcatgagccaccgtgcctggccttc

SEQ ID NO: 92101 - DNA, 1048 bp, Homo sapiens
gaggggctgggcctggactcttgggtctgagggaggaggggctgggcctggactcctggatctgagggaggagggaatggggccctggactcctgggtctgagggaggaggggctgggggcctggactccagggtctgagggaggaggggttgggggcctggactcctgggtctgagggaggaggggctgggggcttggactcctggatctgagggaggaggggttgggggcctggactcctgggtctgagggaggaggggctgggggcttggactcctgggtctgagggaggaggggttgggggtctggactcctgcgtctgagggaggggcctggactccgggctctgagcctactggggcacaggcctgtgagttgaggccccttctcatcatccccctcctcaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggaggtaggcgccttgctgtgactccttatttggggggatggttgtggcagagtagctatgacaggagaccctctcacaggcttccttctgcagggtgtgcccaaactgccttattttaggatgcataagttcagtgcatgggctctggggtcagaggaaattaacacaacagcagcaagactcgctatgtgtcagtcactaccctaagcatttcacctacttacttttctcagcagccccactttacagatgaggaaactgaggcttagggattcttttttttctggagacaaagtctcgctctgttgcccagactggagtgcagtggcatgatctcggctcactgcaacccccgcctcccaggttcaagcaattatcctacctcagcctcccgagtagttgggaagacaggtgcacatcaccatgctctgctaatttttgtatttttagtccagacagggtttcacatgttgaccaggctggt

SEQ ID NO: 92102 - DNA, 1081 bp, Homo sapiens
gcctggactcctggatctgggggaggagggtctgggggcctggagtcctgggtctgagggaggaggctgggggcctggactcctgggtctgagggaggaggctgggggcctggactcctgggtctgagcgaggaggagctgggcctggactcctggatctgagggaggaggggctgggggtctggacttctgggtctgagggaggagaggctgggggtctggactcctgggtctgagggaggaggggctggggacccagacttctgggtttgacgaacgggctggggccttgagtcctgggtctaggggaggaagtaggtggggtatctttcttgtcttctgggggattggagttagagtgcctgaaagctgcaaaagctagcagctgagcctccgggtccctgcaggatttttcaagctcagagggcagtctctacatccctgcaagggctgaggctggtgtactggactgcgtctcttccagagacacagactgcctgggcgaaccggtgctggatttggcactttccgaaccctgcgaccctcccaagttcctatggggcagctttgggggtgcgtttagcgccgccacggcaaagcaggaggtgggcgatagggggcgccggggatccaggccccgccctcgggggcggagcctctcctcccggactcctccccctctcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggtgagaggcccaccagggctggcgaaggagagagattgcgggcgggggttgggggacgtcgcaggactcaggaagggtttgggggcactaggggcacaggtt

SEQ ID NO: 92103 - DNA, 1049 bp, Homo sapiens
agaccagcttggccaacatggtgaaaccctgtctctactaaaaatacaaaaattagctgggtgtggtggcatgtgcctgtaatcccagctactcagaaggctgaggcaggagaattgcttgaacccaggaggcagaggttgcagtgagtgaagatggtgccattgcactccagcctgggcaacagaggaagactctgtctcaaaaaaaaaaaaaaaaaaaaaaaaaggctggaggatagatttgtctggagctcacatgagaggttgtgactgaggacaggagccattaacatatccagcactgttcaataaaactttcagcaaagatgaagctgttctatagctgctctgtccgatttgaaagccacaagccacatgtggctgttgagtacttgacaagtggttagtgcacccagaaaactaagttttaaattctatttaacatttttttcctctggtccttgattcaggataaattttatttaattttaatttgaatagttatgagtggctaacagccaccctattggatagcatgggagacagtatttaaactcatgggcctggttgagatcaccagggagagaggaatagagaagagaacagtaaggcactcctagtgtttagaatttagaattctggctgaggaagaagggccagcaaaggaggcagaggaagaggtgacagagaggtaggaggaaaaccaaagaagggaaaggacactctgcaaagcttcttccagtagggaaataccatcagcaccctcattgcatgctgggagatgtagtctcctcactgccttcagggaaccagtccctctcagtggctgctgggggctgtagttcccttaccggatgctggttgtattaatgacagtgatgttagctgctggaacggatgaacccccaaatctcagtggatcacccaacaggaggttgtttctcattcatataaaatccaggccaggcacagtggctcacgcctgtaattccagcactttgggaggccaaagcgggtggatcatctgaggtcaggagttcaagaccagc

SEQ ID NO: 92104 - DNA, 1043 bp, Homo sapiens
cagcctggacttgattctgagagtagtggggagttcaccggaaatagtattccagtcaggggaaacgagcatatgcaaaaacccagaggggagagaaacttgggcagatggtgggaccacaatagttccaagcagatgaaggccacagaattaggagtcagagtgacaggccaggcgtggtggctcacgcctgtaatcccagcactttgggaggccgaggcgggcggatcacgaggtcaagagattgagaccatcctggccgacacagcaaaaccccgtctctactaaaaatacacaaattagctggacatggtggtgcacgcctgtaatcccagctactcgggaggctgaggcaggagaaccgcttgaacccaggagacggaggttgcagtgagctgagatcgtgccactgcactccagcctgggcaacagagtgagactctgactcaaaaaaaaaaaaaaaaaaaaaaaagcagtcggagtgtgggtggcaccaggcctttgccttcaatgcaggttgagaggcctggatctgttccacagcactggtgagccaggggtgggttatgagcaggagacgggtggcgtgagttttgggtatagaaagacgcctctgggacctggtggggaacagactggagtagagagattggaggctggaggccaggcaggaggctgggatgagggcctaggagggctgtggggaggcacagaagaagacagggcagagagagccccaggccaggaagaaggagacttggggaccgataggctgggtagcgggagggaggaaggcggctaagagtctagtccagtgactgggtggatgacatgagagacagtcagagtacccagggtgatgttgcatagtgaagatattgaggagtccagggacacccccggccatccccagccctgggcacttctaaccagaggaagagacatttgagctcagtctttaagacacatggagttggtcaaggctgggtacagcggctcgtgccagtaatcccagcactttgggaggtcaaagcaagtagatc

SEQ ID NO: 92105 - DNA, 1023 bp, Homo sapiens
cctgcctcagcctcccaaagttctgggagtacaggcgtgaggcaccgccccagcctgatccccgagtcttttgcttggctgagccataaccacgcactcccttgtccccagagccctacagccccgccgtgtgggtgatgatgttcgtcatgtgcctcactgtggtcgccgtcactgttttcatcttcgagtacctcagtcctgttggttacaaccgcagcctggccacgggcaagcgtgagtcccccttcctccatcccccgcctcggagatcccgaaccacagagacagagaactacatttcccagcagcccctggagggggggcggtcaagctagggcctctcgggaggtgccagatgccttgagggccactgggaattgtagttctttctttttttttttttcccttccttattgagaagggatttggggtccatgtccacgtcctggccccctgcaggccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaaggtgtgtgtgggcccagggctgggctggagctggggctggggctggaggtcacagagcttgtcatgtggtagattagaggggattcttgcggggggcgggggtgagaggggtggggggagggcgggaaggggtctcttcccaaggagaattccagaatggtagaatggaatgttgtggatgaagaaagaacacggttcacgatgagctatttaaaatattcctagggaagagggtgtccctgaatgttctaggggcagttgtgtcaaataggatattctagaaccagtgcttctctcaaactgtgaggaaggattaatttttgaaacttcta

SEQ ID NO: 92106 - DNA, 1471 bp, Homo sapiens
ctttggtaacatagtgagttatagaacttatctgatggggctggcatgaggtcaaatgaaataacatatagtgcctagaatagcacctggttgtaatatgaggtatgtattttctgttactattcaggaactgtttttggttgtggctgtttgttttgtttttgagtcatggtttcactcccattgcccaggctggagtgcagtggcgtgatcttggctcactgcaacctctgcctcccaggttcaagtgattctcctgcctcagcctcccgagtagctgggatcacaagtgcacaccaccatgcccagtaatttttgtatttttagtagaaatggagtctcattatgttggccaggctggtcttgaactcctgagctcaagtgatctgcccaccttcgcccccaaaatgctgggattataggcatgaggcactgtgtccagcctgtttatttgttttttgcttcaaagctaaaacatcttctgatcaggtagacttgtaagtacaatgatacggtatatgaagagcacttagagcagtacttggctgatagctggggctgtctgtttccatgaaattatttttactatgtttcagtactgttctagatgcagaggatttagcagcaagcaaaaggtctctggctccatcaacttacacactagtgggggaagggaacgagatgaaactaagtaaatgtgtaccatgtccaaaggtgttaactatcctggaaaaaatccaatgaagtaggggaagagggttagggtgctccaggagtggggtgctatttttaaacagtgtggttaggaaagtattctgtcataaaatgccatttgcatagatactcacaggtagtggggcagtgaaccctgtaaaagaatttgcaggcaaggaaaaacacaagttcaaaggccctggggtgagcttggcatgtttgaagagtttcaagtgaagcgggagtgtccagtctgtctggagcagaatgaacaaaagggagaatgacacaatttggggagcgggcacagagaagacattgttcagagccttgtcggccactgtaaggactccagcttttaattgggagacgttggagggtttcaggcagaggaaagacagggtctgacttctgttttaaagtggtccctctggctgctgtccttaaatatcaattgcagagaggtaagggtcggaggaaagaatcctgtggggagacttacggtattcaggggaaggatgacatcagtagtagtgtgacagcaatagacatcatgagaagggggttggaagtgagcttttttttttagatgagacagagtctcgcttttgtcgcccaggccggagcgcaatggtgcgatctcggctcactgcaacctctgactcctgggttcaagcgattctcctgcctcagcctcctaagtagctgggattacagccacccaccagcacgcccgactaatttttgcatttttagt

SEQ ID NO: 92107 - DNA, 1103 bp, Homo sapiens
ctgcatgctcaccacagccaccgcccatgatggggacgtcaatgtcatcagctggagccgccgggagcccttcctgctcagtggcggggatgatggggccctcaagatctgggaccttcggcagttcaaggtattttcccagccggacacctgggggctagagaagcttgctcccagcagcccctgggatttgtaggatttttcctccttgaatagttttacacaaccagagctggagagcccttagaactagactcctgcctcttcagggtacagaggaggaaactgaggctcagcaagaggaagggtggcgggtctccactcttggggtcactcactctaccaggggaacagctgacaagagatggaaggggctggggcagcagagactaggactctcatctgcctgtgggcagaagtacaggtgtctgtacggccagtgctgagagcttcagagagttgtagatttctagatgcaactgagaatcggggcccagcctgctcgttgtaggagaagactgaggcacagaaaggacaggagccgctgtgacatgacagccaagctagaggttgacattgtggagctgggagggtccctgtgcaggagaagttgcagcgtccggcatccctctggacaaagccgcagctttgtgtggctctgccttcccgggctgccatgatgtcatcctttttctcctccagtttgatcgtttctatagcgtcagccctggggaggaggctggagacggattccagcctcccaggcccaccaggtcacacagggcccagcttgttgaccattggaacttcagagcagcctctcctaatgagagagacgccaattgagcggggcctttgctgtagtgaaagtgctgtcattcttagtctttctttgggtcggcttccggggattgtgtttctgcctcctttgaggcctttgtagaatctgctgggagagctctgggagagccatgccctcctttttttctttttttttttttttttctttttttttgcgatggagttttgctcttgtttcccaggctggagtgcagtggcgcaatctcggctcactgcaacctcccgctcctgggttcaagcga

SEQ ID NO: 92108 - DNA, 1034 bp, Homo sapiens
aaacaggcaggcagagggaagagcaggggcgggggttttgctacctgagctgggaggggcttctttgcaggtgaatcacagttcccagcaacccctgggctggtcagccttcttagcagccagaattaccctgtgtccctttcctggactctgggcttgtgagggcttaaggggtggggccctggctgaaccctgaggctggagaagggttggggcttctgcctgggtcctccccagagtcaggctgaggcattcagagcccgttcctcccatcctctccctctagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaacccagttttttgtttgtttgtttgagacggagtcttggtctgtcgcccaggctggagtgcagtagcacgatcttggctcactgcaacctccgcctcctgggttaaagtgattctctcagctca

SEQ ID NO: 92109 - DNA, 1013 bp, Homo sapiens
ccccaggttcagtgcctccaactctcaccccatccccattttatgcattttctcactggcttccatcctttcagagaaaccctctcagtctgtctgtctctgtctctgtctctctcccccatctctgtctctcccatctctctctgcctctctctgtcttcacaatttcatctccccatgtcgccatttcttaaaacatttcttttctccttttcgttttcccaattgccctgtccgcctctatcttctctgtccccctccatctaggtctctgtccccccctctctctgggtctctgtccccctctgtctctgagtctctatcctctcaaggtctctgttcccctctctctgggtctctgtcctctctcaaggtctctgtccctttctctctggatcaatgtccctttcctgctgccctctctgggtctctgtccccctctctctcagggtccctgtcctgcttggtccctgtactttttcttggggcaccctctcaacacccctcctcctgcctatctctgcatctctttgtctttctgtagtctctgctttccaacctgctgtccagcccccaccagtaggtggggagtggtggggaacacccctggtttcggaagagtgagagtgttgatttgggagggtgagggtggggcctgggggcggggcttcttggcctcagattagacagtgactttgacacgaagttgaagcaccttaagccctgtatctcctttatatggaaacattaagctgctctcgcaggtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctg

SEQ ID NO: 92110 - DNA, 1028 bp, Homo sapiens
agctaggcatggtggcccgtgcctgtaatcccagctacttgggaggctgaggcaggcgaatcacttgaacctgggaggcagaggttgcagtgagctgaggttgcggtgagctgagattgtgccgctgcactccagcctggcgacaaagcacgactccgtctcaaaaaaaaaaagaaaagaaaagaaaaaagttaaaaaaaaaattacccaggagtggtggtgtgcacctgtagtaatcccagctactcaggaggttgagacaggagaatcgcttaaacttgggacgcggagattgcagtaagccaggatcatgccactgcactccagcttgggcgacagagcgagactctgtctccaaaaaaaaaaaaaaaaaaaaaatgcgtatcgttccacctatttgacagatgaggccactaagccccaccagaaagcatgcttggccgatgagctcatccattcctgttgcccctgacgtttctgccggtttcttgtcccagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtg

SEQ ID NO: 92111 - DNA, 1128 bp, Homo sapiens
acagccatcggggactacctgggggagaggtacggtcaccactcagctcctgtggggcccctccctcccaccccccagacccagctcctgccctcacactggcagctcacaggtggaacagccctgcagcctccccgcagaggggccctggcagatcagccttctgactggactgtgacagaatggactgacatgggctaggggagcctgcggccaaccgagagcatctggggatgtggggccttctggaattacctggcagttgtggggaagcatccatttatgtctgagaagggtagagaacatctctcaaggatcatgggagcttgagaaccgtgggtagaccatggctgtgcataggcactgggtggccatctgggagctgtggggaccgctgggcccttgtgggagcttaggagttgtgggggtcatttggaagcctagggtgcacaggactggacatcagatgattggaggccatctgtggacgtctgggaatcagggatttatagagatctggggtgcttgggaagcatctctggatgtctgggggatgtgggggctgtgtctggatacctggggagcatggggatcatttgagagaggtgacagtaggtagcatacatgtttgcggcatttctcccaactgtacaaaggtctggcctaagcagggttcccaagccagatattcctcccaagagtgtgttctgagcatcccccaccctgggggcaggcctgtgtgggagtccagcaggaaacttcaccctcggcagtgggcagctgtggtgcagtagagggggcacgacttccccagggcattgccctttgcccattcctgccccatcctttccaaactgtatgtgtctttgtcccatccttccagggaagaactgaacctggcagtgctccatgcttttgtggatctgcatgagttcaccgacctcaatctggtgcaggccctcaggtgagtgagggggaggggtttggaacgccaggaatgtacctgtcagggccttcctagttacaagtgacaaaccttactcaagaaaaaaacagaaacaagcaaaacagaaacaaaaactagggaactgagtgtgtcctgcaccataaaagttcagggttatggcc

SEQ ID NO: 92112 - DNA, 1031 bp, Homo sapiens
gcagaaagaggctatttctgtagggattcacaacactcccgtggccaatgcccattggtgagactggatcatgtgaccatacctgaaacaactgctgaggccggaaggtcgggattcctcgtggaccagttcctaacacagggactgagagtggggacaggctcccaccagccctggcatccattcctggcccctccccaacccaggcagtttctatggagctttcgcctacccggagaggcccagaaaattgaccggatgatggaggccttcgcccagcgatactgcctgtgcaaccctggggttttccagtccacaggtgcgggccccaaatcctgggtcctgggaaagaggagactggggcccagactcctaggtctgagggagggagggggctgggagctgggaatcctgggtcctggggaatgggggcactggggactgacatgcctgggtcgtcaccacctgccctgtccggtgcagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcagggtcagtcccccttccctgcccctcagccctgcccctcttcctgccacagacacccccgccccacctgtggtctcctagtgcccaagctgtctgccctcacccccaagatggtgcgatcatgccaactcgtgtgtgatctttttctctctctctgggtgcttctcttcttgactgtctctctcaggctttggccctgacaattttggcctgtctgtcttctctgtctctggctgttgggctttccggccctcgattggcctcattccccatctgtctgtttctctgaggacgtagccggctcctccacctatcaccagggcatctcttctttcctccgccacctcagcctccctccacttctctgcctttcacttccctctcctccccactacccctctc

SEQ ID NO: 92113 - DNA, 1047 bp, Homo sapiens
tgctctgcttctcacgcccctcccatctcccagaggccctgtccccctgttgagcccaggccccctcccaccccttccctttcagggggccgggtgaagacgtggaagcggcgctggtttatcctcacagacaactgcctctactactttgagtacaccacggtgagcgtgacccgacccgggctctggggtcctgggcggagtggctgggagcctggactcctggggctgagggaggtggggtggggtgaggacttggaagtctgagttctgtccaccttgcttcttcaggacaaggagccccgaggaatcatccccctggagaatctgagcatccgagaggtggacgacccccggaaaccggtaagaccctctctgtacaccttcctgccagggcggggcctcctctgcccagggctggttcttacctgcgcccttcctctctcgtccccagaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccagtgagcctggactcctgggcctgatggaggaggggctggggcctggactcctgggtctgatggaggaggggcaggggcctggatgcctgggtctgatggaggaggggctggggcctggacgcctgggtctgacggaggaggggctggggcctggactcctgggtctgacggaggaggggcaggggcctggacacctgggtctgacggaggaggggccgggggcctggacccctgggtctgacggaggaggggccgggggcctggactcctgggtctgacggaggaggggccgggggcctggactcctgggtgtgagggaggaggggccgggggcctggactcctgggtctgagggaggaggggccgggggcctggactgctgggtctgagggaggaggggccgggggcctggactcctgggtctgagggaggaggggc

SEQ ID NO: 92114 - DNA, 1018 bp, Homo sapiens
agacccaggagtccagacccccatcccctcctccctcagacccaggagtccaggcccccatcccctcctccctcagacccaggagtccaggcccccatctcctcctccttgagacccaggagtccagacccccatcccctcctccctcagacccgggagtccaggcccccatcccctcctccctcagacccgggagtccaggcccccatcccctcctccctcagacccgggagtccaggcccccagcccctcctccctcagacccgggagtccaggcccccagcccctcctccctcagacccgggagtccaggcccccagcccctcctccctcagacccgggagtccaggcccccagcccctcctccctcagacccgggagtccaggcccccagcccctcctccctcagacccgggagtccaggcttcagcccctcctccctcacacccgggagtccaggcccccagcccctcctccctgagacccaggagtccaggcccccagcccctcctccctcagacccaggagtctaggccctggtctttcctccctaaggcccaggagtccaggcccccagcccctcctccctcagatccaggagttcaggcccagccccctcctccctcagacccagaagtcctgcccccagtcaccagcccttcctccctcagacccagaaagtccagctctcaccttccccccgctgccttggttcatgcagcacccacccaccctgtggcaggtgtctcaggatcacttcaagcaccaccaagtctcccagcaggacttattgggaagaagctaaaaccttatcctctctctccctttccccaatcccccaggactcacatgtgaccctaatgccgccatcaccttaactccgaggccagagtctacactacagcctccctaacagagggaaggggctgggttcccaccccttgctccttccctctccccgcatccagactacatcccgcaaatacaccagtgaacctggtaccaaggtgatggggga

SEQ ID NO: 92115 - DNA, 1001 bp, Homo sapiens
ccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggccccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggaccc

SEQ ID NO: 92116 - DNA, 1036 bp, Homo sapiens
agcctgggcgacagagtgagactccgtctcaaaaaaaataaaaaataaaaagagataaggaaataaatgcagaaagagagatggagtcagagagagacagggagagacaaggaaacaggaggagacaggcccctggtactaagaaaggcagcgccctttggccacgtgttcctttctctgctgctgtcagagaccctggctttggagggaaatccaggtgtgtggaggcggactggatggacagatagacaaaggccccccaagatgggcaaccaggggagaagcaggttggaagagccccagaacttggtggaaatgtgggggctctgggggagggcatccagctctgggggctggacctgggggtttgtggggcacagctagttagacccatgagccccagtggggctgggggaaccccgccactcagccctcaccccacttgtccctctgcccacagtgcagtttggctcctggttcgaccacattaagggctggcttcggatgaagggcaaagacaacttcctatttatcacctacgaggagctgcagcaggtgagtccccacctcctccaggtgcagcgtcccccccataccctctgctcacaccccacactctccccttcccgagggtctcaggacccctccgcttccccatgcaatgcgccagcccctggggatactgcaggaacagaacagaggccctgagcctgtgagcaagaccacagacaaaatccctaaaccacacagcaggctggcggggcagaggagctgaggagcaaaggcgagtgggaaggaagataaggaatggtcaggggcgagatttaacccaggagggttggccggacacagtggtagtggctcacacctgtaatcctaatgctttgggagcctgaggcgggaggaccccttgagcccaagaggtcaaggccacaatgagctatgatggtgccactgtactccggcctgggcagcagagcaaaaccctgtctcaaaagagagagagaaggccaggtgtggtggttcacacctgtaa

SEQ ID NO: 92117 - DNA, 1179 bp, Homo sapiens
ggagcagggtcccccattgacagggtagggaagggtttgccaagccttcggcctttaaggctgagcgagcaggcccagtggagaggcatcctggctggtctgcgggtgagagctgatgagcaggagaaactcgtgggggctgtcagatttggccagagacagatgctccaacaggcagatactgtgactgtcagtcggaagccattggcgtttgccagacagtggaaggagagggtcagttcgtcgtgctcttggccgggggcaggcaggcaacctgtcgtgcctttaaggacctttgggtgattagagacaggcaggcagcttgccgcctggaaatgatcaagtggtcagcctgaccaaattcaggacagctgaagggtctgactgggcactgtgtgactggtgggttggaggctgtcgtgtggctgagcagagatggccagctgatgggtcacacagttggggatggtgtcaggaggtcaacctgaccagcagagacggctggcaggaaggtcacggaaggccagccaggcatggtgccactgggtgcaggcaggtggcggatctgagtggcctgacacattggatggtcgcttatttgggcagcgtgattgtcagaacagtgtggcaggggctgctgcagggagccatttggacatctgcagggccccgccggaggcctcggatggccacgtagggtctgcctatcaggagaacccccagatgatcacagtccccagagacagccagacccccggggacccagcctctcacagtcagtcctcccacccgagtgaccccgatggcggcctcccagctggcggcgctggaaggagtggactccggtcccagggtgcccggggccagccccggctttctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccaccgatgtggacgcgggcagcctgagctactggcctgggcagtcggagcagccggcgcccgtcctgcggctgggctggccagtggactctgcgtggaaaggcatcac

SEQ ID NO: 92118 - DNA, 1061 bp, Homo sapiens
gagagcacggtagacctgggagccgctgggtcttgtctgtctggaagggaggcaggacttggagctctgggagcaaccagggcatcaagggtttgtctcagccagtcgcgagcgtagagcttggactgttggttggaactgagtgtccatgggcagtgggcaagtctcctggtcctcctctccttctctttgtgaggtggaggtgtcctggtggcttcaggagattgccccaagtcataactgagttttatgtcaaaggctctgctgagggaggccctattgaacagtctgcatttttttttttatctggagctttccccagctggacctgaggagaggcctgtggggtttaaggggtgtggtgtgagtggggggtcccgttagagggcacagctgccctggcctggggatgcctcaagcggggctgaatgtaaacaccagaacaacttacgacgtacatcctccccaccctaagatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtgctggtccatcctcagtcttgccaccgctggtgaggcaagcatcctgcctgtctgagtggctttgaggattggtgtgggtcgtctctggcatggttgatggtggggtcccctgggcaagcttcttctggggcaagttgtaaactgttagtgctggcccctagagccagacagcctgggctcaagtctagactcctttgtcacctctgcacaggtctttttttggcccagcttccttgctgtagtttctagcataacaccagggatgtggtggtgaaagttccggaagtgttgagaactgctgctgtcagcccagggtgctccgggtagtaaacgatagtgttggttaccagggctctgctgcgccaaggcagtggagggtgagtcctggcagcccctgggtgaccacgc

SEQ ID NO: 92119 - DNA, 1008 bp, Homo sapiens
aactaagagtggctgcgggtccagccacctgggtcggaatcctggctctgccacttcctggctttgtaaacccagtcatatcagcctccgagtacctccacttggtcatctactaagtgggggcggtaggctatgactgacccatccctgctttcctggcccccagagtaggtccccagtatcgggaattgctccctccgggcagccgcagaccccctgccgccctccagcgtgcccctagcccaaaaccacggcggatggcagcggattatccagccccgaacgccgcaaagcgagctcaccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggacgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaaggtctaacccgagatgatcttgctgcacctcaatctatagcatcctgtattcccatcctttgagttccgcttctccttctcccccggcccctagatggcccttccctgacctagaaagagggagacagagtttcataggggaggcaaaatggagactc

SEQ ID NO: 92120 - DNA, 1025 bp, Homo sapiens
cccagagtgatgggtgccaacagaggtctagggcttccctggagttcagaggtggcatctaatcctgcctggggcccctaagggctggaagtaacctaatcctgggtaataggtgtttggggtgaggaaagtgggaaccacagctctgaactacagctcctcccacacatggggacaaagggcatttggtttcacacctaagccctgcctttgtctcagcagctaggagttggggcagggctgcatacctaggcctggccacatgagagccagcaggtcccaggggccagccctccaccaattccgttgggggctgatgaagggactgtttccaaggtggggggcctgggtcactggcctctgcagaccctaacctctctccacagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacaggtaagggccagtgagaatgggagctgggggctgggacagctgagtcctaagggagcaaagtggtgggtgggactcctgggtctatggggctggggtgggacagcctgcctaacagcccggtatcccacttcagaacgacagaaccacgcccgggagctggtccaggggctgagcctgagtgagtgggatggcatcgtcacggtctcgggagacgggctgctccatgaggtagagcaggagcaccctgcccctagccctgggccctgggggactatagagactgccaccaggacccaggcttctggtctcccaccctccaggtgctgaacgggctcctagatcgccctgactgggaggaagctgtgaagatgcctgtgggcatcctcccctgcggctcgggcaacgcgctggccggagcagtgaaccagcacggggggtaggttgaggataccacgaagggagggatgagcccctcctggggtgataggg

SEQ ID NO: 92121 - DNA, 1087 bp, Homo sapiens
cgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcagaccttctgcccttcctccatccgacagcccgcgggaggactcagactccagcacttccagcagcgcctgccctctatggacgacagcccggagctgcccacgggctgcagccagtatgccagggagctgccctcttcttccacaacagctggctctggggttctcaagatttat

SEQ ID NO: 92122 - DNA, 1072 bp, Homo sapiens
ccgtcccccaccttgtccagccttctcttgcagctcctctccccaacacattaataataatccagctgtgggataagagcgattaaaaaaaagaactacaactcccacggggctctggggcaggtaggcagcagaggggtaggctggtagcactggggcctgctgggagttgtagttccatctacagtggcttaagatgggtttgatcggctgggcgcggtggctcacgcttgaaatcccagcactttaggaggccgaggtgggtggattacctgtggtcaggagttcaagaccagcctggccaacttggtgaaacccgtctctgctaaacttggaaactattccaagattcttctaggacccagaattctggatctgagcccagtcctccctcagacccaggagtctaggtccctagcccctcctcccctgggatctgggagtccagaccacagcccactcagcagataccagccctgggatccagtctctatttctgactccttgtcctcctactccgaccccacccccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaaggtaaggggcttggagggaggagctattgaacccactggggatgggcatgaatagaggctggggaatggggtgctgaggtaggagagcagccttgggggaggaggggacacccagtgggtggagaggaggctgcttacactgtaaaatggatcacccattcttcccatcccaagcatggtcccctagtctccccatctctgcagaagcaatgaaaagcagaacatttcctgtgccaggcagatttaaaaccttgataagcctctcatctcataaccaccccacaaaatgggtacaattattattattgttattattattattattattttgagatggagttttgctcttgttgcccaggctggagtgcaatgatgtgatctcagctcactgcaacct

SEQ ID NO: 92123 - DNA, 1074 bp, Homo sapiens
agcgccacggccagcaggatcccctggcagaactaccacctgaacgactggatggaggaggagtaccgccacatcccggggcgctgtgtccgcctcacgggctacccctgctcctggaccttctaccaccacctccgccaggagatcctccaggagttcaccctgcacgaccacgtgcgcgaggaggcccagaagttcctgcggggcctgcaggccaagtgggcagggcaggcgaccttcgtgggggtccacgtgcgccggggggactatgtccgtgtcatgccgcgcgtatggaagggggtgctggccgaccggctacctgcagcgggccctggactggttccgggcctgctgccgcctcccggtctttgtggtcaccagcgatgacatggcctggtgccgggagagcatcaacagctcccttggggacgtggtgttcgctggcaatggcctccagggctcacctgccaaggacttcgcactgctcacacagtgcaaccacaccatcatcaccgtgggcaccttcggggtctgggccgcgtacctcgcgggcggggacactgtctacctggccaacttcaccctgcccaactcccctttcaacgtggtctttaggccgtaagcggccttcctgccagagtgggtgggccttgcggctgaccttggacaggctggacagaacggcctctagccagccctgcatgtgcctggtcctcatcctgtgacccgaggggcagtgagtggggcgtgcggggcatggactcacggtccctcatgcagtttggatccaggcttatctacttcatagctgagtgagtttggacaactgactcaacctctgtgccttagtatgtcaaccacaaaatgcacaaaccacagaactaaacaccagtagcagctggtgggagctgagcaaattcgcttagagccagtgccttgtgaccgtgtgggaggtgtcggctgctcacatgtatgcagcacgtcaggaacactggcattgctttccaatggaaacgcagttttgccctctccttcctggcagcactggtagcacagagcccagatattttgcac

SEQ ID NO: 92124 - DNA, 1794 bp, Homo sapiens
tgggtctgtctctcccgttgggcctctgtctttctcactatcctcagggagggagaggtggaggtctgcagcagggcaaccctctggggacacgtgtctctgccaactgccctgcagggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacagggtgaggcggggctgccattgtgggtgggagggaaggaggggaggggcttggtcctcaccgcaccttctgtcccagaacctccacattcccaccatggaaaatgggcctgagctgatcctccgcttccagaaggagctgaaggagatccaggtgagctgcagggagctggggaatgggctgggagcttgttccctggagaagttggtgtcccatgagcccctggactaacagccagcctccttcagtagtaccaggaacagataatggcctttcttattgaggccctggagagtgggctttctgtgctgctctgtggcctggaaaaccccttggggctaaatcaccctttcctgggagctcccggagccctggatatgtcttcagctttggaaaccccttcctgtgatcctctgcggctcctgggtgccctggtaggagaaaccccctctccgtgggcctctgaggcccctgggtgccctggtgggagaaactccctccctgtgatcctctgctgccccgggtgccctggtgggagaaaggccctttccatgaatcactgagaccttagccagccctctggccatctcagaggttggcctcccaagattccctggagccctgggctatccctttggccggagaaagcttcctcccatgagcctctggaccttggcccctctctggcaccagactgtttaatcccataaatctctgggggtattcccatcttctgggccaagatctctttcccaagaatctctgggctcctttcccagacctagagctacatttctgtaaacttttgtgcatcaggacctagaactacacatcctctgactatctgggctttctgagctgaaagtgactttttccaagagccttagaggcctggccataattcctgtcttcagaactacatctcccggaagcctctgcgccgccttagccttgattccccgttcccatcattgttggggccctctgggaagtggactacatttcccgtgagccgctggggcacagctccgtaggcactcggcctggaacaccccagggcctactgggagttgtagtgcagcttccacctcacgcactgcctccgttgttccgcagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacacacattgtcgggcttcttcagtga

SEQ ID NO: 92125 - DNA, 1913 bp, Homo sapiens
cgtgtcctttgctttctagagtctccgtgtgtctctacctgtttgtctccctgtctatatctgtctctctttttctccatctctctgacccagctgctaaatctccccggtgctctcctcttggcctccatctttcagttgtctgtgtctttgtgtatctgtctctgtctgtcttggtgtctctcatgactgtctggagaagtctctgagcctccccacccgcgtgtccccgcagctgtttgagggcatgaaggcgttcaaaggcaaagaccagcaggtgcgcctcttccgcccctggctcaacatggaccggatgctgcgctcagccatgcgcctgtgcctgccggtgaggggtcccggtccaccggggtggggaggagggctggggccggggcagcaagggccccttgactcattcagaatcccacccagagtttcgacaagctggagttgctggagtgcatccgccggctcatcgaagtggacaaggactgggtccccgatgccgccggcaccagcctctatgtgcggcctgtgctcattgggaacgaggtgggcccaactccagggctgggaagctgggctgcgggggttggattctgcagggcaggggtggggtcctggaggcctgggcctggggacgggaagggactgggggcctggactcctgacgctgtccctttgcccgtcgcagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggtaagtagcacccccatccccagaacgactggcgcactgggcgttggagacacagggaccagcgtgcgtgctttcggccatgcctctggatgtcacatgaaggtgacatcatcagcaccgtgcagggctcagtgctaagtgacctccctggtccctgaaaacaaaccatggaaggaaggaggaggggattatttttcagatggacaaaaaggctcacagatgggaaggcattgggtggaggtcagtggggaaaccaggactggtccctggaagcctccaggagtgaagcttacactcagctcattggcttctcgccccagaagcctcccctgatcccccaggctgggctgcgctccccatacccagctcccacagtcgtttgagcctccaaagcccctcacccccgtgtggactttctgtgtaaatctgtctcccagtggcctcagctcagcagggcaggaaggagacagctgggtctcctgggcaaccaaggcagagggtgggcactggcgtgttgggacaggaatgtggccccagctgggggtgcattcaggtcctttcagccacatcctgtgaggtctcctgagggccaggccctgtgctggcagaagctggggacacagatgagtcagccccgagccctgctctcctgggtctcccaggctggtgggagccccagtattcggagctgcatgttctctggtgaggtgacccagggcattgtgaaagccttcacagaggccagaggcggtggctcacgcctgtaatcccagcactttgggaggctgaggcgggcagatcacgaggtcaggagatcgagaccatcctgattaacacagtgaaaccccatctctactaaaaatacaaaaaaaaaaaaaaaaaattagccgggcttggtggcgggcgcctgtagtcgcagctactcaggaggctgaggcaggacaatggcgagaacccaggagacagagcttgcagtgagccgagatcgcgccactgcactccagcctgggcgacagagcgaaactccatctcaaaaaaaaaaaagaaaggtttcg

SEQ ID NO: 92126 - DNA, 1616 bp, Homo sapiens
ggccgggtgcaggtgaaggcagagttggacctcaagtctcagctctgggaattggactcaaggtcctattttcttggaatgaaagttgaaaaaaataagagatggggattgctgtgcttcccaaactcctatctgaagctttgcacctggattggaaatcgaggcagcgtctcatggtcaaagtgacagatgctgcaggctggctgagacgatcccttctgactgtgcgatgtcaaacagcagcagcgtttcccagagtctatgatttcagagaacaaggtttctcagtgaggaaggaaacagccaaagaaaggggtcattacaagccttcacagctgcggtgtaaccttgggagaactgtctgttaactttacacctgactttatttgagtctcttatcctagctgatgaatgtcagggcagaatttcacttttttcggctcttagtgactgatagggatagtcctgggatacctggggtatgtgggcaatctgggctttagtggtgacactcctggactgtggtggggcagtactgggctttgacaggtccacttgggactgatgtggaccgtctcatcatggcacagttctggtgtcatagaatggccctgaactcatgatgggacattcctaggctctgatgaagatagagatatcctgtaatggagataattgggctgagtcctcagctgtgatggggacagtcccggggtgtggagaggacagtgctggaccatggtagggacagtctggaaggtactggcctagacagcaacatagggatagtcctggggattgaaaaagacaacaatgggattttttttttttttttaatttcagacctggtgaataggaaataagccctgatatttggcagagacaatgctggttataatggggaaaagtgctgggctttggataggggacattcctgagctgtttgggacagtacttggctctgctggggaccagttctgataagttacaggcacaatctggacttgtgatgtggagcatcttgggccatcatagaacagccctggtctgtgatgggggagagtcctgggctataaagggggcagttctagacgtgatggggtcatgtgtgggctgtgacaagggcagactgcggtatgatggggtctctccggggccgtgatatggggacagtcctggagtatggagggcactgctgggctttgacagtgacactcctggtctttgatggtgatactcctgggctgtatgggacataatggaggttctatcacattatagagacctgccctgtgaacccccaaacgtactttatttctttgtctcgtcttttctttttgaccgagtcttgctctgttgctcaggctggagtgccgtggcacgatctcggctcactgtaacctccgcctcatgggttcaagtgactgtggtgcctcagcctcccgagtagatgggctcaagcgatccacctgcctcagattacaggcatgagccaccatgctggtcttttttttttttttttttttttttttttttgagagacactctatcactcatgctggagtgtagcagtgtgatcgtagctcaccacagccttgaccagtaggtcaaggtga

SEQ ID NO: 92127 - DNA, 1005 bp, Homo sapiens
ggaagtcaccaagaacgcaccggaggtccttgcccgccctggaaaacgccctctgcggtgaaggagaggtgagaggccagggttcccatactcttgggtcctagggaggatgggggccagagggctggaaaactgggtcccggaggaggatgcactgggtgccagtactttaggtcctgggaaaagaggaggctgggaccctggactcttgggtctgggggaggaggcggccgagatcccggattcctgagtgtgagagaggagcgtgttgggagccaggacccctgggtctgagggcccagactcctgtgtcggaggaagggaaggccggaggcctggaatcctggggcctgggtaacaaaatgcttgtgtcttgattcttggaagtgggggcggcgctgggggcccgaactcctggttccaggggaggaagaggcttgggacagacattatgcattatccagccctccatcccccacagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgtgagtggccctgccctgctatccagccaggtgtttgcagtggtactacagctcctgcagaccccggtgcccgtagggcggatgctccagtgacttcctggccctacagttgtagcttgttttttgcccaccattcctcccagcagcaggggtttgacttggtgaaaaactggaggtccctgactctgaggtgtggaaaatctgcatcacgccccaactaaacgtctgtttttttaagattctctccacccaagaaggaatttgaaaacaaacaaacaaaactacatttcccagtagcaccatgttgctagttcccagtagcagttgatgttggctagctggggtattctgacttcatggtgctcttgggagttgtag

SEQ ID NO: 92128 - DNA, 1247 bp, Homo sapiens
ctaggcagtggccctagcaacgggtctagtggggtactaaagcctgggggccaccgttccaccgcgggagacccgtagttacctgtcctctgataacagaccccacatcagcccaaaatttcttcaccagggaccttacacatcccgtcctcggtcccctgagataccttgctatcctcttcccttcagatatcaacagtgatggtgtcctggatgagcaggagctggaggcactcttcaccaaggaggtgagcatcttggaagcctcgggcacctggagggacgcccaaatcagccacttgtttcctcctgcagtccccttaaatccccctggatgggagctcagtgaaaactacaactcccatcagcccctggggcaaaaacggctcccaggagtggtagcgtgcccaaaggactgctgggagttgaagttgtcgggaatgagctcgctggggacctctcaatgctgtctgcctctcgcttgctcctgcagctggagaaagtgtacgacccaaagaatgaggaggacgacatgcgggagatggaggaggagcgactgcgcatgcgggagcatgtgatgaagaatgtgaggtgggggccaggcgggggagaggacgggcccccagctctgtcactcacccttatctggctccccaggtggacaccaaccaggaccgcctcgtgaccctggaggagttcctcgcatccactcagaggaaggagtttggggacaccggggagggctgggaggtgagaacatgggggatactcggggtcctgaacctctctctcttctagccatgacctttctttcagaatcttaggccccttctctttctctctgggtccccgtccattctcctgggtcactgcatctctatctctgggtctctgttttcccctgtctctaggactcttatttatttatttatttatttatttatttatttatttattctgagacggagtctcactccatcgcccaggctgcagtgcagtggcacgatctcggctcactgcagcctccacctcccaggttcaagcaattctcctggctcatcctcttgagtagctgggattataggtgcgtgccaccacacccagctgatttttgtatttttagtagaggcaggatttcaccatgttggccaggctggtctcaaactcctgacctcaggttatccacccaccttggcctcccaaagtgctgggattagaggtgtgatttttttttttttttttttttt

SEQ ID NO: 92129 - DNA, 2048 bp, Homo sapiens
ctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcatatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacagtctcctgatcccctagaacccaagagtccaggtacctcttcccttcctttctcctctagggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggtgtgggcccctgaggacccagaagtccagccactgggctccttcaggacacaggactctcagccccgcattctcctcctcccctaagaactaggagtctgggccccacaactcagcgcaaacattccggactcccagccctcctctctgccaggatcttaaaaccctccttcagggagtcatttttcccaccttcctaaatgtctgtcttgtccccttcccttgtcccccgttggcctgttgcttttcatttcagcctggcttggggctcagtctccttatctttagtgtgcggtggatgcgggaattttccaccatcagcctgatgcctgctccccggcactggttctcctctctcctgcaggatgattgccgccgtggacacagactccccccgagaggtctttttccgagtggcagctgacatgttttctgacggcaacttcaactggggccgggttgtcgcccttttctactttgccagcaaactggtgctcaaggtgggcagctgcagggcagtgagcccagggatgctccccctcagatctgtgaggacctggggatcgtggtatcaaccccctgcagtggcccagtgaccacagagggcatggagagagatggctgtgcactgggtgtctgctccttcttttattcattcaacaagcatttactggacctgctatgtgccaggcctatacctggcacctgggacacagcactgtacaaagcaggctacatccctgctctcagggagttcacgtgcaggggtgaagtaaagtgggcagtgtgatttagcagagtggtcaggaaagatttctattttttttttttttttttttgagatggagttttgctcttgttgcccaggcttgagtgcaatggcatgatcttggttcactgcaacctctgcctcccaggttcaagcgattctcctgcctcagcttcctgagtagctgggattatgggtgtgcaccattatccctggctttttttttttttttttttttttttgtatttttagtagagacgggtttcaccatgttggtcaggctggtcttgaactcctgacctcaagtgatccacctgccttggcctcccaaagtgctgggattacaggcatgagccaccgcaacaagccaggaaagacttctaagggcaggtgacatcaaagagcaggtgacattaaagccaaagctagaatgataagaagcatgcagtgatctatagtgatcggggggaagaggcatctggtagag

SEQ ID NO: 92130 - DNA, 1860 bp, Homo sapiens
aggagctgggattacaggtgcctgccaccacacccagctaatttttgtatttatttattttgagatggagttttgctcttgttgcccaggctggagtgcaatggcgcaacctcggctcactgcaacctccgcctcccgggttcaagcaattctcctgcctcagactcccaagtagctgggattacaggcatgtgccaccacgcccggctaattttgtatttttagtagagatggcattactccgtattggtcaggctggtcttgaactcccgacctcaagtgatccgcctgccttggcctcccaaagtgctgggattacaggcatgagccgccgcacctggccatgtttacaatttttgaagccgacttcaattgtgggtggcagaaatctttgaggggaggcaaagaattgacaaaggaggtttggggccactatctccaggcagtggggacaaggttcagtccctaacgcccactccactccccacaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacacacttcggcatctgagtcactgggcctctgccccgctccccggcacgtcaggagagcaggccctgtccgctgccccacgccgggcccgccgtctgctggcctagagatacctgcttgggccactcagggacgtggggctctctgcactcacttgacatctttttctggggtgccctgtggggtctgtgggttagggatgagttggtcctgggcctgacctgcaggagctcacgggaaaggaaaagaagggagctcacgggaaaggaaaagggagctcacgggaaacgagggtgataggtggtacatctgtcgcagcccaggatgatctgtgcgggacagaggcagcggcctgtgaggcccaagcaggcgtgtgggtaagggaa

SEQ ID NO: 92131 - DNA, 1123 bp, Homo sapiens
tccccttctctctgagtccctgtcccccctctctctgggtctctgtacccccttctctggatctctgtccccacctctctctggatctctgtcccccactctggatttctgtcccctcccgccgggtccctctgggtctctatcccccccacccctgggtctctgtacctccctgcctctgtccccccccacctctgtccccccctctctctgggtctcttttcccctccctctgggtctctgccctcctctctctaggtctgtccccctcccctctctctcagggtctctgtacccctctgtctccgggtctgttttcccctctctctgggtctctgtccccctctctctcagggtctctgtctgagtctctttttctctgggcctctgtctccccaccccacgttctctatggtcttcagatcctgtctctctcagcccctcctctccctccacctatgggccccaaggcccctctcggccgactaaaggtctctgggctgaggtatgacatttggtaaatgagtaactcgggccccacagtcaacggggtgctttggacggctgcccctcctccatggactcttcccagagaccccaagtcaggggagagagaggggcagaggatcaatgagtgtacactgagccaccacccagagtgaggggacaatatggccacaggcaggatcccagaaaaaaaaaaattatgggaaccaaaaagacacggagacaaagcacacagccggcttccaacaaggggggaccttggggtagggggcccgatttgggtctgagccaggtctagttctgagggtcccaccaaaaaagtcggggagtgccaaggggatgaggtcagcgagtggccccacccccatccgtccccgcgggggccccttcccgcgctgagctcagcatgactcagcagtcgctgcctgcaacaaggaccccagataccggcctggcggggcatctgcagatcccctcggtcaggggctgccccgcctgggctgttcggagcagctcctctgtagggcagggcctgacctcaccccacaccccagtggcttcagctccctgcccagcgcacgggctgcctccatcagggcacttaagtagagtcaag

SEQ ID NO: 92132 - DNA, 2177 bp, Homo sapiens
ctcggaaaccccagaatcttactttcccgaggcaccccaggaccccagggtcatcagttcacagggctgttagtgctcccataaaactctagcctcccagagggaccccagcccccaccctcccgcccacgaacccctgcatttccagaatcagccccagggccccaacccccccaagcccccatttcacaacacgctggcgctacaggcgcgtgacttccccttgctttggggcggggggctgagactcctatgtgctccggattggtcaggcacggccttcggccccgcctcctgccaccgcagattggccgctagccctccccgagcgccctgcctccgagggccggcgcaccataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttctatgtgccgagtgtgtgtattctgagccatttctcccttctatatagaagccagctgaagatgagtggggtaaaaccccagacgccatgaaagctgccatggccctggagaaaaagctgaaccaggcccttttggatcttcatgccctgggttctgcccgcacggacccccatgtacgtacccgctgcatccatggctacccaaccatacccctcaagcctctgctccctttgggcaaatttccttcagagcctcatttcacacctgtcacattttaatctgcaactggctgctctctccccctcttttccagggattgggtttctaatttctccctcttctctctcagctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcagctggtggttttgtgtgtggtgtggaagatgaggtgggatctgttctcataaagcttctggctgggttgggatgccagtgaaagaggagttggccccatctcccattttcttaactgtcctaagacaagaggctatctgggtagtgttgaacctgagggttctctgcttgcctggctgttaactgtccctcccagatggtagagatagactccagggag

SEQ ID NO: 92133 - DNA, 1038 bp, Homo sapiens
cctaacagcatggtctaggggataaaactccagatttgagagagagctgactgggagataggaggcctgagcggcggtgggaggacctgaggatctggctgcttaagaataaagatgggacgggctggagactgtaatgaatgcctgggctttgaaggagctgagggcctgagctattagttcctaggagtagaggagcccatggcctgggacacatgcgtactggaataggggaaggctgggaagtcctaagttagtcagaggctgggccctaggatgggaggggctaggagcctgcatttctgtgtcttgggcttcagaaagctgaggttctggccttggagaaggctggggctgaaatccccaggaacaagccaatctcacacctcaaagagcagggtctggggggttgctttgctgggtcttggaggagaaagggactgtgtctcccaggaggagagggggcccgtgaacacccagccgggtatcgccagggcctgggctccaggatgggaggaggctgggggctggggctcctgggtctgggatagggtcatgggagaggcagagccctgcatgctggtgtccctagtcagggagaggaaattgggaggcaggtcagcaaggtccctgggggcagggaatgaccatgcaggcttctcttgggcaatggtgagaagctggattggccatgagggggtctccctcactgggttttggagcctggctgcgatttaaacccagctcctgtgagctgggaactcgggaacctgagtccgggtagtcagtcctcagctctgccatccttagagccccagtgcctaattccttcagaccaaggggtcccggcacccagccccttctctctcagacccagaagtctagcctgagccccctcctccttcagggtcctgaccccagcccccttctcccttagacccaggaggactgccctccagccctcgtgttcccctcatccaagcttccaacccctactccaaactatgggctcccagtcccctcttccccctgagctag

SEQ ID NO: 92134 - DNA, 1038 bp, Homo sapiens
atgggagccgaggcagtctgccttcatcacttgtagctatcgtgtgggctccttggccttcgtccctggtccccttcgtccagctctgaggctaaacagctcgtagaggctgggagactgaggtgtggcgaggttctagggtgtaccctctgggcaatgtgggattctaagccaggcctgccggagcaacctgccctgcctggcttctcactcactgtctgcctcatggctgaaccccgctctccagttccccctccccagcgctctgctcagctcggagccaagtccttacatgtaggatggcactgaaccctctttcctggggtgggagaaaagctagtttgccacagagcaggtgtcggggacctggtgccagagcggcttcacctacacagactgcctccttcccaggcatggcgcaggccctgggccctgacacgccattcacagccatcgccggcagtgaaatcttctccctggagatgagcaagaccgaggcgctgacgcaggccttccggcggtccatcggcgttcgcatcaagtaagcgggggacccgaggcgggtgccagaccccagagcctgggagcaaccccgcaccccgggcggctcgtcctttgtcccagagctcatggaaggttgtgattcccgagggtccaggtgtcaggctgtctcctcagatctgctctctggctagggaggagacggagatcatcgaaggggaggtggtggagatccagattgatcgaccagcaacagggacggtgagtctgtgtgagtctgtaccctgctgaggccacctccagcgccagggttggagagagtagatatcaggtctgcactgaggtcagaatcccatggaatgttctagctgcagactagagccatgtacatgcctacagtaggaggtcagttaacttgacaatggcttatccccttatgaaggacattatgggcaatagaaactgaggcggtaaaataatgagagagatctgttagtgagttcccaacagacctcaaaacccaacagacttcaaaac

SEQ ID NO: 92135 - DNA, 1043 bp, Homo sapiens
ccctgcacgagatcgacgtcatcaactctcgcacccagggcttcctggcgctcttctcaggtgaggcccctcctgccctgccctgccctgccctgccccaggcctagcagcctccctcgggctccctctgttcctgagctccgagtgtggcccacctgctccacgctgtttcctgtaactccggcccgtggctgcctctgttctccacctgcaagtccgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtggcgcgaggagggcaaggcggagatcatccctggagtgaggacccaggacatggccggggcgggtggtggggtggaggtgggccggggaagtggggacgcgggtggtgactctcacacacaccccaatccaaggtgctgttcatcgacgaggtccacatgctggacatcgagagcttctccttcctcaaccgggccctggagagtgacatggcgcctgtcctgatcatggccaccaaccgtggcatcacgcggtgagccggctacaggggcctctggggaaaacaggatgctctgggcagtgggtgtggtcagagggtcaatgggagcctgtgttgacaccgggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagtcttcaaactgcgtgccgaggcaccccagggtgctgcaggaaactcacag

SEQ ID NO: 92136 - DNA, 1058 bp, Homo sapiens
gaagcagcagcgaatggcaatgggttgtgttgtgttaatgaagactcaattggttcatattactctgagttgtgcaaagctcatggagccttttggggtagtgttgagataggtttggtcgtatcattttgtgagtttcctaggtcagtgttgggtttggttgggttgtgagtctgggatagtgtggtccagctgcattgtgtaggattctgtggtttggtgggtcccctagggccatgttgggtcaagttagatggtcccccatggcattgttgagatcgaatgtgtgtggtgttaagtttcgttgagacatggtggaaattgtgtagctctgtgattcttccaggggcatgttattttaggttctgtgaacttgcgagtcatgtagaaatgtgaagagtccagtggtagaatttgagctttctaggtcacattgggttaagtttgtatgaccaaatgaatcttgtagggttctgttgggcttaactgtgtagaggtgtgtggctggacatttttcgtggccacagcgagttgagttgtgttgaattgtacaaccatatgagccttgtaaggccagttcagttgggtcatgccactgtttgagtctcatagggccatgctgaattgagttccattgagttgtgtcactatgtgagtcctacaggaagttgggttgagttggactgtgcgaacgagttccatagggccacatcgggctgttttgcatttagtggtagcaccaggacccaaaggaaatagcagtggggaagcatcatgtatctgggagcatgcagtggcgagggctctgggaggtgtgccgagctggctccccagctcgctgtagggggcgggactggattctgtatccatgggattgggtgttcatccagaggcgactgggtaaattaggaagaggtggatgctcctcctgtttaccccacatccacttcattgtgctgttcactcccattctcccctacagttttatgctcagacatggaggtcagagccacaagggaaaggggagagggggagaaaactgtactctgtccagacat

SEQ ID NO: 92137 - DNA, 1521 bp, Homo sapiens
cctagcagcagaagactttgctttaatcacgtgctgtacccccaaagcccagacagtgcctagcacacacgagatgctcgatgaatagttattgattgaatagattagacatcaacgcaatcaggctgttcacctagggactctttgctaggcggcggagaggtacgttacagttctctacgcaaaacgcatgcgcgaaagatccgggaagtgtgatcggaaaggggcggagcatcagggagagtctcgcggacataggcggttcggcgcggaaagcgggaggtggaggggcggcttggggcaagcgcgcgcgcgcagtgcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcggtgagtgagtgtgactgagtggcccgacggggtgcggggccgctacccagaagccccagcggtgggcccggtcctcttccccgcggccaggcccctttcccgcgtccccgccacaggtcccttctgcatccctttcccggaccccgaaatctctgggcacccacgcccgcttcccacagcgccctcgtggttccctacccacaggcccttgcggtgtgtggccttttttctttttcgtttgtctatgttgtcctggacccttacccataattcctttcgctttttgcggggtccaggtctgttacccacaagcacttggttttggggcttcgctccttatgtttctctttctttgcttggaaacttccgatccccaggaccctgcaaactgcatctcgtaatttgccctccacggcacgggacgagcagccacagctgctctgggcctccctcctcgggtccttgatttccccagaaattcccagggaacctctccgccccacagctcgtgtcagaggactctgagacttcactcttcaggaacccttttccagccgttatttttgttttctttaccggcctttcacctccacccccaccaagacgtacccttttctccgcaacacaggactgttctctgcccttacagagcctgttttaattccgagacttttctcctgtctttcttattttgagagtcaaggagtaacaggggctttctctgtgcagacccgatctaacctaaggctgtcctgcttctgctctcagacttggcaagatgacccagttcctgccgcccaaccttctggccctctttgccccccgtgaccctat

SEQ ID NO: 92138 - DNA, 1047 bp, Homo sapiens
agaacaagactgtctcaaaaaaaaaaaaaaaaaaaaagtggggttgatagtacaccttttgtagaatttttgtgaaaattcagtgagtagtggttgaggattcatgcctaacccacaccatttatcagctctgactttgggcaaatgttgtatcctcttaatgcattggtttctttatctttagcaaggggatagtggtagcacccttataatgttggtggagaattaaatggcaaactgtatgtcagggggcttggcaccaagcagtcagcacatgtcagcctttgttactctgtttactacttttattgttaataagatgatgttcataaaggcttagcacccagtattgagtattggagggcttaaaactgcagatggggatcttagctctgcacctttgggataaataggaatgaatgacttaggctcctggacctctgtgtttttatttgtgaaatgggatgacaagggtcatctcttaggtgcatcagagcacacctgagaaaagctggcacacagtcggaagttacaagaagaacgttctagcattgggtaggtaagggcagctggaggcgagggagttgcagagcagaatttcgtagataacagaaaggtatgtcttcagtgggatttgccacccttggtgaacccgcacttgagagatattactggccaattaacttaatgggcacaggcgggtggtaggtgccctttgatgatgcaggtcatgtgccagttaccatttatttatttatgagacagttttgctctgttgcccaggctggagtgcagtggcgtgattttagccaactgcagcctccggttcaagcagttctcctgcctcagcctctcaagtagctgggattacaggcatgcaccaccacgcctggctaattttgtatttttagtagagatggggtttcaccatgtaggccaggctggtttcgaacccctaacctcaggtgatccaccccccttggcctcccagagtgctgggattacaggtgtgagccaccatgcctgggagccaggtacttttttttt

SEQ ID NO: 92139 - DNA, 1023 bp, Homo sapiens
tttttttttttgagatggagtatcgctctgttgcccaggctggagtgcagtggcgtgatctaggctcactgcaacttccacctcccgggttcaaaggattctcctgcctcagcctcctgagtagctgggattacaggcacgcgctaccatgcctggctaatttttgtattttttgtaaagacggggtttcaccatgttggtcaggatggtctcaaactcctgaccttgtgatctgtctgccttggcctcccaaagtgctgggattacaggcatgagccactgcaccctaccagccagttcctatttaatgtgtggttgatgagacctttaagagctgccttggccctcagagggtgtgcagttgtgggctttggagccctgttctgtcagcttatgttgctttaggcctggtcatcctcactggcactcataagcagggccctgccatcactccactcccatcacatcctctggcactttgttcaatgtgagtgatacttggagctgtgagaagcaatgtctttcctaaatatggaagacagggtgtttcctaaatactataaagctagatgtcacctgtaccagtgcttttcaaactgtctttggtgaaggacagatactgtttccaatctgtttgcttttgataaatatgatagaattactttttaaagaaagatctacagtcaggagttcaagaccagccaggccaacatggtgaaaccctgtctctactaaaaatgcaaaaactagccaacatgctgtcgtgtgcctgtaatcccaggtactcactcaggaggcttaggcaggagaaccgcttgaacgattctagtcagttgctgggttccttttagagagacgggcacaggggggaaagcagggcttagaatcgcttgaacctgggaagcggaggttgcagtgagcccagatcgcgccattgcacaccagcctgggcaacagaccacaacttcgtctcagaaaaaaaaaagacctacagaataaaagaccaaatttgtattaagagtc

SEQ ID NO: 92140 - DNA, 1028 bp, Homo sapiens
gagcgcatggagaggaaagtatgtcatttttgcttcctgaccccctgttttaccactgtctccagatgatccttgacactagggcacttctatctgcattcacttctccacctcccctttctcctgacagagacgggaaaagattgagcggcgacagcaagaagtggagacagagcttaaaatgtgtaagtctctcatccaccatttggctctctcctctcccaaaccctctgtattcttcccaggtcatacccaggaccctgctgtctccctaaggcctgtgttgtggggaacagggttgttagttcatttgtttagcccctgccacttcacaagcactgtttttggtttaggcttttcagcagcagaacatagggtaaaagttggcaggaagggagacccctggtaccttgggctcctcctgcatgggaggacagttaaggggctcccacaacccagctgggtgtcacaggctgaagtggtgggttgtgggatagtggtctgtcctggctctaaccttaggtccccaacccttgggctgaggatgttccatcccctccacatagaggaggaattggagtacaagacaggtgtgttgttgccattaaccaaactcataagagggtcagatgtcaacctccagtggctctttattctgaaagtgaaaactgtacagtcacaggcagcatagcagtgtttcactcagcaggggaccgtggatgtgatggtgatcctataagattatatcatattttgccaggcactgtggctcacgctgtaatcccagtactttgggaggccgaggcaggcggatcatgaggtcaggagttcgagaccagcctggccagcgtggtgaaatcctgtctctactaaaagtacaaaaattagctgggcgtggtggcgagcgtctgtaatcccagctactcgggagactgaggcaggagaatctcctgaacccagaaggcggaggttgcagtgagccgggatcgcgtcggctcactgcaacccagcctgggcaacaagcaaaa

SEQ ID NO: 92141 - DNA, 1620 bp, Homo sapiens
tgcagtgagccgagatcacgccattgcactccagcctgggtgacagaacaagattccatctcaaaaaaaaaaaaaacaaaaaaaaaaacagttccaggccaggcacggaggctcatgcctgttgtccagcactttgggaggctgaggcaggcagatcacatgaggtcaggagttcaagaccagcctggccaacatggtgaaaccccatctctactaaaaataccaaaacaaaaacaaaaacaaaaacaaaacaaaacctagccaggcattgtagtgggctcctgtaatcccagctactcgggaggctgaggctggagaattgcttgaacccgggaggcggagtttgcagtgagcagagatagcgccattacactccagcccgggcaataagagcaagactccttctcaaaaaacaaacaagtaagttccaattgggcgaacaaaaaagttccaattgaggaatttgaacactggatcatagatgaggttaaggaattagtaaatgttaactctaagatgtaatagtggcactgtggttatgatgtttaaaagcctttgttagagaccaaaatggtgtgctatctggaatttcatttaaaataatccagccggtcgtggtggttcacgcctgtaatcccagcactctgggaggctgaggtgggaggattacttgagtgatccaggttcgagtggtgaatatggtgaaaccctgtctcaactgaaaatataaaaattatctgggtgtggtagcaggggcctctaattgcaactacttgggaggctgaggcaggagaatcacttgaactcaggaggcagaggttggggtgagctgaggtcatgccactgcactccagccggggtgacagagcaagactccgtctcaaaaaaatgcagtgggctgtgggaggatagggatgaaacaagtccgtccacgtgttgataatggaagcgggctcatgggagttcgttatactgctctgcctccattaaatgcttgaacttctccataatagaaaagaaataaaagaatggatcaagttcagtagggtttctgtgcccttgagagcctccactcatagctatagaagcttgctgtgccttgtcacaatgaacagctcccgtcaaggggacggtgcctccttgctgagcgcttgtacttggtgttactgactttctcacagcttccaagtgcagcaggggttgctactcccatttttaagataaagaaatggaggcttgttgaggcaagcacgcttccaaagagtgagagttccaagatgggacctcgagtacctcaaagcctaattcccaactccacgacccacttccgttgagtctctgctctgggctgctacttagatgagccctcaaccagtgatgtcctgagggagagctgccgtcagggcgctgcacgcatacgctggctgtggggcgctgcccggcattgggtctgtgctaccttctttgagcttttgttctctatcttcaggacttgggggtaccattgctttgctgcatttgctttttacctttagtcacatttgtggcccccccaccccgggtaagcaagtgctccagggaactcacacagtgtgctggggtggtttccctctggctgcc

SEQ ID NO: 92142 - DNA, 1432 bp, Homo sapiens
atgaaattggtttcttaggagattcctggctcttttctttggagattgttattccttagtagccaggtagaacagtttgcctcacagtagtgaggctggagtgagaatctgatctgacgctagtcagttcctgggttcctttttagagacacagggcacagacaggaaagcagagcttacttagtgtttgctttcctggctctcattcttagccttggggcagcttggtctcaggttttcctgtgggctgtagttgcagtctgtgtccagtaggtggcagtgtggccctgcctacaggagggagctcagaacctgggggcatcagctgcatctccagggaggcccagttgggctattactgtttggatcaccttgcatctgggagcgatagggcccttagggtttatgtaggtctgaaatggcagttgggcctgcccacatcctgtcagcttgaagtcagccttacctcctctcctcagcagcctggattatctctcagccactctgataaagcccactgtgcctcagagaaacaggttcagagaggggcgtccctgaggttgccaggtcaccacccatgttcctccagttaggggcctctcccaatgccaccgttttcttcttggcctctgcccatcgtatttgttttgctacctgagaccatggacaccttcaacttataaaattcctttcttcctgcacaggggaccctcacaatgatcccaatgctcagggggatgccttcaagactctcttcgtggcgagagtggtaagtccccagctcctagctcctggaaccccacgctgctgagagcctgggtctggcacaaaggtcaaataggctaggtacaggggaatgttccaggggctgtgggacagctctgttctcccatttaacgtcatatccatctccttgtagaattatgacacaacagaatccaagctccggagagagtttgaggtgtacggacctatcaaaagagtaagtggagtgggtcagggtgtttgaattgggggtgcatggaggaggggctgtatcctgagagggagggagagaggtcccagccctgagcatggctcacaccatttcagggcctggatttatgcatcctgactgtatctccatgcagcagaccttgggcagcagaagtaaaatgagaagtaatgactgctggtggttggttgagagcaggggttggcaaactacagacttaaagttttcctgctgctcagccaggcaggtctgtttgtttacacattgtctttggctgctactgttgtaaggcagggttggattgttgcaacagtatacggccgtccaagctggaaatatctactctctgggtcttggcagaatacctatgctgagtcccgttttagaggaaggctttgttttaccaatcttcttttaagtcactgaagtgctctgtgt

SEQ ID NO: 92143 - DNA, 4324 bp, Homo sapiens
cggcctggcattggggcgcttgatgaccccgggcctgcccacctttgtggcttcatctcctgggactctctgtcatcagtacatgagccagccctgccgaagcgcatccccagcctcctgccctcctgcccccgggcccttggacctctggagttactgctattccacctgacaggctgacacctcactgtcttccttcatctctcttctttctttaggtcttagcttaagtgtcattttctccaggaagccgcctctgtgtcctctgctcctgccattagaacataagtcactcagggctcttgaaggacagagagggtctgaggcctcatccggcccagggcctggtgtgcaggctgttgtggggttggtggggcggagccgccctgtggcaggactcacccctgtccccatgtgccccacagatacacatggtctacagtaagcggtcaggaaagccccgtggctatgccttcatcgagtacgaacacgagcgagacatgcactgtgagtacctcccgccgagccctgccctctgacctgctctcacttctctgctgccccagcccctcccagtctgtcccctcccccaccctgccacacctgacattagcgatgtctcttctcctcctccctctgtttctgatgtatcttttttttttttatatacgtgttttttaaaaaacaaaaaccaaatcccccacaacgtgtgtgtgtgtgtgaacctggggaggtaagtgtcacacgttgaacctcaggggcaaagagggaactgggtggggggctggggccagctggaggtggggggaggggtcggattttgggggaacctcccccattccccccactgaagttgggggtggccaggttgcaatgaggactggcctttgaacctgccctctcttccccccccagtagaactggggctgggccacccgaccctccgcttccccaaccctggccccccaccctgttcctcagcgggcagtggggtgataggcatgttgagcgcctgcccctacagttccaaagccccctttgaggctgccgcggcgtccacatgggcagggatgggtgggggagggtgggcagggctgcggcgtgtccaggggccgccgtattaattgactgttcttattgtcactgcagccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctcccaccccagtcgcccccgtagcctccccgcacccatggccctttccttgtttgggtgccctttgtccctcctgccccgatccgtatgctctctgagaatcttgctgatcccaggaggggaaggatgaacctggtgggaaaggcggcggcctctccgcttgggttccacccagcctctgatgacccggcttcgtgatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggtgagcacatcctgccttcgacgggctctcgggggccctgggcctggtggccttgttctcccttctctgctgctttctgcttctctgtctcctgccggcccacctctcccatcgcgtcctcatctccggcttctctctcttgtggccatcacatttctgacagctgcctgcctcctcgttctgggttactgtgaggagcaggggcaccagcctggagaggcctgagcccacatgctggcgtccgcccttgctagctgggggtccccttttcctgcctcattgtactcctcttagtggaaataaccccgagttcactgagctcagtgtactgggcgcccagcttggcagtgacgcatgctggggttgtaaatgtcactcgctcatctgcttctgctgcttgctgttgctcttgttcactcttttactgattcagcaagtacctattggatcaccagctgtgtgccgggcttctagttgagcaacacagaggcagcctctgccctctgagcctcctgcattcggtctcctcattgtcatttgctgtctcaggcaa

SEQ ID NO: 92144 - DNA, 1855 bp, Homo sapiens
ctgggacacgcagccaagagccgcggctcagacgctagcagggcccgctcttgctgcctctaccaccagttgacgaggagtttggaccttaggctgggggacgccagcaaaggcttctaagcagatcacatttttgggtggaaagatcattggcttcgggtttctgtgagggcgaggatgattggaagggagggttttgaggaggctgtgaagtgcgctatggttaagatgatgcgctttggggccagacatgggttccagtaacggctgttgcctagcgaacgctttgtgtgagttaattagagaagacgtggctgtcttgtgatgggagtgcgcgggatgaactgcacggggggacccggccctgtgaacactaagccaggggctgccttcctgccctttgctcttggagtcggctcatttctgctcctccgggccctgtccctgcccagattcaccctctgtccgtctgccctgccccaggaggaggcctcggtggtaccagaagaggaggggctgatgtgaacatccggcattcaggccgcgatgacacctcccgctacgatgagaggtaagattgggcgaccggtgtcctggggtggggggcggtcacggggggagcccagccacacaggtctgcccacctcatccaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgatagtgggcacctcggtttcttcctcactgctctgttttccccagaaggttgttcctgacttgatagccctgcttggtttggtttccagggtgtacttaaaacttgagcgttaggacatgaggctggctctgcccagtagccagagctgttgaaagtggggtgaggcggcctctcgggctccttgtctcccttgtgtttttcacccttttttctttttcatctctgccacacattcctcagggctgaccatacccctgtcttggtggggggctgggaattaggagggggcttgattactcaggggaagccgcagttttgaatatgcaagggaagctaccatctgcaagggagagcggcacacagggtgaggaaaggcagaatacactgggcac

SEQ ID NO: 92145 - DNA, 1050 bp, Homo sapiens
ttctcctccatctgccactttggcattctaagcttgttctaggctctctcttcttctggagccttcagcctagaaatgtccttatttccagaacagcccccctcctttgccagcctcagtctttattccaggaaatgctcaattctcaacatgcatccttttgatccctccccctccccgccctatagacacttgtaagttccaagcaaactcttagacacatgataaaaccaaggatgtgactcctgctatattcttttttaaaaatgtaattaaatttttaaaaaatctatttatttatttattttgagaccaggttatgagactggttaatttttgtatttttttgtagagacagggtttcaccatgtttcccaggctggtctcaaacccctgggctcgagtgatcctcccaccttggcctcccatagtgctgggattacaggcatgagccaccgcgcctggccccctgctatattctgtgttataccttcatccctagcaggctctgagttctagattttatctgctgactatgtttgttatgtgttgcattaggtatattaatgggtgtcattatgtatgtggggttctggggtgacctggacactaagttattgggttgctcttggctggttctagattataggcttcagaacttagttctagattacttaggcctatgagcggttcttaccccaagccattgaaagcgtggaagcatacgtctattccccaccctgtactgtgtgtagtaaccttctaggttctatgtccagccttgctgtgttttttatttccttctcggtcaatttaaggctctggaacaggctccccaaaacatctgtgttgcatcgtcagagtgggttgctggttttagatatcatgttggggctgggcgcggtggctcatgcctataatctcagcactttgggaggccgaggcgggtggatcacgaggtcaggagattgagctcatcctggctaacatggtgaaacccgtctctactaaacatacaaaaaataattagccgggcgtggcggcacgagc

SEQ ID NO: 92146 - DNA, 1068 bp, Homo sapiens
tgggaggtggaagttgcagtaagccgagatccgtaccactgcactccagccagagtgctggttgctcatgcctgtaatcccagcactttgggagaccaaggcaggcacatcacctgaggtcaggagttcaagactagcctggccaacatcgtgaaacccccgtctctactgaaaatacaaaaattagccaggcatggcagcgggtgcctgtaatcccagctacttgagaggttgaggcaggagaatcgtttgaacccaggaggtggaggttgcagtgagccgagatcgcaccactgcactctagcctgggtgacggagcaagactctctctctcaaaaaaaaaaaaaaaaaaaaaaaaaaaaaagaaagagagagagagaaccttcatctgggattttaagcctggatagccgcaggggctattgggaaatgtagccccaccacgtgggctaccagatgagggtccatctcccataagaagttgaagcacttcttttggggttctaggcctctggtaccctggtagctcttgagaggtgttgccttctaggtagaagggatccttatttcccatgagaccccaggacacttgctgtttgattctaagtctgctctatgccagaaattagtgagaaatccaaggcctgggttttgaggagagggctggagtggagacttcacatcccacaggcctcagatcctctgaacctggaggatctgagcctgcagtgtcctagaagctcatgggaggtgtagcatcaccattttaactcgcaggtaggtggcagggacttaagatgggctagtcctgggagctcttagcgggtgtgacaccaccattctgactcccatgtcagggcactttgtttcccagggaacaagggggttccccgtcctctcccccaggggctcgcagtccacggggccctttgctacctccgcaggcgctggcgcagcgggaagatatggaggagcggattacaacactggagaagcgctacctgagcgcccagcgggaggccacgtctctgcacgacgccaacgacaaactggagaacgagttagcta

SEQ ID NO: 92147 - DNA, 1040 bp, Homo sapiens
agaattcccattgccccaccaggcctttctggcccattgtgctcccagattccctctcccgctgtctgctgcggcccctcacccagtttcccctatttccctcctcaggctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctgtgagtgctctgaagtctccccagcctagtagggggatggggagaggtcagaggcagggctccccagtgtacagcaacaataacccctcacaccagtggttttccaaagcaacctcagctttccctaaaggttcaaactcaaagggcaaaggggaggctgagtcactgggatcttgaaccctaactttcactttagtcagatctggtctacttttatttctcatgcgtcaagtttctgcataggattttaaaaagtttctggctgggtgcggtggctcacgcctgtaatcccagcacttcgggaggccaaggtgggcagatcacttgaggtcaggagttcgagacccacctggccaacatggtgaaacccccacctctactaaaaatacaaaaattagcctggcctggtggcacgtgcctgtaattccagttactcgggaggctgatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctattttactcccttaaattcagctttcctgcttccagaacctgtaactcattagctttctttgaggcctga

SEQ ID NO: 92148 - DNA, 1078 bp, Homo sapiens
tgacagcttctatcctggccccttcacccttacaggcatgaactcctggaggaggcctgccgccagggcctaccttttgctgcctgggacgggcccaccgtggtgtcctggctggaggtactggggcccagaaatgccctgactgttggtccccaacccctctgacagccccactggtaggggctgcctggtcctcctggcgcaccctgcttctagcccagaggtgggggtggccatgggcctggcaggtgaggacccaggagggctcgggcttcctgttcacctaaacagtttctttctccttctccttctgcccctgccactctggccttgcccacctgggtcatggtctcctgtcgttctctctactctctctttctggattctctgtctctatttttcggcaccattcccatctctgaccacgcttttgtcattccccatatttctcctcatgtctccgatcgccctgccgatgtctccctgtctccggcttcctgtctctccccaccctctatttctctctctctatttctttctctctctctctctttctctctccctctccctcttcccccacccgccccccgccccccgtttctctccctatttgtctccctcggactctccctcatctcgtccacgtctcttttccctgtcctgtttcttctccttgcgaactttcccacgtctctgtttcgctccccacccccttgcctttccccacctccctgttcccccatctctccgattttctcctcctctgtccctctgtcccctctgtccctctgtccctccgctgcagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcactgtgagtgtccggcggccaattccagccttcgcttcctcagagccccgcctcttgccctcagtctagccaatc

SEQ ID NO: 92149 - DNA, 1068 bp, Homo sapiens
ctgtccccctctctctgtggatctctgtccccctctctctgggtctctgttcccctctctctgtgggtctctgtccccctctctctgtggatctctgtccccctctctctgggtctctgttcccctctctctgtgggtctctgtccccctctctctctgggtctctgttcccctctctctgggtctctgtccccctctctcagggtctctgtccccctctgtctcagagtctctgtccccctctctctgggtctctgtcccctctccctgggtctctgtacccctctccgtgggtctctgtcccctctccctgggtctctgtccccccatccctgggtctctgtccccccctctctgggtctctgtccccctctctctgggtctctgtcctcctctctctctgggtctctgttcccctctctctgggtctctgtccccctctctctgggtctctgtccccgtctctctgggtctctgtccccctctctctgggtctctgtcctcctctctctctgggtctctgttcccctctctctgggtctctgtccccctctctctgggtctctgtccccgtctctctgggtctctgtccccctctctctgggtctctgtccccctctctctgggtctctgtcccctctccctgggtctctgtccccctctccgtgggtctctgtcccctctccctgggtctctgtccccccctccctgggtctctgtccccccctctctgggtctctgtccccccctctctgggtctctgtcctcctctccctgggtctctgtccccctctctctgtgggtctctgtcccactctctctgggtctctgtcccactctctctgggtctctgtcccctctccctgggtctctgtccccctctctctgtgggtctctgtccccctctctctctgtctatccctgggtccctgctgccccaccttctgattctctgtcccctaagtctttgtctccccctctttgggttaaattgtcccctccctgtctggcatcctcctttctgagtctgttccctctccgccactggcccccaactccttctgttcc

SEQ ID NO: 92150 - DNA, 1067 bp, Homo sapiens
ccagactcaggagtctcgacccccatgccctggaccctggaacctggaccctcccatccccctcctccgtctgacccaggaatctgggtgtccagcgccctcctctctgggagcctggaggcgaggtccccagctccgcgctcccgcagaccctggtccggcgctcacctgctccttctccggcaccaccatgctgccgcggccgccgcaacctcctgcagcccagggccccggcgctccctccgccggctctgcttccagacccgcccagagcaaaccggatcctccactttccagcctagcctggggcggggcgaggtctggggggcggggagtcttggagacgccaaagcgggaggcggggagagggcgggtcccaggccgcgataaggggacagagggacagcgacctggggggtgcagaggtccgggccggggggagagagacacacaggggagactccaagggcaagcgcgagatgggaacagaaggagttgggggccagtggcggagagggaacagactcagaaaggaggatgccagacagggaggggacaatttaacccaaagagggggagacaaagacttaggggacagagaatcagaaggtggggcagcagggacccagggatagacagagagagagggggacagagacccacagagagagggggacagagacccagggagaggggacagagacccagagagagtgggacagagacccagagagagtgggacagagacccacagagagagggggacagagacccagggagaggaggacagagacccagagagggggggacagagacccagagagggggggacagagacccagggagggggggacagagacccagggagaggggacagagacccacggagagggggacagagacccagggagaggggacagagacccagagagagggggacagagacccagagagagggggacagagacccagagagacggggacagagacccagagagagggggacagagacccagagagaggggaacagagacccagagagagaggaggacagagacccagagaga

SEQ ID NO: 92151 - DNA, 1079 bp, Homo sapiens
cgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagagggtccgcggcccgctgaccccgcccgcggatggtcacgccccagccctgctccttccccattcctggactcggggaccttcccaagggcgttccttgccgacgctctccctctaggagcgtttgggtctgtgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgggcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagtttttttttttttttttttttttttgagacggtgtctcgctctgtcccccaggctggagtgcagtggcgcgatctcggctcactgcaagctccgcctcccgggttcacgccgttt

SEQ ID NO: 92152 - DNA, 1049 bp, Homo sapiens
ggctggtgcgggctgcccagagcacaggtgaccgagggtgggtgggggctgtctcctgggcctcggcctgcctgccatctcccccacgactgtgggtggcctcccccgccgcccagtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacccacaacccacgacccacaacctgcaaccccagcgctcaggatcccagtagtttggtctggtcgagatttggggaattacctatggttaagtgtctttccccgtcattattcatggttttaaaaacttctgtctgagagtgagttagctcacatcagtaatcccaacactttgggaggccgaggtaggaggattgcttgaggccagtaattcaagaccagcctgggtaacagagcaagaccttgtctctaccaataataataataataataataataaagaataaaaaataaattagccaggtgtggtgtcgtgtgcctgtaatcccagctacttgggaggctaaggtgagagaactgcttg

SEQ ID NO: 92153 - DNA, 1118 bp, Homo sapiens
gcctctctgccttcttagacgcccctcaaccctgccttccattatggcctgtccagccttcccttaattgtccatccatctctgtccatctgccccatcttgtttcctctctccccacccatccatctgtctatccatccatccaccctgtacctccatctatccattcatccattcattcatccatctacttatccatccatccatccatttgtccatccatccatttatccatccatccatccatccatccatccatccatctgtccatccatccatccatccatccatccatccatctgtccattcatccatccatccattcatctgtccatccatccatctacctatccattcatccatacatccatccatctacctatccattcatccatccatccatccatctatccatccatccatctgtccatccattcatctgtccatccatccatctacctatccgttcatccatccatccctctgtccatccatccatccctctgtccatccatccatccctctgtccatccatccatccatccatccatccatccatccatctgcccatccatccatctgtccatccatccatctacctatccattcatccatccatccacccatccatccatccatccatccatccatccatccatccatccatccatccgtccctcatacccttgcccatctcttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcgtaaggaccgggcaaagctggggg

SEQ ID NO: 92154 - DNA, 1062 bp, Homo sapiens
aacagaattccttcccaaagttagttcagcctatgcccaggaatgagcgaggacagcttaagggttagaagcaagatggagtcggttaggtctgatttctttcattgtcataattttctcagttatcatttttgcaaaggtggtttcacttcagcctcccaacgtgctgggattatagtcgtgagccactttacccagcctccaactgcttcttgacctgtctgtgactgctgaattgattctaactgcagcccagcccctgacttgcatccctggtctctgaaccacctgacttctggcattttcaactgactttcagtttcttccagatccatctccaaacattacttcatccttggcctctgatgaccccagttagtttctgacctctgactctgttccttcccttgacttcaggcttcctccccctctatgaaccctctttgacgcatccgtgccctctttgtctctccagggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacaggtgagtatctgcgacaccaacatcccaaacagtctccaagtggactctgggaagtatggggatgagcccctgccattgggaacatctatggtcttgaccagccactctccctggagatcccccagaaagtctctct

SEQ ID NO: 92155 - DNA, 1019 bp, Homo sapiens
ttttttggacataaacaaactttggtctaggaaatctcacccttcctataggaaatcatctgccttgggaagccctacttgctcccacagtctctccgatcctgacaagttgacattttggaaacattatcaatatttttagtttaaatctgacaggggctcagagtcccactttagtacaggaagttgtgcccaacaggaagtcccatcctcatctgttggaatggtttggctgacatttcaaacagctacccagagtcccttgctgtggatagtggttaaactcatggattccagctctaccacatacaaactgtgtttctttgggccgtttccttaacctctctgtgcctcatgtgtaccaaggaggagatactagtacccacccccttatgtgtcaagggttcggtggactaatctacataaagtgcttagccctgtatctgccatatggtgtcaatttaagtgttgactgtttactgccaaaacctggcctaagttgtctttgcctttcaccaccgtttccctacctcaatagttgtggctgtgacattgggcacttgctctgtactctggagctgcagtccaacccttgctgggcgtcttagggacggggctgtgggggagatttggatcctaatccttcccaccccccacagtctctgctgacacagaagtggtggggagatatggccagcactacacccatctgggccctggttctcgccttcttttgccctccactcatctacacccgcctcatcaccttcaggtcagtaccctggggtgagagtggtggggatgggggcggggtgctcagtttctccttcctgccccctctgcccacctttcttccctcatcggcccattgtgtcccttccctaggaatgggactctctgtccctccactaagggagtgctgtgggaggtgagttttgggggggatcctccctgtggtatctctagtggcagttactctgcctttctggccatggctctgggggaaggtccctttggga

SEQ ID NO: 92156 - DNA, 1094 bp, Homo sapiens
agcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctg

SEQ ID NO: 92157 - DNA, 1030 bp, Homo sapiens
gaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaa

SEQ ID NO: 92158 - DNA, 1096 bp, Homo sapiens
attttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctccccaaacccaaccagaccctgcttgtaatttggactttggactgatcctctccctgagcccaggttgaacttccttatttgtatttttttgagacagggtctcactctgtcgccaaggctagagtgtggtgatgtgatcgtagcttactgcagcctcgacctcctggactcaagcaatcctcctgccttcgccccataagtagctgggactacttaaaattagccaggccagcaggcctgcctaatttaaaaaaatttttggagagaggggtctcactatgttgtccatgctagtctcgagctcctggactcaagtgatcctccctcctcagcctcccaaagtgctgggataatct

SEQ ID NO: 92159 - DNA, 1048 bp, Homo sapiens
cgtgataccatcccaacttgacctctgacatctgacccttggcccttctaaactgactttttttttttttttttttttttgagatggagtcttactctgtctcccaggctggagtgcagtggcacgatctcagctcactgcaacctccacctcctgggttcaagcgattctcctgcctcagcctccccagtagctgggattacaggtgcccaccaccacgcctggctaatttttgtatttttagtagagatggggcttcaccatgttagccaggctggtctcgaactcctgacctgaggtgatccgcccactccggcctcccaaagtgctgggactacaggcgtgaccaaacgcccttggctctaacctgacttctaatcgcatcctgtaacctctgactttagtgatcttgacttctgtctgctgctatagactgaacaattattgcctggcatctaaccttcgtccttgcccctggctgggccctgacctcaagtgacctttgacctctggcctttgcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgtaagaacagagcttggcttaaaaaggagaaatataggggaccgggagcctggaaggcgaggggaagggggcatgccccaaatgactaacgggcgtggcttaggtagcgaggggcggggtttaagcaacaaggggcggagcttaagcactgaggggcagtgcttacgggtgaggggcggggcatgttctcgaatcaccaggggctgggtctgggatagcgtgcgtgttctgagggtgtcggaaggggcagctgggattgggaaggggcgtggcctgagccctttgactccgcccgcccctgcaggggtttacctttctaaggaagccga

SEQ ID NO: 92160 - DNA, 1010 bp, Homo sapiens
tgggggtgggtgggctgcgggtgcccccggtaagaggccctcccttctcagggtggacttggcactgaaacagctgggacacatccgcgagtacgaacagcgcctgaaagtgctggagcgggaggtgaggccttggggcctggctgggggactgtggcaggggtcccatctcccgctctgacattcctcccattccgcaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtgtccggaggcttgattcctgggggagctggtgggtgtctagatccaggatgggagctggagctggggtgttgggtttggggttcttggtggatttgctgctgtaattcagatattttggagtccgtttcctcc

SEQ ID NO: 92161 - DNA, 1051 bp, Homo sapiens
ccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaacgcaggggatttatttgaggtttgggtgaaaaataatcttgtgggtggtggtaggccgacagatggggacaggaagctgtggacgaaagccccaggtcccgtgggagaggtgacagcagcaggggcacgcagccacgtgggtccccaggggaatgtgaaggcggagggctccaggcgaactggggattaaacaaatatttacaggcagcagggaagtgcccagcgcacgtgacgggggcggggcgggactttggggagggcggggcctaacg

SEQ ID NO: 92162 - DNA, 1010 bp, Homo sapiens
ggctaggggtgtatttctcagcccagagaggaactgatggatccaggctaggcattggttgggtagtgtggctgcaggacggtgaggcaggagtgttgacggtattgtcagagaaagagtgtagtgagggccgagtgtggtggctcacgcctgtaatcccagcactttgggaggctgaggcgggtggatcacgaggtcaggagatcgagaccattctggccaacatggtgaaaccccgtctctactaaaaacaccaaaaaaaaaaaaacaaaaaacaattagctgggcgtggtggcaggcacctgtagtcccagctactcaggagggtgaggcaggagaatcacttgaacccaggaggcagaggttgcattgagccaagattgtgccactgtactccagcctgggcaatagagcgagactccagctcaaaaaaaaaaaaaagagtgcagtgacaggctgtgtgggatctagactggaagagaaggaaggtcactggggagctgctgctgaatggggatacgggaagcatcagatcaagtacctgggggctgagggttttgcaggggggttgcttagctggaaggtagggggctgggcaggcactgccctgacgctggggtttccgctttcatggagctgttagtcaaatgggggaaatgagcgttcatcaaatcatcacctgcataaacagaaaatcgaagaatgtgtgaggtgctgtgaagaaccacagcaggttctggggtggaggagaaagttctaggggtttctctgagaagataacattgaaggccgggtaggacttagccaggtgaagaatgggagtgggaggcccggcatggtggcccgcatctgtaatcccagcactttgggaggccaaggagggcagatcacttgaggtcaggagttcgagaccagcctgtccagcatagtaaaaccccatctctacctaaaatgcaaaaaatagccaggcatggtgatgtgcgcctgtaatcccagctactccggagcct

SEQ ID NO: 92163 - DNA, 1643 bp, Homo sapiens
acccgtaattcatacccgaacctttagccttcatggccctcggcattactctagggtaatcattgtgacttcatcacaattgagttcctctggaaactctgagaacactcccatcctcagctttccaagaaatccagctccttctcctccctcagactcaggagtccagaccccagccccttctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtgagtctacttctgtcttttgccctggcccccactgatgaataatgacagtaaccaaggtttatggagcactctgaagtaggagctagcatcaccatttgcacagatgaggaaactgaggcacagctaggttaagtgatttgcttatggtcgcacagagccagtgcgtgatggagctgggatttgaacccaagcagtctggcttccacgtagctgaggggaccggcagcccacttgctgcagacctttggggacccatgctgctttcttcttccctggtgtccatgctgtggggaagttctgttgaaagtctaactaactctgttccgtctttgaatcttcaggtcggaatgaactgatcgcccgctacatcaagctgagaacggggaagacccgaactcgaaaacaggtctcggaatggacttgtgggcttctgtctgggatgggccggtcttcttagggtcatcctcgcatgggcaggttcaggttcaaggaagaagctgcttcctgtgcgttcatctgtcttctcggcatgtgtgttagtccgtttgtattgctataaagaattacccgaggctgggttatttatgtatttgtttattttttgaaatggagtctagctctgttgcccaggccggagtgcagtggcgcgatcttggctcactgcaacctctgcctcccgggttcaagcaattctcctgtctcagcctcccgagtagcagggattacagacatgcactaccatgcctgggtaattttgtatttttagtagagatggggtttcaccatgttgtccaggctggtctcgaactcctgacctcaggtgatccactcacctcagccccccaaagtgctgggattgctgggattacaggcgtgagctactgtgcctggcaaggctggataat

SEQ ID NO: 92164 - DNA, 1215 bp, Homo sapiens
tccccagccccaggccgggaggtaggaaggcgccggcgggagtcggggatcctgctttggggtgtgtgagttggggtggggagttgcttcttaggaggtgaggcgtgcgtttgcgggaccgtctctgaatggttcgcagccctctttttgcccgggggcccgaatttgctcccgtgaccgagcctcagtgaggagtgggaactctggccggagttagggtgcctgcggctgggtctgagtttgggcgtgcgcgcaggagcgggtgcgggccaagggcgctggcggggtgtggggcgtgcgtctgcggcggtgtcactttggagtgagaaggaccccttgtgtaatctggggggcatttggtccttcttacggagaagggagggcctctggggtggccgaggggaggttacggggctttctggatcttaagtcttgcctctttggaggtttagggtctggggcgggaaattagggggacctttcttacccggctccaccgtccctttgtctggccacatggggaagggctgggctgggattttggcctacgggggtcctgaacgccgcagcgccactgggcttggctggggtctttgtctgctatggtcggcgggaggaggggaataggggcctggactctggggtcctgggaaagctgtggaggacatggagcctccggggaggcgggatctgactgtattggaaaaagttttccctgttcccggcctccggaaagtcactgggaacttgagttggatcagagcccacggcgcacgggggaggggaggggcggggcccggtgccggaggggagtcgccctggccggcaagcccctcccctgatgggggttgtgggaagctgggggaggggacgcctgggccctttgttctggctcttctgatggcagggcgcccctgtcccccagcttgtggttctgtgggtctctcctggtctcggcctcagctgctgccctgagtctctgtccctgccctttctaggtctccgtctccctttctctgggtctctgttgccctctctctgagcctctgtccccctctctctgagtctgtgtccccctctctctgggtctctggtcccctctctctctgggtctctgtccctctctctctgggtctctgtccccctctctctgggtctctgtcaccctctctctctgggtctctgtctccctctctgggcctctggacccctctc

SEQ ID NO: 92165 - DNA, 1018 bp, Homo sapiens
accccgcacccagagtctcctgagacccccaaagctgactcactcacaacctcaatatcagaatccctggacatgcccaaaactaacctctccaaaatggcacacccagagtcttctgagacccccacacctggcccaactgaaatgccacacccaggatcccctgagacccccaaacctaacttctccaaaacttcacgcccagaatttcctgagaccccaaacactgaccttatgcaaactacaccccaagaatccccagagattctgcagcttaatgccactgaagtctcacaggcagaactccccgagacctcaaacactaaccctaccaagacccctgaccccaaatccccagaaaagcatgacctcaactccactgagaccccaaactctgaatttctccaagctctccatcctgacccttctaaaaccccccacccagaatcccatgtgacccacaatcccagccccaccgaaatttcccaaacagaattccccacaacctactaccaaaatgcaacagatgtacccaggacctccgaccctcaaatctccactagtctctacccagaaacacctgtgcccttcaaggatgacgccactgctctaaatgagctgtccctgaatcccaaaccaggaacacctgcagccatccagcccgactccccaaaattgcccacttcagattctccaggaatggttgagctgaaggccccccagaactctggccctaaggagtccaacgtccctcctccctcagcccggattgcaggtccccctgctcttccagggcgccccagtcagttggcccctgccactctgcgggcaccccagaggcacagccgaggtgagggagtcaacaccatcatcgtggtggagcgagtgaaggagaccggtgaggggcaggagccggactcctgagtctgagggaggggctgggggcctggactcctgggtccgagggaggaggggctgggggcctggactcctgggtgcgagggaggaggggctgggg

SEQ ID NO: 92166 - DNA, 1050 bp, Homo sapiens
ttctctccctgagtttcattccctaaccccgattttcttccctctggcttccgccccccacagttatatttcacacaccccgccagtgccagctgcgaccccatagtctccccattgtgttatttctctgctcctctgggatctgtccgcgctctgagttcttccctagctccgggggatccattcctctatttgagttctgtctccaccccctgagatctgtcccgccccctaaattgtgatccgcaccccctggcatcctcacccgccctctgaatttgtctcctcccctaggatctgtcgctgacctgagttctgcccccgccctctgagttctctccccaccgttggagttgtgtccccttctcctaggatctgtccctggctctgttcccgccctctcagttctgtccttgccccctggaatctgttcctgccatctgagttctaccccttccccacaggatctatctctgccccctggaatctgtccccacccaccgagttctggcctccgtccctgggatctgtccccgccctctgtgttctacccctgccccatgggatctgtccccgcccacccagttctccccgccccctggatctctccctaccctcccagtcttgccccggccccatgggatctgtccccgccctccgacttctgaccctcgccactgggatctgtcctcgacctcccagtcctgcctccgcccccggaatctgaccccgcccaccgagctctggcctccgcccctgagatctgtccccgccctcccagtcttgcccctgccccatgggatctgtcccccgcccaccgcctccgcctctgggatctgtccctgccctcccagtcctgctcccacccccggaatctgtccccgcccaccgaactctgtctccacgccggaattccagcgccgccccgttgggtagagcccggcccttccctgtcctgggcccgcagacagggtcccgccccgctcctgtcctcagaccagcccatctcccggcgctgagtccacctccagatccaggccccaggagggt

SEQ ID NO: 92167 - DNA, 1036 bp, Homo sapiens
tcgctggagtacggaccggtgccggagagccacgcatgcgcactggtgagagtctgcccggccggcgctgctcgctgcgttccccaggcctgggcgcccggtttttcgcggggagtcccgtcatccactgcggtagctcagccgctccgcctctcttagtccccgtgattcccgccgcccaataggatcgcgccctgtaggacgctcccttgagccttggcggtggcagccttttagtctgttccggtcttccccactggttctcttgccccttgatcctgaactcctcgtagtgtttccgcggttttcctgaactcctctagacgctctcgtgattcctcagggtcccctcagaacctgacgccacccaccagaccccttaggattcctgtgaggctccagtgacccacaacccccattgtctttccacgactcttcaaaacatcctatggcttccatgggcctccagagcaccccagacctcctgagggactcccttcatccctttgattacccagagaccttcagaacttccatggagcccccgtgatcccataggacccctcaatactcgtggggttcatgtgacctcatcggaactctcaggagcctagaatacatcaggacttccggtttgggttgggttttttttttgtttttttttttgagccagggtctcactctgtcgcccaaactgaagtgcactggcgctatcacaccactgcagcctcaacctcctgggctcaagccatcctctcacctcagccccccaagtaactgggaccagagacgcgcgccaccactctcagctaatatttgtactttttctagagacaaggtttcagcatgttggccaggctggtctcgaactcctggcctcaagtgatccacccacctcgacttcccaaagtgctgggattacaggcgtgagctactgcacccagccacatcaggacttcctgtaattacttatggcccctcacaataccctcacggggctcctatgatctctctagctctcagaatgtcccatagg

SEQ ID NO: 92168 - DNA, 1052 bp, Homo sapiens
taatgtcatctgatgcccagttcatgttcaaatatccctgactttctcacagatgtctctctccctgtgggcgtttgagtttggaacttctaagtaacttttttgctttaaagagaaaggagaagccaggcacagtggctcatgcttgtaatcccagcactttgggaggccgaggcgagtggatcacctgaggccaggagttcgagaccagcctggccaacatggtaaaaacccatctctactagaaatatataaattagctgggcatggtggcggccgcctgtaatcccagctacttgggaggctgaggtaggagaatcacgtgaacccaggaggcggaggttgcagtgagctgagatcgcaccattgcactccagcctgggagacaagagcaagactccatctcaaaaaaaaaaaagaaagaagggccagtaagagaaaaatcaggaatatgtgacatcagagatgctaggggagtctgtagaaggagcaagtgagcagtgtgctttggatttagcatcagggaagacgtgaccaggatgagaaagaaatatggaggagaagtccgggcgcagtggctcacgcctgtaatctcagcactttgggaggccgaggcgggcggatcacgaggtcaggagatcaagaccatcctggctaacacagtgaaaccccatctctactaaaaatacaaaaaaattagccaggcgtggtggcaggcgcatgtagtcccagctactcgggagcctgaggcaggagaatggcgtgaatccaggaggcggaccttgcagtgagcagagatcgcgccactgcactccagcctgggtgacagagcaagactctgtctcaaacaaaaaaaaaaaaaagaaagaaagaaatatggaggagatgtggtgagtgagatgtggtaaaaaaattttttttctttgagacagagccttgctctgttactcaggctggagtgcagtggcgtgatcttggcttactacagcctctacctcctgggctcaagtgatcctcccacctcagactcccaggtagctgggactacaggc

SEQ ID NO: 92169 - DNA, 1877 bp, Homo sapiens
tcctcccgaacccctttccaaactgtctctacctcccccaggcctggctggacacccaggaccggtgcttgggccactatgtgaatgggaagtggttaaagcctgaacacagaaattcagtgccttgccaggatcccatcacaggtacgagatgtcccccagtcattagtggaagggaggtatctgtgccctctagccctacccaccaacacccattccccttgcctagggccctgagggcaggaaacagctggtggtgggagatgggctgcgatgtctggttccttctgaaaccagtcaccctaattatggttccgggtctctgtggaggctttgtgagactgctgtctgttaaaatagcttccttgccctggaggtgatcatagccgtgacccagcagagaatggggaccagctttacactcttgggctgatccaggctccgaaaatctcagccccctccagatatgacatgggctactcctcccatctgagtccccccacttttctccccaggagagaacttggccagttgcctgcaggcacaggccgaggatgtggctgcagccgtggaggcagccaggatggcatttaagggctggagtgcgcaccccggcgtcgtccgggcccagcacctgaccaggtgatgcagctgaggtgtggaccccgggaggcggggaaccccagcatccactcgagaccatgggaacaaaggctatttcccaagatcccactgaattaatttgcagctaaggctcagattcccagtatgtgctggaggcagtcgtggctgaaacatgcatccgttgtccactattcactgggactagaagccacaaagcctctatttcccaggacattcttggagtgcattggggctcagttcactggggctggtgaagcccctaaatccatttcctagccgcttgcggggaagctagagacaaaaattccatttcccaaaacgcaattgaggttagaagctaagactcaatttcccaaaagcttcagggatttccggcggccaagacctttacacagcatcctcagggtttgtgtttccatgactataattctcataaatcttcactgccctctgccccaggtaaatggtggggatgcctcaggggctcatggggattgtagtccaggtatataggagcagcccaggactctgcaaggctgagggccgttggaaaatgagcaccctcttgctttctcgacaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggtgagaccctggagtccctagccctatcctcccacatgactcagcagtgctagctccagtcccctcattctttttcttttagacagagtttcgctcttgtcgcccaggccggagtgcagtggcgcaatcttggctcactataacctccgcctcccgggttcaagtgattctcctgcctcagcctcctgagtagctggaattacaggcacccaccaccacacctggctaattgttatatttttattagagaagaggggtctcatcatgttggtcaggctggtctcaaactcctaacctcagatgattcacctgccttggcatcccaaagtgctgggattacaggcatgagccaccgtgcccggtcccctcattctttttcttttgtttttgtttttgtttttttctttttcagacagggtctttctctgtcaccctggctggagtacagtggtgcaattatagctcactgatac

SEQ ID NO: 92170 - DNA, 1021 bp, Homo sapiens
aggggctggagtctggactcctgggtctgagggaggaggggctgggcctggactccggggtctgagggaggaggggctgggggcctggactcctgagtctgagggaggaggggctggagtctggactcctgggtctgagggaggaggggctgggggtccagattcctgggtctgagggaggaggggctgggcctggactcctgggcctttgagctgccccacttccccaggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggtaccttcgggacaggggtcgtggcggaacgcggctgggggccgcaaggctcctcctgcggctgaactggggggggtccctaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccggtgagacccgtgcgctcccgtctcctcataccctggaggccgttggtgtctgtctccagtcttcggggtcccgagtctctgttcattttattttattttattttatttattttgagacggagtttcactcttgtcgcccaggctggggtgcagcggcgcgattttggctcaccgcaacctctgcctcccaggttcagcctgggagtagctgcctcagcctcccgagtagctgggattacaggcgggcaccaccatgcctggctaatttatgtatttttagtagagacggggtttcaccatgttggccaggctggtctcgaactcctgacctcaggtgatccgcccacctcggcctcccaaagtgctgggactg

SEQ ID NO: 92171 - DNA, 2531 bp, Homo sapiens
accctgtctcaaaaccaaatcctacagtttattagttacaaggtcttgtaactgggtagtcagtgggcagagccttgctggtcttcgttcaaatccaattgctttgcaaaatacaatctgagcataaaatactcatagaagaactcagatatgaggggagtttgggcctcttaaactgctcactcactgatcctgaggcagccttgctttctcagtccctgttcctcatctgtagaacggggctccgtgcatagttcccagctctgatggctgggtgcaaggcacgctgttggcacggtaggacaaaagaagggaatgcttgcttgtgaggacaatcaaaggctgtccttgtctctgagtccttttgcccttgtctcccacaggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagtaattatgtattaggctagtttttcatttaaacaggaacttagctctggcaagtactgcgctgtgtctggagggtgactgcataggcagtggtgggaccctcaggcggctcggccctgctaagcctttccctccctctaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcccccagccgcatcttctggcggaccgtgcgaggtgagcagagcgtggggactgcaggtggtgacgggcaggcggccggtgatgagaacttctcccactcacattcgagtttcccgaccatgagatgactccacatgcactaccatctgaggccaccccatgggcccacctcagtggggtgggtgggcatccttatgaggccctctgactgggcctgctatctgtcacccaacaggtatgctgccccacaaaaccaagcgaggccaggccgctctggaccgtctcaaggtgtttgacggcatcccaccgccctacgacaaggtgagctatgccaaaccccacaggcagcggccttacctgtggcgtccatgatgttccgcaactacctacattgtttgatcctcatgaaagcagcactggctgagacgccagtccagccgacctccttccctgtctgtccctcccgggctcttaagcccctctctttctctaacagaaaaagcggatggtggttcctgctgccctcaaggtcgtgcgtctgaagcctacaagaaaggtgagtcccagcttacgctgcaccatctacttgggagatttcaggcctgctgagggacctggggacctggagcctggcagatgatgtccttatctcacgatggtctgcggatgtccctgtgggaatggcgacaatgccaatggcttagctgatgccaggaggcttgggtgggtgcttttctaacaggcctgcagagaacagttgcattatgatatgcccagctgtcagtcacctcccagctctcaacagctccggctcttcagggtgtgggggcttagatatccttacaacttcatttgttcaccccccccccccccccccgcagtttgcctatctggggcgcctggctcacgaggttggctggaagtaccaggcagtgacagccaccctggaggagaagaggaaagagaaagccaagatccactaccggaagaagaaacagctcatggtgaggccaggggctggtgctgaggggggcatctcactcctggacaggcctggcaggtgccttgctcacagagtactcttaactggcaaaggaccagccggggttggggtgggatgcagtccatgtaatgagggcaatgcaacccctcctgaccaccaccacctgcacttattcttggcagaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcgga

SEQ ID NO: 92172 - DNA, 2576 bp, Homo sapiens
tgttgggattacaggcgtgagccaccgcgctaggccgagagtaactttcactgcacctctgaaagttcgtgggcagctcctgcccctaacaaagatggcgacgccgccacacatgctcctagcactccccggccgcccacccttcaaaaagatggcagccgcctcatccggtttgaaggctgaacgaacagagccacgcggtatccaaatcccacgggagcctacgccacgccgaaacaggatggactccgtacgactctcgcgataatacgggcgggctgaaggctggtcacatcttccctgcctaaataatcgcgcccggcgttgtggggcctaagactctcgcgagacaccgtctagcacttcccgcccgtcagtccttcacagtgcccgaatcgcccgctggtttaagtgcagcctgtcaatcagagcagctctcgaggccccgcccaaggccgtgctgcgtttctccttacgtcacttcctctccagcccctgcgtaatcgataaggaaacccggacgctgctgcccctttctttttttcaggcggccgggaagatggcggacattcaggtgcggactcggggttggatgccagggtgcggggtccgccttggccttcaggggcgcgtccgggagggcagagcccggcggccaagttcgggggttaattccgggcgtccgtgattattttctagagattaactggagtggagggcgcttgcttttgtttctagatgagtgcttcctaattcctgggggctcctggcgttaatggaggctcaagcgttttaggacttaccttcttaaaaaccaagtttaagaaggtttttttggagttctccggtcttcaggggtaattctgtggaaacggactcctaagggctaatccagggagcctgccgtctggtatttaattctgaatccttatgtactacataaggagtgaatcctgggtgggcgatcttgggtcttggagaatgatcctcgctgaaaggtgtccagggtgtgagagggttgatcctggtttagaggatgaattttgcaatccctgagaggccttctggagtatataaattgaaataacctcgggcttagatctgagtatgaattacaggtaaggtcagggtggtcatgtcttagagggtgattctggggcaccaggccttggacgccggcgctttgcaagtaaatgtagagcatggggtctgggaggttctgggaaggtctctagggctggttggctgccggcttcaaacttagcagctcatcagttttctcctcataatctgtagactgagcgtgcctaccaaaagcagccgaccatctttcaaaacaagaagagggtcctgctgggagaaactggcaaggagaagctcccgcggtactacaagaacatcggtctgggcttcaagacacccaaggaggtgcggggaacctcagaagaaagaaggggaacctggcgttcctgcacgtgtgcccacgacgagttgccctgcctgcatctaagtggcttctggggctgctgggaattgtagttgcttccctgaggccacgcccctggctcttttaaggaaccgcccgcccaaggctcactcctttatctttcctatcctttcaggctattgagggcacctacattgacaagaaatgccccttcactggtaatgtgtccattcgagggcggatcctctctggtaagtgcgggagttactggtgtctggggcctgaaatactgaaagaagggtcttggggcccagactcctgggtcctgggtgagaggggtggttaggaatgcaaacttgtaggtccaggtacattggcagatgatgtttgttttcacgatggtcttcagatgcccacgtgggcactgctgagaaagccacttggtaaaactgatgccggaaatggggctttttgggatccctgctcagctgcttctgagtcccagcatgccctgggttacctatggccctctttcccatgggacctgacctatgatcggcccccgctcctaggcgtggtgaccaagatgaagatgcagaggaccattgtcatccgccgagactatctgcactacatccgcaagtacaaccgcttcgagaagcgccacaagaacatgtctgtacacctgtccccctgcttcaggtgagcgcagtggcccatcaggttgctcaggccacgctctctcagccttcagattccagatcggaccaatttaaggccaactgagggagggaaagactgaggtggcatctctgggaagccccagaatctcaggatttgtatatcatatgttcttcagaatcaaagcgttctacagggtgaatatctctacctgaaatgcttggaaccagattttggaatgttctcgcatacatagtgagatgttttggggatgtgacataggtctaaacaagaagctcatttgtttcatatacaccttattcacatagcctgaaagtagtcttacgcagtgcgttttataattctgtgtgaaacaaagtttgcgtacattgaaccattggaaagcaaaggtgtcacgctggtattgaagaagtttcagattctagcc

SEQ ID NO: 92173 - DNA, 1118 bp, Homo sapiens
ttagttagagcttatcacgtaccaggtgtggtgtgagatgtttggggttcagtggtgagccaggaacaaagtcctgctccctcagagggcaccttcaagcagtgtgggtgccagatgacagccaagtataaccagaatggggatgtgggcagctgatattggtggccctctgggcggggaggatcttgggagcaaggtgaggagtcctgtgggtggagaggagggtggcccaaactgatgctgagcgataagggacctgtggttgtcagtgctgcaggatccccctgctgctctgctggggaagggtggtgaggctgctgacaacttgggggcctccagtttgcttgtgaaatggagctcgtccaccccagcggtcctcggaggggtggtggcctgctctgtgtacagcgttgagcttggtgcttggcacaaaacttgtacgaaaggaggggacaggttgaattggcgagtagagcttggttggggtttggtggagccgaagcagagagcctttagcctggtgaaggggagggagggcctcctggggtctgctggggtggcccctcctgaggacatggccctacctgcctccacagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaggccagacttgggatcttccgcgcctttaccagagcattggtgggggtgggggtgtgcctcggggaattgggcagagctgctgtcagagaggctgcctgcccatgtctgtgggtgaggacagtggagcctgaactgagatgcctgccttcccctgggtctccttctttggtccttgtcaccttttcggtgtctgaataaggctgattacctggcgttgcgctgtccccccgccccctccggtctctggggaggaagtgagtgacggcggaggcccctgggtcctccaggccctggtctgtctctttcctgaccacctcgggtggggaggggaagaagctgcagc

SEQ ID NO: 92174 - DNA, 1049 bp, Homo sapiens
gcaagtggcatcatgaggctcccctggagcctgttcagtggtaccggggcccaggctgctgggaaggaagtgggcaggaagcgtccggagacggcccaatacacacaggccgcagagatgggggccttgagaggaacaggacaggacacacggtggcccagggttgtggcacatggggaggaggggttttgcagagctggggagagcacagaccaccgcgagaggcaggtacaatagaaacaggtgtactttgcgcatcacacagaggtggggacgacaggcatggggtgggggcggtgaggcaggagcgcaccagaggatatgtgggacccgaaggggagagacgcataaaagccgcagcagagatgggagtacagggaggggaggtcccaatgcccgctcacctcaccccttggggcctgccggtgccggggtccccaggtccctgtcccccaggcctgtaccagggtctgagcccagcactggtacaagggttgggagacagggccatggggagaggagccgccgctgccgctgctgcctcggggacgctgcctccccgtgggcccagtccctgccttatacccaggtccagggagggcgggggttcctgccagaggaagtggggccgcatcaaagagggcaggaaggggcagggacaggttggggggacgccaccctgagtcgcagaaactgcacacccactccaccctatgctgggggcagtagagaaccagcaaggggcaaagagggagtgtggactccagagggaggggacggagacccagaggggaataggaggttgcggccccctcccctcagccgcaggtgtttccgttcgggtggggctgctgtgtttacaacaacagcccggctccccggtttcctccctgattgttggggcgtctccttggcaccccatcacgtcaggtggtgtgctgaggtcagagtgtgtgctggggaaggacctctgctgggcctgctggattgcaaagagcaagtttaaaagaccccctcggacctcttgacaggccttccacctgaagagt

SEQ ID NO: 92175 - DNA, 1057 bp, Homo sapiens
gggcctggattcctgggtctgagagaggagggactgggggtctggacgctgggtctgagggaggagggaggaggggccgggggggcctggactcctgggtccgagggaggaggggttgggggcccggactcctgggtccgagggtagagcggttgggggcccggactcctgggtccgagggtagagcggttgggggcccggactcctgggtccgagggaagagcggttgggggcctggactccggggtctgagggaggaggggctggggcctgaggggggcggaaggggcgtggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcaggtgagggccgctccgggccagggccctgctgcaggcgggcggcgggaggcggccccaggcaggcaggggcgaagccagcgggacccgagttccccgcgagcccctggcgctgccttctccgctcaattaactttctcaacgtctcctgctgggcctgaggctgggaaccacctgtcgcctcttgtgtctgtttccctctctctctctgggtctctgtccccctctctttctgggtctcttgtctctctctctctgggtctctgtccccccccccccgggtttctgtcccctctctctgaatctgtccccctccctccataatagattcttctccctccctgggtatctgtcccactgcagtctagttccccgcccgtgtgctcccttcagctctgtttctgtctgcagaaagccacctctccctcctgtaccaccttaccgcggt

SEQ ID NO: 92176 - DNA, 1050 bp, Homo sapiens
gagcctgcctgacctctcgctggccacaactatgccctgcaccttgcgtgggatgtgcgccacgtctgtctctgtaattccccctggcaggtctgggacccccctgagactccgtcagaagattcggtcctccccataggtggctttacctctaagcatcccgccctcttttcccccatcgcccgccctttttgagcccgaaagcttgcagccaacttccaactccctgtcctgtcctaggtaacccctccaccccgccattctcctatcccgtgtctgtccccatccctgtgacccctgacccctggcctttgccactccccagggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggtaagagagacattcggttggggcgtgtccagaggtggggcttaggagagagacgcgggggtatcgacaggggtcagagaaatggcgtggactgaacttcatttctttgtgagaaatgaaattctaccttctatccttgggaaaaagaaattaagttaaaattgaggcctaaagaggacctttgagaccgggcgtggtggctcatgcctgtaatcccagcactttgggaggccaaggcaggccgatcacttgaggtcaggagttcgagaacagcctggccaacatggtgaaatcccgtctctactaaaaatacaaaattaggcaggcgtggtggtgggcacctgtaatcccagctactcgggaggctgaggcaggagaatcgcttgaacctgggaggtggaggttgcagtgagccaaaattgcaccactgccctccagtcagggcgacaaagtgagactccgtctaaaaaacaacaa

SEQ ID NO: 92177 - DNA, 1068 bp, Homo sapiens
ctggtaagggggaggggcatggggcgggtcggggcctgagacagcgggggatcgggggtgtggccgtggctgtctgggttcagagtcaatcttgcaacagggcccccttggcaagggtcacagtgcgacgccgcgctccccttcaccaccccagctcggcccagcgagaggtgcagcacgtgcaggccgagggcggggccggcgcggagagggtggccctgcatcgtagtaggtccctcccccgcagtgctcccagcaggcccgctcgttctggagaagggcgtgactcgacctgggggtggaccctaggctgaggggtagggtcctccggtgggcttggtcccgaaattgacccgcgcccctccccagttagcccgcggaccgtggactgtattttcagccccggatccgaagtgtcccagggggcgtggcccgtgcgaggggcggggcctgggggcgggaccagagcctgacgtgtgcccgccccggcttctaggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtacgcggcgagcccccgaccctgctccccatacaccgtgaccctgaccttctggaccgcctcattctgagaaccctgaacccatttacccggagtccctggcccctaaccaggctctacccacttttaggagcccataactgtgagatcttcagtttctcacctctggcttctcttttttgtttttcgtctgcttatttttctggtatttagctgcatgctaaaaacgatctttttttcaaacatgaagtcacaattaggtgctaaaagccactgaacgcacccaaacagggacttgaaacctgggccctcaaattaaaagtccaatgctctaccaactaagctacccaggttcccttcagggctttc

SEQ ID NO: 92178 - DNA, 1026 bp, Homo sapiens
ctcacggcaacctccgcttcctgggttcaatcgactcttgtgcctcagactcccgagtagctgggattacaggcgtgccccaccatgcccggctaagtatttttttggtagagatggggtttcgccatgttggccaggctggtctcaaactcctgacctcaagtgatctgccagcttcagcctcccaaagtgctgctattacaggcgtgagccactgcatccagcctactgatatatacttattaactccacagaaatctttgtaccccagtaggatttactttgtctttgttttaacctgcttggcgtttcctccattaaagctcatctcactgagacctgtccttccccaggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgtgagtggcggctggggaaccctgtcccccacacccttccggggacccaggcttccggttcaggtcctgcttcccagcaccgacctgggggcaggcagtcacctggttctccagcatcttgccggggaagccaggccgcaaacacaggtcagaggacggtgacctttcccacctccactctcagtcccctggggtctgatctctcctcgtctggccttcccctccctgtgctcgcatttggggtccaggcccccagccttccctcagacagccactgtgccccaccttatacaatttcttttctttcttttttttttttgagacatagtctccctcggttgcccaggctggaaagcagtggtgcgatctcagctcactgcaacctccgcctcccgggttcaagcaattctcctgcctcagcgtcccgagtagctgggattacaggggcgcaccaccacacctggctaatttttagtagagacagggtttcttcatgttgg

SEQ ID NO: 92179 - DNA, 1043 bp, Homo sapiens
ttatagtgaatgagtttggatataaattggggaacaaaagtcgttttgctccagaagggcacaaaaacaaggagcggaggtgtccagtgtgtcagaagaagccccaaagtgcaccatgttcacacataaagcagaggtaggttctaggctctgctaaacataaaggagcttctccccttggagggtgtttgctggggcttgagcaagttattagggacccaggacagctccccttgtgagcaacaaacctgtgcactgctggacattagggcctctgggctctggccccgtaaatgcaggtggtgcctgtttgatgataacatcccagaaagcccgcaaatttcccacatgccacctgttgagactgctctactgcctgcctcccacagctgcccggagctaaatttccaagagaacctctcactcttaccccaggggtccagcctcccccaggagccagggtcatcggcccccagcctcaatgcccctttctcctccaggaaaccctggaggacctggacagaaacaaagatggctatgtccaggtggaggagtacatcggtgagtgggccccaatttcttcttgggatgcctgtcctctctcaggcatgggcagggttggtgggggtagccggaggtacatcacccatcatcagagaacagtggccctcagacatgggggcaggggcactcactgcttgagttcatttagccacccaacatttattgagcacctactctataccagacacaaaaagcatctattgagcacctgctgtgtgtcacgcccaggatacacttactgagcacctactgcatatgggtggttgcgcctacagcagacaataacacagacaaatcccttcttgggggtctggagtttctacaaaatcaaggctcaggggctatgtttagttgagaatgggggtcaggaagctggtcttgaacctgcgcctgcacagcaaacactgtttcctgttacatgggatgttgggggatcctcacaataccccctgagttctgagttctccctgggcccctgc

SEQ ID NO: 92180 - DNA, 1016 bp, Homo sapiens
agcccctggtggaagccaaccacctgctgcacgagagcgacacggacaaggtgcagtgacggggcctcggcaggagcgaggagcgggtgggcattgcgggccagactccagaaaggagcaagacctgggcctggagctcagggtcccttttaggtgggataaaaaaagagggacagagagagggaggaaaagagagggcacggagccccagaaagagagggggacagagacccagagacccaaagagagaaggacagggaccaagacggggacagattcagagagaaagggacagaggcccagagaacaagggtcccagagacttcgggacacgcttggatgcagggagggcttttgaaagcagggccgtgttgtcccctctgaaccctgaccctccctccaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaccttgtgtgtctgtctgttgtctgcctgtctctatgaagggtaagggggccctggagatggtttgggggctgtgactgggagttg

SEQ ID NO: 92181 - DNA, 1042 bp, Homo sapiens
tcatcacccgcagcgagcgctacgtgtgtgccgtgacccgcgacagcctgagcaacgccaccccctgcgctgtgctgcggccctcgtgagtcacctgggaggggagggaagggaccactcgggaacctgcggggcggtccggctttggggccagtaggtccccaggaaggcccctgatcagagtctcccgccttcggcctcaccgtagtggggctgtggtcaccctcgaatgcgtggagaagctgattcggaaggacatggtggaccctgtgactggagacaaactcacagaccgcgacatcatcgtgctgcagcgggtaagagtcccacccctccccttcccccagcactccaaggccccgcccctccccttcaccccctccaaggcttcgtcccctccccttcccccaactctccaaggccccgccttcttctctgctctgtaaggccgccccccccccccgctttctcctgcaaggccccgcccttccccccctccgctctcctaggccccgcctcctccttccttttcaaggccccgccccttccctgcctccagccctccacggctccaccccctccacacgctccctcccaaggctcctcccctgccactctctaccctcttctctgcgccctgcgccctgtccatccgtacccactgcggtcgcctcgccccctccccaactcctactccttagccagcaacccgcttcaccttgacccgcttaggaatccccactaccacctggagccccactggtcacccccgggccggcctctacctcgtccttctctctacctcccccagggcggtaccggcttcgcgggctccggagtgaagctgcaagcggagaaatcacggccggtgatgcaggcctgagtgtgtgcgggagaccaaataaaccggcttgggtgcgcaacgacgtggcgccttcattcgcggcgtgggcgccccggggacagggcaggcgaggatgcagggccgtgcaaacagtgctcctacagcgcacgctggagtttgaaagagcgggctaagcat

SEQ ID NO: 92182 - DNA, 1712 bp, Homo sapiens
ccagccttgagccaatcactgggctggtccacgccttggcctcagtcagagcttacagatatgagaggggaagggaaggtggagtggattcatcaacaatagtggcccccttggtgtctttttttttcccctccattaaatggcacagccaccaccctagctaatctgaagtagtggctagaatttgaactctggtctctcaccctcttacctccaaacaaagagttttgttgttaaaggtgctattttcacatataaatgagtctaggtgagtctggaaggaggacttcctggaggaggcctggcgaccacatgccctccctctcttccacctcaccccccttctccgcctccgctttcccatcaaggggggcagatcagctctgagggctgcagaggtcttccctgtgctgcctgcctccggtaaccacagtcctgccactgtcccttcctccctaggatgacgcggcatggcaagaactgcaccgcaggggccgtctacacctaccacgagaagaagaaggacacaggtgcagggctggggtgggaagaggcgggacatggctgtgtcttggagtcaccctctcccctcgtgccccaggttttgcttcctctgtccctgtctctctcccgcccccgatatacactgatggccatgaccatgtaaacaacagctgggtgatcccatgaccccatgtggcccggcactgtgttctctgccttctgcgcatgaactcactcctcccaacagagtgtcagggagggtgctcttgttaccccatgttccagaggaagaaactgaggcccaaagagggacaggcacttgagcttggtcacagtcagaagggtggaggggagtcagccgtcagcccctccaccaagctgccactcagtgaccaggcctgtctgcctctcaccctccagggttgacaactccctgtgggttcagcccgtggccccagcacacaggcagcggctcccaactgcctgtttctctctgagtcccccacccccaccaccgcgttgtctctgtgcctctctctggggctttggagacggacatgtctcctgttgctccgcccctccatcactctgcccatctctgtccccagcggcctcgggctatgggacccagaacattcgactgagccgggatgccgtgaaggacttcgactgctgttgtctctccctgcagccttgccacgatcctgttgtcacgtgagctgggaacagggatgggtaggtctgggtggggagagcaagggaaccgccaggaggaggctgtgtgcgtgggtctggccacctgcacagccagggaaccctggatgagcagtttatcctcagagcctctgtattctcacatgggacatgggcatgatcctagcatctgtttcatagtgtggaacatatggaaaggaacatacttctaatggggtgtagggctctcagagcattgccgaggccatcggagcagctcacctttggacacttcccatgacctacctctgatggtagggcaaaggcttaacaggtgctgagtccaggcactaaatacgtgctcaattagtggtatattttgtagaagacagtaattaatgatcagggcccccaaggccaccttcaggtttcttttttttttttgagacagagtcttcactttgttgcccaggctggagtgcaatggggacatcttggctcactgatatcccagg

SEQ ID NO: 92183 - DNA, 1042 bp, Homo sapiens
actgtgccactgcactccagcctggctgacagagcgagactccatgtcaaaaaaaaaaaaaagtaaaatgagtttatataggtaaacagtatctggcacagaatacaggctgtgtaagtggctgctattattgccattcgtggaccacagaggccagtcagagaggcactgcctcattacccagggactaaggcccttgtcagctgtaacaaacctggttctaggtgtctggaaaatatgaggggccacccctctctgctgctgctatatatggcattaaccacctgcctggatacttcacccagtgaggagacagaccaaggtgagtgtttgggggaagtggcatccagacacttggcgttggcctccccctgactcaggaatgtttctagtccttcctcttccaggagtccaggacccagccccttcctccttcagacccaggaatctggattcccagcccctgctccttcctccaggaccccactgctttccatccccctatgactccagccctagggaccctccatttttctgtccctcatgtctttgggtccagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggtgagggcctcgagaccctggagtttcgggccctctctcttctctatacctgtggggaggttgcaggggtaggttctggccttcagctccctcctccttggtgtctcagaaatcaggatgggctagtttgggggtgtgaacctcccagctgaattcctgctttttccccttcttttccactccttccccctcaaggagcgcttttgggagagctacatctacaatggcaaaggaggtgagtgaggggctgaagccatcttgttctgtgcagctaaggtagtcccttcccagcgaggccaaaccaacg

SEQ ID NO: 92184 - DNA, 1063 bp, Homo sapiens
ttctgaaccctcccacttagctcaatcctttctgacacgttctctggtctttcttagacttcattgtcccatcctttcctcttccttgctggaaatatccaaatttggtctccctcccagccttactgaggactctgttcttttgctcctggctctttcgcttctagatttttctacacttttgtctaccatttcctacctgggccccctgtccttatgactggattgccccttgtcttgctttactgtctcacctttcccccttccctcccctcattcatgtctcattagcttggttctatccatcttgtttttgaatttgcccttttctctcccatcccctccttttcctgatccaacttgcttttggcctcttccctttctctcttgactgtatcctacccacccccacctggctgactataacccctgtccccggccaggcctctctggactcttcgacactggcctccaccacgcgggctcagcagggcccgacgcctccgtcatgaaccttatctcggccctggaatcccggggcccccagcctggcccctccgcctcctctctcctctcccagttccgcagtccttcctggcaaacaggtaagcccagcgccggccctgcagggccagggtgggactggctcgctgttctctctgacgcgcggtcttcctcatctccagccatgcacacgccaggccccacggagctcttcatctcgggtgccctgccgggttccagcacctttccgtcctcatctgccctgtcggcttaccaacacccggcttccttcggcagccgccccttcccagtgccctcgtccctcagcctccaggaccccccattcagccctccagctaacgggctcctgtcccctcatgacgtgctgcacctgaagccctcgcaggcacccacggtgccctcttcactgggcttcgagcgcctggcagggggcggtgtcttggggccagctggtctcggtccagcccagacccccccttaccgccctggccccccagacccaccaccacctcctcgccacctcccaactcagttcaac

SEQ ID NO: 92185 - DNA, 1031 bp, Homo sapiens
ctcttgcaggcgcccagccctcctcggacctcaggggcggacggcttggtgggcgaggacggggcagcagatgcctctaagggacttggggggagtggcggggccgggggaccaccgggtacaccctacgagttggccaaggaagacccccagaggtaccacctgcagagtgtcatccgcaccagtgccagcctggatgagggtgccactgcggcactggagctgggcctggggaggctgaaggagaagaagaaagggccagagcggggtggcgagacccccgaggggctggccacctctgttgtccactacggggcaggcgccaaggagctgggggccttcttgcaaaagagccctccgcccccacctcccacggcccagtctacccagcccactccccatggcctccttctggaggccgggggccctgacctcccactggtgctgcctccgcctcccccccagctgctcccctcggtcctcagccatgcccccagtccctctcccagcgcctccaaagtcggcgtccacctccttgagccagccacccgcgatggggcaccccagccacctccaccgccacccccgcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatcc

SEQ ID NO: 92186 - DNA, 1676 bp, Homo sapiens
ttcgagaccagcctggtcagcgtagtgagaccctggtctctattaaaaacacaaaaatttagccaggtgtggctgcgtgtacctacagtcccagctactcaagaggttgaggtgggaggatctcttgagcccaggagttcaaggctgcagggagctatgattgcatcactgtggcctgggccacagagtgagaccctgtctcaagagataaaggaaattctgggtttagggagagaggcaggaggttggagcttacgctggtttgaaactcctgacctcaagtgatttgcctgcctcagtctcccaaggtgctgggattacaggcacgagccacctcacccggtctgcttgcttttagtttctatatcccaaaggatgggcattcagggatcctacattcctgggtctcatgggaagcgggtctagggacctgaactgggctgtaagtgaagaggctcagtgagtccaagttcctggtcttctgagggaggaactccagtcttgtcctcctagaatctaagacaaggggtctgcaggtttgaattctataaattcacaggctgagcacctgtaaatttggatttttgggggctgagggaggatgggactgggggcccaggctactgggccctcacggcccgccactcccatgtctagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccggtgagctctgggcaggtggtctgggagtagagcttaaaggttattatgatcactaggtaacagttgtgcaggttacgcactgtttaagagacaccattcacatacatggtgtaagcttgcgtgtttatgaagggactttcctgattacacaagcattttgaggaaggtctatctttttctaattcactcagaggtgctaagtggactaggaggggccccaaggcagacactggagaatgcagggagacagggcaggtgataagttacagggacaggacaggggctactcaggttctgaatggtgggaggtgtgggaactgaggagggctctgagtcaactgtgtgtgaaggt

SEQ ID NO: 92187 - DNA, 1606 bp, Homo sapiens
ggctcactgcaacctctgccttccgctcaccgcaacctctgccttccaggttcaagtgattctcctgcctcagcctcccgagtagctgggactacaggcgcgcaccaccatgcccagctaatttttgtatttttagtagagacggggtttcaccatgttggccagactggtctcgaactcctgacctcaagtgatccacccacctcagcctcccaaagtgctgggattacaggcatgagccaccatgcctgccctctgtgaggttcttaaaaagcctgaagaagggagctggcagacaggggagaggttagcagtctgcatactggtgagcaggccaaggaaaggacaaagatggtcctggagggaggaggatgaggccttggaggaagaggaggtgaggaagtagagttagggaggtgatgatttaggagttgggagggtcattcaggaagaggagttaagaaccagacaagggctttaagaccacaaagagacattccaggactgagaaggggattagggataggagacaggtctcctttgcagccgcaggagccagagtaggtctctggagagactctgatagggtagaagggacactgggagctgagtggtagttacagaggggcttttggtatagaaagcagtgtttaaaggacaagaggaaaggtgccaggaatgatgaataacatccaggcctgatgtccctgtctcccccagagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaaggtgagtcccagccttctccagaaactgggcctgatgggtttggtcacctgtttgttgagtgcccgctggatgacaggcttgtgctgagacctgcagatccagtcgtggccgggccgccctggaatttgcagtcctatggggctgatagaggtgtcgaggacctgcgggcctcagaggtgttatttgcgtttgtgtctgtacatgcattacctgtatataaggtaaagcgattgttaacgcgtatgtgtctatatgtgcgttacctgtatataaggtgaaccgcttgttaatgtttatgcagataccctgctgtgggtggtagaggaccagtactgtacaagcagatgaggctctggccctagggagcttctagtttaatggaaccagccagagaggcgggctgctttgccatttatggcacaatggtggaaatgtgtcattgacatagactacctgca

SEQ ID NO: 92188 - DNA, 1681 bp, Homo sapiens
tggtctccctgggacactgacatctgacaccccaggccccatgccccagccccttccctccccagaggccggtgtgccaccctccccagtgccatgtttgacccctgcagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacactttaccggcaggctggagtgcctctgtcctgcggcgctggagtgggtggcagtggtagcaggggcagaggttctggaacgggactttcccagagccctgggcagtggggggcctgaggctggcatatgttctgtgtccccgcacagcagagtatcccaccctgaaatttaatgacttcagacaacaaatatttatcactggggggtttcttttgttttttagctaaagacagggtctcgctctgtcacctaggctggagtgcagtggcatgatcatagctcactgcagcctccaactccctggctcaagcgatcctcctgcctcagcctcccaaagtgacgggattacaggcaagtgccactgtgcctggccctgtgttctttatgttacccaggctggccttgaacttctgggcttaaaagatcctcctgccccagtctcaagtagttggcattacgggtgcatgccactacacccagttcaaatcctgtagtgttttgttttggtttttttttttgagacagagtctcgctctgtcacccagcctggagtgcagtggttcgatcttggctcatgcaacctcagcctccccggtt

SEQ ID NO: 92189 - DNA, 1117 bp, Homo sapiens
ggtgccagatgccccgcacagttgcgcccctcctttccctgctcccatcacttcccccacaacgatttccacacagaactcatccatctggcaaaggctctggggatttccaggctttggggttccgcctgcctctgccgggaacaccctgacttccctgcctgcccactcctggttatctaaggcatagcagggcaagtgcccacgaagcctgcccccatcccttacttagaagacaccaagcccctgcggcatctccctccataatctctcaggagctcttcctctttgagttctcacagtgggtcacctctcctagagtatccagcctgcctgtctgtctctctggctgcggtcaccctgagtgcagggacctgactcccccgtgtcccccctacccccaggtcccccgatcagaagcctctgccttcggcgcctcccaccacgtggcctactttgaggcctcggccaaactgcgtctcaacgtggacgaggcttttgagcagctggtgcgggctgtccggtgagccaagtccccttcctgtcgtccttgtccccagcccttccactccaaactcactggcgttttcccacaggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcaggaggtgctttctaaaaaggtaatgagggtcgggcactgtggctcactcctgtaatcgcagcattttgggaggccaatgcgggaggaccgcttgagtccaggagtttttgaccagcctgggcagcatagcgagacccccatctcttaaaaaa

SEQ ID NO: 92190 - DNA, 1108 bp, Homo sapiens
tgagatgttaaaagcggaggccagggaggcctccctttgacataagaggcacctgagacccagaaaaaaggaagagaattgctcctagtccctggggtgtctgtgctgggtccagcgcccacccaagcacagggtggagtgggaggaggtggaggagaggaggggtgccagaggggatgctgagggagatagtgtggggcccttgaggtcttcatgtctatcctctacttccatcctttctcccgggacctccactccaaactctcccccctggacccccaggtgaccatggaggaagaagatgagtctcgagggaagacagaggagtcgggggaggatcggggcgatggtccgccagacagagaccccacgctttctccttctgcctttatcctggtgaggctgctgggctcctggcactgagggatggaggagctgggcatccacactccaggggcctgactccagggcctgaggcaggggcgctggactcttggctcccttgaagcacttgagtctagctgtcagtgtctgggatgtctgtctcccaaggggcagaggttgcaaagcatctgcctgggtcctctgacgcttggttcttccccccttccccagcgagccatccagcaggctgtgggaagctccctgcagggggacctgcccaatgataaaggtatggcggcttccggttccttttagcccctgccccctctctgcattctttatcctaatgtcattcatacaagcttttctgaagcctcctgggtgccacccttgtgctggcatggggagccaaaaatgggcagacaccctgtagctgccttggaagggcctagtgtgcagtggaagggagacaggcacagtgctgggagagggcaggaggcccacttgagctagcatggtgggagacgggtcagggcaccttccccgagcagggacagtgaacggctctctaaggacctagaagagtctaaggacctaggattagagggaagcctgatcagctgcagcaggcctacagcacgggtgcagcggcgaggggctgcgctgggcttccttggggctggcatgcaggagggtgtgagtggggttgggggaggcaggagag

SEQ ID NO: 92191 - DNA, 1102 bp, Homo sapiens
aggtgtccaggtgaggttcaccagctcctgtcctgtcacctctcccatcttcatgttgtcacctctctgcctcctgcagtgactgcacttctcttcaagatggaagaagccaacctggcgagccgagcgaaggcccaggagctgatccaggccaccaaccaggtgggctcccctgggggagagtccctgccgccccttcttttgtccattgcctcgggttaggagaggaaccgcgggcctggcagctctggggcaaggtatcggcctgaagaggagcctgttgcctcagctgtggggaagtcagcgtgggaacagtggggtgcacgtcccctcttcccctccacctccctttactcatcacccctctgtcctcgtcccacagatcctcagccacagaaagccaccctcaagtctggggatgaccccagctcctgtgcccacctctttgggtctgccccctggcccctccagctacctgcttcctggcagcctccctctggggggctgcggttcgaccccccccacccccaccgggctggctgccacgtctgacaagagagagggcagcagcagctctgagggccgtggggacacagataaggtgagctggcctggggagaggtggggcggtgctgacagttctgtagagaatatggacaggaactgagacgcgggggcccaaggagaaagggagactgaggcagggagacagggccgtagagaccaaagtcatggaaccataaggaactccactttgctggaatgggtgagcaggaaatgcgttaggcgtgtccaaaggaaaatcgcgtctgtgcgtgtgtggggctgtgtgcgtacacaccacatatacacaccctggaagagatgccccgcgctgcagcccaccccttgattatctgttgctcgcgctgtctccgtctctgtgagtgggggagggtggtttccgaatgaaaactcaagaacctgtttgtagatgaagcaggggagaatgggtgccaggcagacagtaatgtaggttcttactcagctgctctggccggctcctactcctgggctctggagctgtttctctcttggtcaggtctagatgtgggtttttgtt

SEQ ID NO: 92192 - DNA, 1335 bp, Homo sapiens
aatcctttttccctgttactctctcctagaattttgtagccaccttggctaatgggatgagcctccagccgcctcttgaagaagtaaatatccttttgtgagacccctccccaccctgacctccacatcaatatatcttgccacacatctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctccccagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcctgtggccaggcggaaagcagtgagaagcccaacgctgaggacatgacatccaaagattactactttgactcctacgcacactttggcatccacgaggtcagtggggacagtccccaaggccccaatcttaggggggcttaaatgttggggaaggggtggaacctgttttcccacgcatgcgcactgcttcccctggccgcaggccgcccccctgcccctctgctgcgcacttcctagggtcgcctcgccaagccgttgccttggagaccgaggttagcctgaatctctgcaggggcctcgcgccgaaggctggggtgggagagcgcatgcgtgcctggggccttagccagaggtcgggcagggcccactggtctctgccgccctctagtgaccggcggtgggactgcgccccggctgctcccgccctaacagcttctgcacacttcagatctgactgaagacactgaaatcccagaacgaagctggggtggcattctaaggaattttcttttccccctgaggcctttttcataaaattgtggcaaaatatgcataaaattgccattttttatttttagagacggtctcgctctgtcgcccaggctagagtgcattggtgcaatcatggctcactgcagcctcgacctccccggctcaggtgatccccccacttccactttcggag

SEQ ID NO: 92193 - DNA, 1331 bp, Homo sapiens
ctgggcgcagtggttcacgcctgtaatcccagcactttagggggctgaggtgggtggatcacctgaggtcaggagttgaagaccaacctgggcaatatggtgaaaccccatctgtatgaaaaatacaaaaattagccgggcatggtggtgtgcacctataatctcagctacttgggaggctgaggcaggagaatcacttgaacccaggaggcggaggttgcagtgagctgagattgcaccattgcactccagcctgggcaacagagtgagattccatctcaaaaaataaaataaaataaaaataaataaatgaataaatataaaagggaaactgaggtgcatggaagaaagcgagagggccgagctctggccctccgagctctcaggacacgctgttctccagctggggatatggggcccctcacggcgtctctgtgccattcttgccctaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcggggtgagtctccagggtggccaggcggggccgggcctgagggatggaggggagcccatcagggctcagggattggatggaggtgatgggggcaggggatgggtctcaccctcccttcttcctgggccctcagatcgagtgttccagtatctctgattatgcggtgaagatcgtcaaagccaacaagttagaccacggtgagcccagaaagaggatgggtttgtgggagtggagggggtgatgccctgcttccccagggccctctgaagagcagtggggtctacagatgaccacagattcagcagctcccaacccatggtcttttgggctgccggccgcctgagaatctgagtgtcaaaatcacaggcttagcaccgcagtcttaaaattagggcaagaagcactctctagtttcttgaatgagtaatagagtcacgtggttggccacggaaggcccacagtgagaagccttccctgtttcccagctgccctcctctgagtttaaccaacactaacttccagagaagtctggacctacaaacacatacatacgtaaatgcatttacattctcgtgcataattttcacgccagtagcatttcataccagcctcttgcccttggcttcttacacctgcttgtcatgtcgtttaacactttccaggatgttgcggcatccgctcttttgcatgaccaccatcataggtacatccccagcattttttttt

SEQ ID NO: 92194 - DNA, 1920 bp, Homo sapiens
gaccatcctggccaacacggtgacaccctgtctctactaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcagttctctgaactgaagtggggtccccaggctctagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggtgaggccccagcgggacgggtgcagctcgcgtgggctggggtccaggtagaagacgaaaaccacgctcaatttttcccacagacgggacttactgtgggggcttagctgcaaggtgttagaaagccacagcccaagccaggtgtgacagaccctggagggagatggtgcgatgtgggggaggtcgtaggaacaggaaatccgtagcggcgcaatagcccaggtccttaggccccagcaggcctccccgggagaggtgaggtgacggagaggtggatgaagcatacggaggggcagccagggcaggtgtgcccttgctgcgtgtggaacagcagggaggcccgtgtggaaggagggtctagaacggcagcaggaggaggagtggaggtgaggggtgacagggcgtgtgcagattttgtggaggcttatgggaccccgtgcttttcctctcagagcagctagggagggtctgaggatccccagaacctccaagggccgggagctgactggggtgcccctgggtgccctctggcggccgtgtgggaaatagaccagggggcgaggggtgagtgccgctgcgacatgagggtggcccagaccagggcaggaggccacatcttggaggcaagactcagggtagtgttgccaggccccacccttcatgcctcgccctgcccctctgtaggcgcccgatggcctcatcttcccagaccgggccacgctgtatgtgacggccatcgaggaccggcagtacaaagactacaagatccactgtgagcgcggcccgggagctggcgggcggggcctcgggtgggctgctgcgggctcaccccctccctgcctgcctccccagggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcc

SEQ ID NO: 92195 - DNA, 1175 bp, Homo sapiens
cctccccgttctgcctgcaagtgaagcggaatgactacgtgcacgccctggtggcctacttcaacatcgagttcacacgctgccacaagaggaccggcttctccaccagtgaggcggggcccacagggctgggggccgttcccgagccagggcggaggcgcacccacgtagtggagggggtgacagaaacgggcagaaggaaccatggggacacgcgtgttccagtgtgagctctgccatgtagcagtcacgtggccttgggcaagtgacctgagtgtgcagtgcctcagtttcctcatccacaaaaggctgacacggtccctgtctccaaagctcaatgacagggaggtgactcgcggatagcagtcccatcagctgtcatgggggtgggcattccgacagagggaacgcaagggtggggttggggggggcagcaggccgaggccggctgacccgcccgcgcccccaggccccgagtccccgtacacgcactggaagcagacggtgttctacatggaggactacctgaccgtgaagacgggcgaggagatcttcggcaccatcggcatgcggcccaacgccaagaacaacgtgaggctccgggcagctgggtgggagggtggcagctagggcggggagtgtagattggggggggagtggtgggggaggaatggtggcagcgggggtaggggatgggggcagccggggtgggggatgggggcagctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccgggggagctgggggggcttctcggagacagggtctgggcagagatccagtgtg

SEQ ID NO: 92196 - DNA, 1051 bp, Homo sapiens
ccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactggaacgtttgcctgaggaggaagtgggcttgggagaggttttcttttttatgaaagaagcaatcactgcattgctgatgggaatcatcctgatggagaaatccaagggcaagggacagcagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatccctctcctgggtctgcgcccctcccctctgcggtacc

SEQ ID NO: 92197 - DNA, 1021 bp, Homo sapiens
cggtctatatacaaaatttaaaaattagccaggcatggtgatatgcacctgtggccccagttaatcgggagcctgaagtggaaggatcacctgagccccggaggttgaggctgcagtgagctgagatctcaccactgcactccagcctggcgacagagcgagaccttgtctccaaatactaagtaaataaaagtcctagggtgctgatgattactagggtactttgaacaactgacgacacctaagaagtatataataaatggtcactatttttatgtgtctggccttcctgcccccatgcttctgccaacgccacccctagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggtaagggtcaggggtcaggggtcaggggctctcagaggccgccagtgtcctgagactgtggaagggcagggtggggccaggtggcggctgggcaggatggactcaggcacatcccgggccctccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcggtgagtgagtcttgggatggggcccccagatgtggcacccgagaatccagtatcagacctaggacccctgacagtagacagccagaccctggagcccacacctgcagagtctgtagaccaggggctgcatagagctgaggaccccagacccagtgctttgggacctggagacctctgacctggggaacccctca

SEQ ID NO: 92198 - DNA, 1976 bp, Homo sapiens
atcgccttgcaactggcccacttccgggtcagttgggttccccatccacagcccccgcagggtctcagtccacctgagcccccaagacctgcccctccacggttccttgtggtcgctgccattgtgggtcggccatcttgaattctctcttccaaccattcttgggctggctggaggaggctggaggtctggacagagataggtcaagtctgtaagatctcctgagcccagctgacagactcctcttctcctccctgtcccccaggacaggggtcaattctgcctgacttatgagtcggccatgactcgcttattcctggaaggccggacggagacggtgcggtcttgcacgagggaggcctgcaactttgtcagggccatggaggacaaagagaagacggtgggtgcagccctcgcttgaggcttcagttatttctgtgtactcactcatccacttgcaaacgttgatgggacctactgaagccagcctccacgaggagcacaagggacaagggatgaatcggacctggcctctgacttcaaagagctcactgatggggggagacagcccagcatagtgtgatatctgctttcatggtggtctcacagggcactgggggtgcacccaagaaggaaccccatttctttttttttgagatggagtcttgctctgttgcccaggctggagtgcagtggcacaatctcggcttactgcaacctctgcctctcaggttcaagcgattctcatgcctcagcctcctgagtagctggaattataggcacccgccaccatgcccagctaattttttttttttttttttgtatttttagtagagacggggtttcaccatgttggccaggctggtctcgaactcctgacctcaggtgatctccctgcctcggcctcccaaagtgctgggattacaggcgtgagccaatgcacctggctggaactccatttttacaacgtaactctgcccatttaacctctttgtgacttgtgaccttcctttgcacccctgtaccctctctgcccagatcccacctgccctgcacctcttctcccttgccctacacctagccctgcacctacaaggtattgtggttccatggaaggagtttggactctggggccagacacacctaggaacccgcctggctctccctggctgtgtgaacctggccaaatgatttcccctctctaagcctcagttccccatctgtaaaatggggttgatattcccaccttgcagggatgtggcaaactcagttgaggccagatgtgccgcaggcccagccctaagtcgacttcctgtctttccatgacctgtgacctccctggggactgcaggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggttggggcacagggaaagggttagagagggaagtgggagaccatggaagaagggagaggtttcagggaaggagggtgatgttgaaaaaggacccatcaaggccgggcacggtggctcacgcctgtaatcccagcagtttgggaagccgaggcaggcggatcacttgaggtcaagagttcgagaccagcctggccaacttggcgaaaccctgtctctactaaaaatacaaaaattagctgggtatggtgacaggcacctgtaatcccagctacttgggagggctgaggcaatagaatcccttgaacccgggaggcggaggctgtagtgagctgagatcgcaccactgcactccagcctggacgacagagcaagactctgtctcaaaaaaaaaaaaaaaaggagggtgatgttgagaaaggatgcgtcagcagagaagtcagttgtgggggggcggcaaggcagaaggcggaga

SEQ ID NO: 92199 - DNA, 1702 bp, Homo sapiens
cgcctcctaggaccgttccccgccttccttcacgtccctcccttcctccttggagagccgctagatccaatcagtgtttgacctggccgcgcggagggggcgggcccatgatacgcaatcgaaccccgcccgtctctcgggcaacgcctcctcccccccctccccagctcccaaacggaaatagcggaacactgggccaatcgtagcgtcgtgcctttgcttggcggccaatgagagaggaagtgggggagaaacccgcctgtgagcggcaggagctcaagccagtgggcggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtgagcgcgcggccgggggacactggagacgcgggggaggggggagcgtgaaattgaggggtttggggatcacagagggacccgggggatcaaaagcctctgcggccgtatagggacagcatagatgggccccaggaagaactttagagtggggggcacgtaggggcttggggtgtcatagagtgcctcttgaggtgacgacacggagtagctagaggggtccgggagggcttgaaaggggaggaagccagtgaggtcccggggatgggagcatagaggtgtcccctgggaaagactgaaaagctgggggatcttacaaacgatggggttagagggattcccaatgtagagaagaagtgaaagaagtgtatggcgggggtgccctgtggagcgatggaatgggaagaggccagaggggacctggaggaagtggaatgccggaagcctaatgaagcagggcttgaggacctgggatagggggtgtcatacaggggaaaggggttagataggtcaccgaggctcctggccagtggtatagaggaggcctgagagtggttgaaagtccatgagtttggggcagggagatgatgggacggggagactataaggacaccctggtgaaggatagaggggcttcagggtgggagattgcctagaagacatggaaggcagtgtggagggggctagaggggcagctgaggggaaaggagggacccaaggaacacagaggaaaagagctgtcggtgtaaggtcttgggagaacctgtgacagggaacggggggccaggaaagaagaggacattagagtaggggattggggaaagggtagaagaaggagcgcccagacctcaaggaaggcgttgggttctgaagtgcttgaggggtagatatctggaaagctgggaataggggaagtctaatcccagagagaggtcaggggtcaggcagcaggacaggcagggatctgagcccttttctatttgaccacagtaatatggggacggtggtccctgccaggaagagttgtcgtgacgatgggaatcctggcggcaagtcagctctcaactcctgggaatggctgtgggtgattggagctgccaggagtcttcagaggctgcatccgcatgggctctgg

SEQ ID NO: 92200 - DNA, 1056 bp, Homo sapiens
gacaaagggggtgaggacagcacccaagggtctgacctggtgactgggtggacagtgggaccttcatgggattgagaactggaagaggcagtgagctcagtggtaggggtgagcaccctgcggccagccaagctctttattcattcattcattcatcacatgttcatcgcatgtggggagtggggacaggagctctcagggagcgtgtctggggccctgaggagccccacaaatcaggggccacagtggtaggaggaaggagagaggaagtcagggacagcccaagggtgtgtgctctgtgctgtggggctcagccagcggtggttcttccctctttgaaactcccagccagagaaggggtcctggcctgtcctgagccccagggcttgggggcggagaagatctgcccttcctgctgggtggggccgcgcctaggaaagagagggcaggtggctgactccccagacccctcactgcctaccctcctcctcctctcccaggtaagagcaaagaggcggaaattaagagaatcaacaaggaactggccaacatccgctccaagttcaaaggtaggctgggggcccaacttctggttctgagggaggagggggctgggagctggggctcctgtgacctatcctgtgacccttccttatttctggctcccctttcctccttcctctgccctaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaatagtgagtctggagaggggggtgccagggcctggactcctgggtctgcgggggagggggctggaggtctggactcctggatctgggggaggagggggtctaggggtctggactcctgggtatgagggaggagggggtctggggctctggactgctgggtctgagggaggagggggctgggggtctggactccccattctgagggaggagggctggaagcccagac

SEQ ID NO: 92201 - DNA, 1028 bp, Homo sapiens
aagctagagggagtgcagtggcacagtcatggtgcactgccgcctcgacctcccagtctcgagcaatcctcccacctcaccctcccgagtagctgggattacaagcctgcgccaccacacccagctaatttttgtatttttgaagagactgggtctcactgtcgcccaggctggtcttgaattcatggcctcaagtgatcctcccacctcgacctcccaaagtgctgggattataggcgtgagccaccatgcccagccctgacagtatttgatgtatgtgttttcgtggtgctgtctgaaatgtaagccctgtgaggacaagtgtttggaccactttattcaccactctatccatggagtgaacagcagtgcctggtaccccatgggcacccagtaggtgcttggtgaatgaatgaaggtgcagagccaggcttgacatgttcctgagccctgtgaggttactgagatgcaatcattttgcagatgaagacactgagtcctggtgggccgtgaggtcagcgccagactggatcctgcggccgcctggctgtctgtccctctcgctggcctcgcacacccttcctgggaggaacaggagaggaggggaggtgtgcagggctggggtcactgactctgcttcccctgccctgcatggtgtccccacagggacagcatggacagtgtcaagcagagtgcggccctgtgcctccttcgactgtacaaggcctcgcctgacctggtgcccatgggcgagtggacggcgcgtgtggtacacctgctcaatgaccagcacatggtgagcccccagccctcacacccccggatacccagggctcccacctcagccctgacccccctggatgcccggggctcccacctcagccctcacacccccggatacccagggctcccacctcagcccacgcaccccctggatgcccggggctcccacctcagccctcacgcccccggatacccagggctcccacctcagccctcacgccccctggatgcccagggctcccacc

SEQ ID NO: 92202 - DNA, 1050 bp, Homo sapiens
acctgcccaagtgtccagaaaccctcccatccccatctctgacactcccctggctggccagggatcctgtccagtgacccccacacccctcaccaaccacccagtcccttagaaaatcccactctgtttctaatacctggagattcccccaacagcgcccatcacctgcgcaccagcgcagaaaccttgactgtcccacccccacagtcccaaccctctagagtctcgccccttcactgctccttacccagctgcctggggtcctgccagggacaccccacacacccaggtcagtgctggccatggcgcccgaggccccgtggcctcctcaccccacccctaaagcacgcacagtgacacatgtgcacacccctaaaccccatcttcccgactgcacacacatcccgaccctgtcccgctcctgagcctctgctctcaggtaccacctcccccaggggcctgacttgtctctcctctgcccctgcagggtgtggtcacggccgccgtcagcctcatcacctgtctctgcaagaagaacccagatgacttcaagacgtgcgtctctctggctgtgtcgcgcctgagccgggtgggtgtggcctagatattggctgctggaggtggccctggcatccctatgccctctgacacccctcaggcccccactctccctgagaggcagcccagcccaaggtttacaaactcaggctctgagctggattcatcctggctcggcctcttcctggctgggtggccctggacaagtggcttcacctccctggcctcagctgccccctgtgttcagtggggataataccggtgcccacctggaggcacagagcgctgtggatagagtgctcagaacagggcctcgcgggccgagcaccccgggagccagccgccctcatgacctcctccctctcccacttctctctctgtctcccactttccctcttctggctttgcctcccgcctctctctttcctgtgcagcctctcactcctgcctggcgtccctctcccacctttgctcctgtcctgcccaggaaca

SEQ ID NO: 92203 - DNA, 1869 bp, Homo sapiens
gtgggtggcttgtgcatttttgtcaggggctgctcagcactcacaccagtccttgggaaggcctgggtttgggggcacctctggggaaggttcctggagcttcctttgctctgtgagaaacctaaggagcctcagagctgcagatgaggaaactgaggctcacatggtgccacctcttgcccgagagggtcagagcaggaggagagcccaggtctggggatagatcttgtgtctccagaggtgccttgtctcaccatctctgctgggctgggaagaggttgagggagcagagaccctggccctgagctgcagaattctcgagtgtcagaggcaccccgagctcctcctttggaagacaggagctggggcatggccaccaccccagcaggtgtgccaggtgggcaggacactcagccgggggcgtccccttcgtttccccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacaggtgcccgcctgggcctatcagggcctgatgcctggggccaggaaagaggggcatggaggcccggactcctgagtcctaggcagagggcagggaatcttgacttttaggtagggtaggaggaggatggggctgtgaagtgtcacctgtgaggttggtgctggggcccttcctgggggcagaattgctaggtatctttctctgggctcaaaggcccagttgtctgggtcactggaggtgcagtactgcgatgcaaggccggcaaggttaagacctggatccttgggggctgtgagatgggtcagctggggcccgagtcctccaccttctcctgtcagtttctctcaccatccctctcttgtggcccctgctggcagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaaggtgtgagcccttggagcccaccccgggcctgccacccccctcagaaagaccagaggctcagaggcccttgggtggccaaccctgtgccaacagggagtctaaaacacacctgggctctgctctccgccctcagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtgagtgctgtggggtgcgggctggactcttgggtctgaggcaggaggtggctgggggcctggattcctaagtctaagggaggaggggctggggcctggactcctgggtctccagatgggggcagtggtgagcccagatccaggtgagtgaaagcccgacatggcctgcggcacactctctctcacacgccccggcggcaggtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggtcagcatccctgaccctgaccctatgaccccacgacaggacctagaggcagagcaaggatggccggggccgtggcgcc

SEQ ID NO: 92204 - DNA, 1103 bp, Homo sapiens
tggtgcgatctcggctcactgcaacctcggcctcccagcgtcaagccattctcctgcctcagcctccccagtagctggtactacaggcacgcgccaccacacccagctaatttgtttgtatttttagtagagacggggtttcaccatgttacccaggctggtttgaaactcctgagctcaggcaatctgcccgcctcggcctcccaaagtaccaggattacaggcatgagccactgcttccggcccacagccctgttttacttcctgtgtgagcttgggcccgtcactcaacctttctgtgactcagtttcccacctataaccccacctgcagcagagctttcagtgttccaccagtcagtaggtggctgcacccaccgatcccggagagggcgctcattgttgtcctctccacgcccttccccaccccactcaggcgctccaggcccctgcctgtcacgagaacatggtgaaggttggcggctacatccttggggagtttgggaacctgattgctggggacccccgctccaggtgagggagcctcagcctgcaggggagaacacacatgcttctgaggggtccagggcttgggggatccccaggggtctcagggcaggcagtgatgggctcccatcctctcggcctccaccccaatccacctagcagggtaagaaaggagcttagtcccaggatcgtggacagagtgtgactgcggcccctgtctggtgcctggggagggccactcccctccagcagcttggggtcctgggacgggtccatcctagggaggggcacctctcgagggggtttctgggagagggcagtggaacctggccccgctgacacccactcctgcacacagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggtcagag

SEQ ID NO: 92205 - DNA, 1090 bp, Homo sapiens
atgcgggggcacgggccagggttctattcccattggaggccactgctggatggatgcgaggttcctcgaggctctgtgaggggtctggatatgtggttctggggttctgtccttagggcttgttctcgcactcaatcgctctgggcctttgcccctccccaccaagttccttcccatctcactctgctccatgcctccagcccaggtcctgaggacatcggccctcccattccggaagccgatgagttgctgaataagtgagtcctgggagtggtgggggaggggaacgggacaggtgcggagcccaggccaggtgcagacaggcacccccgtcatcttgcgccccctgccccctcaggtttgtgtgtaagaacaacggggtcctgttcgagaaccagctgctgcagatcggagtcaagtcagagttccgacagaacctgggtgtgtcccgggggactgtgggaatgggtcggagggagaccttggggaaggggtcagagggactcagatggagctctgcctcccccacctactgcaggccgcatgtatctcttctatggcaacaagacctcggtgcagttccagaatttctcacccactgtggttcacccgggagacctccagactcatatcctctcaggcccggcccagcctcctgcctctccacgtcggccttcctcaccgtggggaagccggctgacccaggtccacacttctcttcagcctctcttgggcacgcaattagttctctgagattgagtgtctgcatctgttaagatgggggtgggattccttcccccaggacaggggatgacagtgaagtggtgtgtgggaggctttacttccagaactccacctgctccaggcctcattttgtccctgtctggcaccttccgtgtcctgccatcgtcctccactgggctccatgtcatgatgccagcaccgcctgcactcaggagccaggcctgcgggtccagacgctgatcaggcctgatctgggctgagtcactttgcctctctgggctctcctgtccccgctgtgaagtgtatgtagaccctcctcttcctcatagggttattgtgaagatca

SEQ ID NO: 92206 - DNA, 1050 bp, Homo sapiens
ggtgaggggcggggcctaatggagcctccctttcacctcatcaggtacggtggcgccccccaggccctcaccctgaagctcccagtgaccatcaacaagttcttccagcccaccgagatggcggcccaggatttcttccagcgctggaagcagctgagcctgtgaggggtggggagggggcggagccaaagccgcgcctctgggtgggcgggtcgggccgtccaggtccctgacttgaaccttcccggtccccagccctcaacaggaggcgcagaaaatcttcaaagccaaccaccccatggacgcagaagttactaaggccaaggtgagagaccgcgggcgtgtttgccggcctatggctgctttgcttctctgagcctctgttttcccatctgtaaagtggggccaattcccatccccaagggttttttgggatctgggatgccactgtgtggtaactaacagctctggcacactctgacggcgccccccctcctcccagcttctggggtttggctctgctctcctggacaatgtggaccccaaccctgagaacttcgtgggggcggggatcatccagactaaagccctgcaggtgggctgtctgcttcggctggagcccaatgcccaggcccaggtgagtgctgctgtgggaggcctgaggccggcaggaaggccgcctgtcatctctgcgtccacccttcctgcctcactgttctttaattcacgtccccactttgaccctcctcctctcacatttctttgtccacttttactcctctttatctatcagtttaatctcctgtctccaacctctggtgttcctctcctcttcctgtccctccctgatttctacctttccatatcctttccacctttctctcatcttttataattttcttcctctctggcgcctctgttgatttcagtcttacatttttctctcctgtgtcttgtatcacctttctggcccctttatccttccttccttctatctcccttgggtcccgacttccctgggctccccatctcctctgagttctgccccca

SEQ ID NO: 92207 - DNA, 2189 bp, Homo sapiens
gctacttgggaagctgaggcacgagaatcgcttgaacctgggaggcagaggttgcagtgagccgagatcaagccactgcactccagcctgggcaacagagcgagactccgtctcaaaacaaaacaaacaaacaaacaaaagattcctgggttctgaggaaggaagtgttggtggtctgcactcctaggtctgagggaaaaggatgctgagatctcagattcctggtctggggagaaaagaggactggtgagtctcaccatggctccaaacaccatttggagtagtctctccagcctcagctcagagatgcccacctcagatgacagaacaatgagggtgatgctgtggaatggaagtgagaagaatgagtcaaggcctggggaatcaggaaggggtatgttggagtccgcccattgatcctagaacaccagatacatcctctctcagaccaacctgcctttcttatagagaacatcagggatcaaagagggtaactggcttgctaaagatcccatagccaaattaacagctgcttttagagagctggaaggcctccggggtcatcttcaacagggactatcacccaggccctgtccctgtcccacgttccctcctggggacctgtcatggaagcttttccacaccacagtcgtgttctcggtcctcgcagagctcagctgcacctccagattctgcccaaacatgtggactccattgagggaaccgatgacagagaacgggagctaaggaggggttagggacatcagacaagagcacccccccatccccttcccccttaggacccaagtgtgccagctcccagccccatcctctttccatatgacctggcagtgcctctttggggaaccaggcttattggtccattgcctcctcggtcctacaaattcaacactgaaacttccccagcccctactgccttgaagacccagagtcaaaacaccgaacccccttcggtttagatacaggcgtccaaggccccacctgctgacgggcgggggcgccgccgcgactgctcctgcagaatagggggaccccgctggaggccgcgaggcacagcagatgcacagtgccgcccgtcccctcctcccccatttaggactcccaccgcggtccctcacgtggggactgtcagtgcgggtcttggagcatggcggtaatcagagtaactcggcctgtggtccggagccgccagagggcgagatggggagctgattggaagaggattaacttcccgccttcttcacccaactcaaacagaccctcaaaccctattcaggcacctcccccaaacccattaggttctcttccgccctagccggaagtcacggtacccctaacaaagatggcggcaaattgaatttgcaaagctttctagtttctccgaggaggtaaagagaaccaagaagccggattgaagatgatgactgcgccaaggcgttgcctagccaccatcctgtaggctttgatgatttacattctaaacggaaaaaacagctgtgcccggatcaaagattgcgatggtcccaaagcattgcctagcaaccacattccctgtaggtttccagtatatagtagtaaacaatgtgccctactcaaagatggcgaccgtggcggggcgttgccaagcaaccaccattcagcctgatatccattccaaggctgtaaacagctgtgccctgctcaaagatggcggcacgtcgaagtccgagcaccctccttggggcgaaatcgagaaaaacaccatctcccctacaaccttcgagggtggttgagtccagcgatcgttgcctagtaaccactaaaaaaaaggttgtttttgttattagaaaaaagaaaacaaggaaatcctttattttccagaataataaaaataatatcatttctgtaatgaatttatacatgatagcataccatgtaaaatgtgaaaaatcccttccccaatttttttcctaaaatacagtttaacgtagactattcatacgttttcacaaagatgatcaatatactaacatttccacactttcttttttgccatgaaaaagtatgtctatttcatcttaataatgtatttttataatctattttatggatgtgacaaattgatttgaccaattctgtattgatgtacattaggttgttgaactcctccagactagccaactagtgct

SEQ ID NO: 92208 - DNA, 1062 bp, Homo sapiens
ccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcaggtggggccttggacgcctgtatctaaaccgaagggggttcggtgttttgactctgggtcttcaaggcagtaggggctggggaagtttcagtgttgaatttgtaggaccgaggaggcaatggaccaataagcctggttccccaaagaggcactgccaggtcatatggaaagaggatggggctgggagctggcacacttgggtcctaagggggaaggggatgggggggtgctcttgtctgatgtccctaacccctccttagctcccgttctctgtcatcggttccctcaatggagtccacatgtttgggcagaatctggaggtgcagctgagctctgcgaggaccgagaacacgactgtggtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcaggttggtctgagagaggatgtatctggtgttctaggatcaatgggcggactccaacataccccttcctgattccccaggccttgactcattcttctcacttccattccacagcatcaccctcattgttctgtcatctgaggtgggcatctctgagctgaggctggagagactactccaaatggtgtttggagccatggtgagactcaccagtcctcttttctccccagaccaggaatctgagatctcagcatccttttccctcagacctaggagtgcagaccaccaaca

SEQ ID NO: 92209 - DNA, 1348 bp, Homo sapiens
gtcccttatctaggttagcctaggcacgggcttatcccataaccttcactgtggtgcccaggcagctcaggcttctcatgaccttcgctgtacttcttagataaaacagaatacttgaagtcatgagttacagagaacaggaatctataaactcattccataaaacaaaggaaaatttgttttttcttctctctatgttgagggagtgctgggagagtctccaagagcactttagatagtattatcaagacttttcctgggtctgggctgtgcccattgctgcctctcagacaagtcagcctaatacatagaacttatttctctttttaattttttttctttaatttcctgcctcaccaccacgcctggcgctggatcggattttgatagttgacattgtagagtctggagtcaggcagacgggttaaatcctggctcttccagcacagaactaactctcagacccaggagtctgtcccctctgtgcctagtatctcacttgtgaagtggggatgtggatagtacttgtattagtatttcattgtattacttattcttagctgtataatagattaccaccaaataatggctgcatactgcaaacatttattatctaacgcagtttctgtgagtcaaggacacaagagtggcttggctggatggttgggctgagggtctcacaaggcaatagtcaggaggtcggcaggattgcagccatccaggggtttgactggtggtggggaatccgttcccaaggtggcgagtctgtggctgttggccacaagacctctccacagggctggttgactgtctaacatggcaactggcattcctcagattgagggacccaatagagagagcaaagaggaagccccaggcctctcttgtttttgaggaagggtctcactctgtcacgcaggctggagtgcagtggctcagtcacggctcactgcagcctcgacctcctgggctcaagctcaagcgatcctcccatctcagcttcccgagtagctggagtagcagggacggtagccaaatgccagcacacctggctgatttcttaaaaatatttttgtaggtcgggcgtggtggctcacgcctgtaatcccagcactttgggaggctggggcaggtggatcacctgaggtcaggagttcgagaccagcctgtccaacatggtgaaaccctgcctctactaaaaatacaagcaatcatcctgccttgacctccctaagtgctggagtgctgaaattacaggccttagctgggcatggtggcgcatgcctgtaatcccagctcttgggaggctgaggcaggagaattgcttgaacctgggaggtggaggttg

SEQ ID NO: 92210 - DNA, 1931 bp, Homo sapiens
gagaggtggggagtctctaccaggagcctctgagccactctctgtgttctcccagccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtaaggggacccgggggagggcagaggtctggactgagtgtcccagcagctcctgggctagagcaccaagaccgagtgctcctgggaagtaaagacataggatccaagaatgagggttcccccatggcctttgcggagctctgagggctccgggaaagtacagcccatgggtccaaggacctagtgggttaagagcgtttcccatgatcctcctgtgtgtgctcctgggattgctgggaaatgtggtcttagggccagagaagtagttttggagaagggcccccaaaggctcatgggaaacagcatatttgtaactagatggggccagaaggtgcttctgttgggtcccccaagggctgcctagaaaacttagtgcctctgggccctcctgggcccaagggcctactgggagatgcagtcccttccccactgcccctcaggtcagatgctgctgagcgggggtccccggggcccggtcccccagccgggcctgcagcccagcgtcatggaggacgacatcctcatggatctcatctgaatccccaacacccaataaagttcctttttaacacacgccccggctcccgtcactgacatccctcaggactgggcaggaggaaaccccagggggcatctctgtccttgttctcacttcagcagacatccctggggccctgggtgaatgacgctggggcctccgtggtgagtcacaggcagtctggtgcaacctgattcgtgggagatgcagggacaggcaggcagcgctcaggactcaagctctcatggaggtggcaggggcaccatgggagcctggaagaggcatctgacccagccccagctcctcagagtcttgaaagagaatcagccgtcaggctgggagggaaggaggtgaggggtgatctgggtgcagaggacaacagaaactttgaatactcaaaggcaggaggaagcctgagacattgagaggagcaagttgatggatgcttttggagcatgagcatgtagggagctagagagatgggcaggtgcagagtttgaggagctcggattccaaactgagcagcccatggtttgtcctggggacacaggagaaccaggaggctttgagcagtggggcgggcctaggccagctctggatgtcagaaagacccctctcagctgtagagcgtgatgaggccagacaggaggccaggaaaggtgaggctgggtggtggcggtgtcgggggctggggtagaggttcgctcccgggggccaggcctacgtgatggtaggtggtggggctcctgggagaaggagctggtagtaagtgcaggtggtccaagggacatccaggtgacaggtgccatgttgggagctcaggacgtgtccttaggggacagtgtatgtttggcagttcaagccacagaagcagacaagatcgcacatggagagagggcagtccctgggtccatgtcagagactgaccttccagggctgtggatggggaagacggtgggtctgtccccaggatagaatacccagcagggaacaggtttgggacgtggcaaggtgagggacctgaaggatgtcctcagagacgtcccgagggcagggggatccagacaggcttggagcgcagggtggtctctcctggaggtggtgagtgagttgtctgttgttggactctggaccagtgttgctgagagcgcggtcca

SEQ ID NO: 92211 - DNA, 1162 bp, Homo sapiens
ggcagcgggaaaggacatgaggaccagcgtgtgggggtcctgaggggtgagcagagggtttggacatggccccgtgggcttccagcaggggatttggggctgaatattgggacgtcccctctggggtgtgtggggactgcctgtccttgcaggccccggcctcagttttcccacctatcccccactccattgcaggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagc

SEQ ID NO: 92212 - DNA, 1032 bp, Homo sapiens
tggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccat

SEQ ID NO: 92213 - DNA, 1094 bp, Homo sapiens
ggaggcagaggttgcagtgagctgagatcatgccattgtactccagcctgggcgacaagagcgaaactcagtctcaaaaaaaaaaaaaaagtttcctcaaggaaacccagaaaggctccatgtacctcagcccttgcttgtgctgggccggccgctgcagatccctcgggctcctgagttgaagccatggccggttggctcaggtggctgtggtgaggtggccccagacacagcctggcctgcccaggagctctgaaatgcaggttcttgggcccttcccgacagagcctgttggcctttggcccacccattgctcttggccaccgtgtcatcccaataagggggcccacctccagggtgggtggggggtgtgaggacagagcagttaggctgtgcctggctcatggagcccacggcatgatgccgtggttggagggatgctggtccctgtggtgctgtctggtgacaccacgccctgtgcctgccaggccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgaggggtgaggtggccggcctccagggctgctcagtctccctccacccccgctgcctgctcaccactggcctctgatttctcgccgtagatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcc

SEQ ID NO: 92214 - DNA, 1042 bp, Homo sapiens
cgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcgtgtcctggggacacgagaggtcacaaacagatcggcagacccagggggagagaagaccccgagcggggacggggaggcaatgatggaggaaagccgccccaaaccagttgagaggtggagatgggaactttataatagatttggggcggcaaaagcctggtcataccctgttcacgtggacatatccggccgacacgaggtgcttcttgagaaaggtggacttcccggctgtgtggggggcagtgtcggtgggtggcctaggacccaggcggggctcagggcacgcgcacaggaacaggacacttacccccagggaatcccactgcgacaaccacctccgggctggcgctcaggagggccctggactcggggaggcagagaggccctgagcgggagacagtcctctgcgaggggcgggggacacgcgtgagatgccgtccccatccccgggagccctcccatccccacccccacccccgccccagggcctcaccggatcaaaggctgggagctcgaagccggctgctggccacttgagaaagaactcctcaggcgtggcgaagggcaggccaaggttgagggcaaactaggggttgaggacgaacatcagacacaggccagggtcgggctcgggcgcggggcagggggcaggggcctcaccaggcgatcggcgcaggagaagtctttcttcttccgccccggggcccagttggccgggcgtccggctgcgtctggaacacacgggacaccccgttcccaccagctcggagggaggcgtcccagcccaccctcagcagcctccaggcccttacctcccacaaagatgctgtccccgatggatatgggcgtgccgtcgttggcctacgggagacggtagtgaggaggcccttc

SEQ ID NO: 92215 - DNA, 1672 bp, Homo sapiens
agtggtagcggcccgacccgttctagagaaggagcgggtgaaaccatttttcagaagggggttattccactggaacctcgagggtggatcggagtcacgtggcgcagacgctgaaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacgtgagtggaggcggcgttgttaaccgcggtgtggggaggatttggccgtcctgaggcagcggggcgctgggagggcgagcggctcacgggaggggtatggcctgcacagatcagagggcagaggtctgccagcgatcctttgctgagcgctggaagggggtcgcccgtgggaatcgtcctgtcagacctgaggcaaatcgtagacagtctcaccttgcggttccagagcgcctgggatctctacctgggccgtggaccacgtccacggggtcgggggatggtttggggggcctcggggcgcccctcacccgtccaaaggcgggacttccggtcctggcctccgtctgggcgggatttcctgttttcttcctagaccagtgggtcctccctggaccccgggcgaggttgggaggtctcggggcagctgagcgtggccccaggcgctcaccccatggctaccgcgttcatgctcaggttcctcacatcttggggtgtggggtactaaaatttcgacaggaggggtggttccacccctctcctccttagctcttttccctcctccctgcatccaaagaggacagccacatcgtgctccccctcctgtggggaacacgtctcactttcctctaatctctccctgatct

SEQ ID NO: 92216 - DNA, 1074 bp, Homo sapiens
acaaggctatgtagtgagagatgccaggaaggtgaagtgtaagggatagtggcaagaatgacgaggtgacctgcttgggtctgtgtggtcagggaggggctctgcagggctgacctgggaggtggcgccaggcttggaggtctctgggtgttgcagacagtggcggcctcacatcttgtttccctctgtcactcagggatgagtatttccgcatgaagctgcagtggaaatctgtgagccctgagcaggagcggagaaactcacttctgcatggataccgcagcctcatcggtcagtgtcaggggtggcacttagggtggatgggagcagggaaccacaggagggcctcaggcataagtgcgagtgggagatagagggagccccctgcctccccaagaccagtgagagggcatcttgggggaaagctgcatgggctgttggggaatggccctgggggagcaaggccagggacaggatgggaaagaaggggagcccagctcccttcaggcccagtctcagttctgtcaatgcctggtgatcttggcaagtgattttgcctccctgggcctcagtttcccctactgtgggaggatatagccagctggtgagtgggaggcctggcgcctcacagcaggagcatcagtgatagtttctagaaccagctctgcttctcccccagagcaaaccccgaggctgggggctgccagcaggaggagcagtgggggctggcactggtggccagcagggatgggcccccctacctttctcacctttgcaccctgtgcccggtccccgcagaaagggatgtgagccgcactgacaggaccaacaagttctacgagggtcccgagaacccggggctgggcctgctgaacgatatcctcctcacctactgcatgtatcacttcgacctcggtgggtgccaggcctggggacgggcgtggccggggctgtccaggggagcgctgcgggcttggctgcagcctgaccccatgtccccccaggctacgtccagggcatgagtgatcttctctccccgatcctctacgtcattcagaacgaggtggatgcttt

SEQ ID NO: 92217 - DNA, 1053 bp, Homo sapiens
tcaaactctcagtcccagcgctgggcaaggctgagtgggctccatgtcatcccccagattcccaggactccggctctctctgcttctgtttccggtggctgctcatctggttcaagagggaattccccttcccggatgtccttcggctgtgggaggtgggccagccagtttgggcgagaggcctgaaggggtgggctcacctgccctgggaggttgggcggagagggacagaccctggtgggacctcaggcccaggctgggctatgacctccctccctccctctgtcccgcaccctcaggtgctgtggacagggctccctggccccaatctgcacctgctggtggcctgcgccatcctggacatggagagggacaccctcatgctgtccggcttcggctccaatgagatcctcaaggtgaggctccggccccgcccccgccctgtcccccctgagctgggcgctgcccagggccgcagtacctccggggagcaggtgtttagtgtgggattattgaaagcctggttagttgggagcgcagtgggggtggggccgcgtaggtttcccttctgccccatgccatgcctgctcccagcaaggtcctccgggcaggtgggtggggaccttccctccccgagtacgtgctcagaatgctcccggaggcctgagaagcatgtctcgcccagcgcacttctgagcccccagagggccagcccggtgtgtcttcattgtttcccagcacgaagcacagagtgggcgctcgggcggaggtggttgagtgccgactggcgcctgacccaccccctcccgcagcacatcaacgagctgactatgaagctgagcgtggaggacgtgctgacccgcgccgaggccctgcaccgccagctaaccgcctgccccgtgagtccccgtccgccccgcagcgccccgcccgaaccccgaccgacccccgcccccttctcaccttcaccttccgcttttcgcttctctcatcccgtgcctccaggagctgccccacaacgtgcaggagatcctggggctggccccgcccgca

SEQ ID NO: 92218 - DNA, 1041 bp, Homo sapiens
ctgtgggcaggggacggacggtagataaacttctcagccatcatgccctgtcagcactgaccagtggcacaggggaccagcttctgtccgtggccacagtgattcaggcaacaaataatcactgagcccccgggaggacacagcacgcctgggaccctctcccagtctcctctccagctgcccacatccctgcctccatggagctcacagtctggctggctggctgaaaaataggcaaaataacacgcaaccgggatgagctgtgaccagccgggccagccgaatgaggggggatgggcggcgttaacagttcggtaatatcggaggagcagtggcatctgagttgccgtggagggcaaggcggagggcatggtgtgggcaaaagcccaggggcttgagagtggtgaatggccagccgtgggcagaaccacgaggagaagccgagtgtgggctccaggcccggcctccaccctggctgcccgggcagctcagcaccatgtctgcttcttccacaacaggccctcaaagacctcaaggcactgggctgcagaaaggcgatgaagaagtttgaaaggcacacgctcttggtaagtggggatcttggttctgctgagatgcagggcaaagagagtgaccatgaggccttccccagagagtcagaaggcgggtacctggcaccctagtcctgccaccgccttcctgcctgacccgggggctggacacgccccctgtctggacctccgtttccctcatctgtcagagagtggggacaggatcctacggtccaaggacatgtcatgggaccaggaggcccagctgcggaggggctctctcaggggtgcagcctgcctgggccctaacctcggcctgtgcccaacctgcaggaatatcttctcggggaggggaacctgagccggccggccgtgcagcttctgggagacgtgatgtccgaggatggcttcttctatctcagcttcgccgaggccctccgggcccacagctgcctcagcgacagactccagtaaggggcggggctggcgg

SEQ ID NO: 92219 - DNA, 1105 bp, Homo sapiens
gctggaggtctggttggaccaggtggcccgagtgttgccagaggcccagggctggcgctggaggcaagactgaggtgaggattaggcgaaggatggggttggaggctgggtttgggagtcagagtggaagttcgggcccactctggtgtgggcatggagctggggggctagttgagtctaggcacacaggtgggtgggttgctaggtcacctgtgagagctgggcatgcgcatggctcccagctccccaatccagcccgtgttctggtcccggtaggtgaagatgcggcccccgatcctgttatctgcctccaggatggtgacctgagggagtccgtggggcgaggagggcccttcagctccacccactgaccatcccctgccctctaccaccccgtgccagccccctgccttcttccatccccacagtggcccagacccagactaggagagggtccccttctgtatggaggtgggggaacagaactgagtgagcagttccagactgcaggaggaaggctgccagctagactgcaaagggacttcccagctcggggagttcggagatgacccatatgcgtagaagcccctgggctggcccattctcattctcggattgcagtgagtaggtcagtggttagacctcagggcacacatccccttggtagagtttccctctccaccaacaggcgccccaccccaggacagaggagctttgagccagtgagacttccctctgggatgaaaaacgtgggacaggaaagtctggggcctctcagtggagacatgtgacagcagggggcttgggcctcacccccagactacagggaaagatagcctctccccccacatccccacctccaccccctcaaggaggaacgcggccgtgtccctgtgcccagggactccagcctgcagcaggagggactccaggtagactgcaagcagtgcttcccaccttgtgtccagcatcgctgagcaccttggcggccaccagcccggccacaccagcgccaaccacaatcaccctctggggcttcagggtccgattgagcccccaggtcaccaccttgagcagctgctcatagtcaggatcctgcatgcat

SEQ ID NO: 92220 - DNA, 1195 bp, Homo sapiens
ccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgac

SEQ ID NO: 92221 - DNA, 1025 bp, Homo sapiens
tcagccctggctgtttgacggggacggggagttcggggattctctggggaccccagcacacctggcaaccgctcccggttagcagagccttggataagggagaacccccgcacagcaagagtaggggtggtgtggagagggagggagatcagccacccgtgcaggaccctgagaatctgaggctcggtgccaagaaggggcctcagatcacagaggcttgttagcaggagtcaagactgaggtcccgagaggtaaggggggttgtgaaaatcacagtgccagttagatgggacctcagcctccaccatgctgcacagcttccagggccccgaggcccatggtgtagtctctgggaggtctccaagccctgaccctcacctcaggcctgctgctgctcacagttgccagacgctatcgattcctgcctgcacctgcaccgtgccatcgccctgctattgccgcaactcctcactgctttcccaatcacggtggcctcctggcatgatggaaaaggctccgagttttgcatcagacagaccggggttctggtcctgagcccagcactcagttgtagactggagtgcaggcagggccctcatctgccgagcctcggctgccttccgcagcgtgggtcagagcatgggccctagagccagcctgctgggttcacaccccaactccaccacttctgtgaccctcagcaagtggcatcctctttctatgactcagtttcccctccgtaaaatggggatgagatggtccattgcagacggtggttttgaggattaaatgtgtaaatgtgcgtgaaatacctagagtggggcctggcatagggaaatgccctgtgagcagtagttcctgctctggggcctggtgtgggagcgctgtggagatggcatcagtgaagccggcggctgccagagcccgggtctgtgtgtgattctctctgttctcgccacgcctgcttctgctttcagatccgccgtgtgcagatgtctgcctacgtgactgctcccccgaacgct

SEQ ID NO: 92222 - DNA, 1025 bp, Homo sapiens; identical to SEQ ID NO: 92221

SEQ ID NO: 92223 - DNA, 1033 bp, Homo sapiens
ataagaaaaatcaactcgcctggtgggtttatgagactcaaataagacgatgtctggcaagccttatgcacagagctcaactcatacattcctgttcaactgttttttttttttgagacggagtctctccgtctctgtcgcccaggctggagtgcagtggcgcgatctcggctcactgcaaactccgcctcccaggttcacgccattctcctgcctcagcctcccgagtagctgggactacaggcgcccgccaccacgcccggctaattttttgtatttttagtagagacggggtttcactgtgttagccaggatggtctcaatttcctggcctcgtgatccgcccgcctcggcctcccaaagtgctgggattacaggcgtgagccatcgctcccggcctcagcatattttattaataggaactctggggcccagtctcatttcttccttaccacttgtaagagccgcagacgttggactgtccaacacctgctgtcattcttctgtctccctcatccctctaaagtgtctgtttccagctatcctcatcttccattccaaatgatgggtgcccaggccccatcccctggcagggattcagacatcgaggccccagctgcgtccttttctccatcccttgcccttggcttcctttcaaaccgtccttcagcttccactggataggaactatctcccaaccctgccaaaaatggaagatctccgttttcgtttagtcacagggtagccatcttgccccttctcatgcactgggccctcctccaccagccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcggtacacacaagcttctttctccttccttacctgttgcgggcaggaagtccttcttgggatctgaccaccttcccttagagcacttactgtcc

SEQ ID NO: 92224 - DNA, 1024 bp, Homo sapiens
cgcagctctttcactacggggcactggtgggctactgcgcaggaacaaccaagcacgaagaatcgtttagaaaaaaaaaaaacacaccctcccctggagtgctcaggcccagctgcacgcgggctgacaaacatcgagtctagaactctcccacccggccccgggcccagtgcgcatgcgcagccgcgcgccttcggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtggtgagcgcggagacgggccgggggcacaaaggggtcgaggctacagagccatggccggggctacgcaggcagaggcggcgacactgtagtgagaagagactgtgatccgaggacagggaatgaggcggccccggggactggggacagatatatactgggtggcggagcacggccctcccggatccttccgcgccccgccctcgcgcggccccaaccgggaggcagccgggtcccctcctcctggggatcaggggatccgagcctttccttcccactcctagggtccgggaccctcctccctctcagctggggatccgacctcttccctctgagccggggatccagccctctccttgtggctccggggtctggtttcctcctcctgactctaagctctggtttctttctctttctgcctctgaggtctgggcctgcttcctcctgtgattttgaggatccagcctcattctcttcccgcagacctgcaccagttcatttctctttccctttccttgcttgcagaatttcctgccagtcacttttcacttcttcatcccccagctgctgactctgagaaaccctcgtgggttagagtccagcatgagtcacagcact

SEQ ID NO: 92225 - DNA, 1018 bp, Homo sapiens
ggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctggcttgtgcatcttgtctttgagagaagcagctggggagaggcggccttgtaatctcagcactttgagaggctgaggcgggcagatcacctgaggtcaggagttcaggaccagcctgaccaacaaggtgaaaccccatctctactgaaaatacaaaattagctgggtgtggtggcgtgtgcctgtaatcccggcaacttgggaggctgaggcaggagactcgcttgagccaaggagacggaggttgcagtgagccaagattgttctattgcactccagtctgggaaacaagattgaaacgctatctcaaaaaaaaaaaaaaaaaaaaagggggggggaggtggggagggccgggc

SEQ ID NO: 92226 - DNA, 1028 bp, Homo sapiens
gagtgcagtggctcaatctaggctcactgcaagctctgcctcccagattcatgccattctcctgcctcagcctcccgagtagctgggaccacaggcacccgccaccacacccggctagttttttatatttttagtagggacagtttcaccgtgttagccaggatgatctcggatctcctgacctcgtgatccacccccctcggcctcccaaagtgttgggattacaggcgtgagccactgtgcccggccaaaacaaggtgtattgatcggggaaaatcgtgtggccagaggcttgcaggaagcagtgctgtttcccttgggagcaatggtagtggattggttgattcagtgttcacagtgactttaagaacataacttccctggatggcagaggggactgtgtatatatcttaggctgtgtatatatcttaggcattctgttttaaaaggttgctctcctttccctaagagacctttcacatgtgtttctgtcccttcaggtttgttgataagccggggcccttcgtgggaccctgcggtcactggatcaggccctcaggtacgtcctgaagggagcgggaacaggcggggactcgggcaggacctggtggctcagatccatcttggggtggcttctccttacacctcttcattttttttagttttccaaattgcatttgtaatacgtacccattgtagaaagacaaaatcgtcaaaagattcactagtgcctctgaaaaacaaaacaaaaacacaacttttttttgaagacagggtaattttttttttttatttttaagacagggtctagctctgacatccaggctagagtgcaatggtacgatctcagcttactgcagtctccgcctcccaggttcaagcaattctcgtgcctcagcctcccaagtagctggggttataggcgtgcgtcaccatacctggctagttttttgtatttttagtagagacggggtttcatcatgttgcccaggctggtctcgaacccctggcctcaactgatctaccta

SEQ ID NO: 92227 - DNA, 1017 bp, Homo sapiens
tcctttgtcactcaggtagtcgcacgctatagctgtctccccactaggctgtcacgggctgggacccgacgagatcctggtctgggttttcagaagtgagctgggcctggcacacgggtgctgaggcttgattgaatgagtgcatgaatgaaagaggagtggatgagggtgacctggtaaaaggggctgagagaatggttgagtgagagagagaatgagtcagcttctgcctactcatgaaagtgaatgagcggaggagacagcccatatggctggaaggctgggtgtatgagtgtgtggttgagtcagtgagagagaggggaaggaaggggggtggacccaccagtgagtggagcgtccagacttgagctgccacctttactcctccttccccagggccctcccgccgcagcgacctccagagcctgggctactgcatgctgaagtggctctacgggtttctgccatggacaaattgccttcccaacactgaggacatcatgaagcaaaaacagaagtgagtctaggggtcagcagaacccctgcaggtggtcagcagaacccctgcaggtggacagaagcccagagcccaactgggagcaggagggaaggggaggtggcatccagcagagcccaagtcctctgagccgcacaggcatgtgctgcagtgtccacacagcaggcgaggcaggtgttccggagccacactgcctgggctcagactctggcaccaccactgtggggtgttaacgtctgcgagcctcagtgtcctgctccatgagatggtctcctactagctactaccttatgggactgcaaagagttcagggaagtcaggtgcacacagcacttagcacaggggctggctcagagaaaatgctcattgtggccgggcgcggtggctcacgcctgtaatcccagcactttgggaggcagaggcgggcggatcacgaggtcaggagatcgagaccatcctgactaacacagtgaaaccccgtctctactaaaaatacaaaa

SEQ ID NO: 92228 - DNA, 1043 bp, Homo sapiens
cattcaggtcgtttctagtcttttgctgctacaaagagtgcctcaaccggtcacctcgcacatggtcatttcctgtgtgagtccaggcagccacaggctgtgacccaagtctggctggctgcaaaggccttgttctctctcaggacaaatcctcacccagacagtgcctttgtgcaatttggaaagattctttgctaccatcagcctgaaaatgctcataacaaacattcaaatctacattgttatggtgtagacataccatgtgcagatagatgcccttgtgcagtgcacggcctgctcagcagccccatgacgcctttcaggccgtgggcagccatctgagaccctctcccctctcacccactgcagacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcagggtgagtgctgggtggggctgtaggccagcgaggcggctcttcaacgggggcctgacctggggctgccggaagccagagtccaggtcaaatgacagcttgtagacttgactctgtagggcttcttagggggctggagggagcacaagtagaggcctgagtgggtgaggtgctaggtcctagagtctttttacctgtctccatgttcattgtctcttttattattgttattattattattagtttgagacggagtcttgctccgtcacccaggctggagtgcagtggcatgatcttggctcactgcaacctctgcctcctgggctcaagcgattctcgtgcctcagcctcccaagtggctgggactacaggcgtgcaccactgcgcctggctaagagatggggtttcaccatgttggccaggctggtctcaaactcctgacctcaagtgatctgcccacctcggccttccaaagttctgggattacaggcataagccaccatgcctggcctctttttaa

SEQ ID NO: 92229 - DNA, 1080 bp, Homo sapiens
ccgccttggcctcccaaagtgctgagattacaggcatgagccaccgcaccctgccaagaaaatagaacctctatgaaattaggctcttctggaaaaatggttaaaatagagacagtttgccctatttcaaatattgcatataatgcaagaatttattacatcttttaatatgtttcagattcctaaaatgcaactgcagtggttatgttatcactgttttctctctctatgcctcagtttccaaatctgtaaaatgggaatgattcttacaggcttataaagccattgatgtaaattgctttgagcaatgcctgccagagtatctatgctaggtaagcatttgctgttattgtcatcatttattgataaggaaaacagagatcatgtccttgaagagaagaagggtcaaagaccagagtttgagaggactcctactgtctgagttctaatctcggatcttcagtttctaagctgtgtgaccttaagcacattctcccactcttcagagcctcagtatgtccatctgtccaatgaagctgatatctaccttacaggctgtgtgaggtccttcatatgtaaagtgccagttgtgataaatgataagacccttgacctttggcccaggtccctaaaactgaccctgacctccttctctctctctctgcatctccatctgacagtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggtgagtgactcagcctggggaggaaggggtggctgtggctgtgggttaaggtttggcctctggacttggctggagccacatctgattcgaggaccctcaaattagctgtgtggctttgagcaaattgcttctattcctaggctcagggtccggttgggaaaattcatgcattcatatgacttaatgtattaagcatctactgtgctgggaac

SEQ ID NO: 92230 - DNA, 1081 bp, Homo sapiens
actaggtggtgaggggcaggggcagctctgggtgtcagaaagaccccgctggagccatgtaggcaacagacttggggtggagggtgctagaagctggggaggcagggaagagaggtgaacaggtgacctaaggccaggggtctctgcagggttttgtctctgctagcccctttgacttagacatggctgagtgtccaagacttggccctgggggcactggggaaccatgggagggctatgagcaggatcagctctggagacgtgttggaatgggctggaggggagagatgagaggctagaaaggaggcttaggtgagatgggggactgagctggggcagtagggatagagaggagaccaagtaaagagagtcagggagtgagaggagcggggcttgcagcctgggcaggagctccagggcagacatccatgtccctagcacacagagggaggctgggcttcctgtgtctgacccggtccctcctgacctcctctccagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggtaagagccggcgtgagctgcagggaggggaggctttggtgtcttcaagccccaaccatcactccagggtctaaggctagctcggacccctcgctctcaacccacaggcagcatccgcatgggtcagcacctttataaacatccatgccccagaggctggcttccttcttcttctattttacatttctttcatttaaaatgctgcacttttaagtcaaatttcctcatttttttgtttgtttctttgtttgttcagttggtttttttttttttgagacagtctcattctgtcacccaggctggagtgcagcgacgtgatctcagctcacagcaactctgcctcccaggttcaagcagttctcctgcctcagcctcctgagtagctgggattacaggcgtgcgccataatttttgtattttt

SEQ ID NO: 92231 - DNA, 2145 bp, Homo sapiens
agtggcgcaatcttggttcactgcagcctctgcctcccaggttcaagtgactctcctgcgtcagcctccagagtagctggaattacaggtgcctgccaccacacccggctaatttttggatttttagtagagatggggttttgttggccaggctggtctcgaactcctggactcaagtgatctgcttgccttggcctcccaaagtgttgggattacaggtctgagccactgcgccaggcttcttccctccctaattgtcccctatggtcctcccaagaccctcctttcctccaggcttgtcctccacccctgctcctccctcctacatctgccctcacctgatcactggctcccactcctccccagaactctccctcctcccatccttcctcctcccctccccctccccagccagcccggaagctccttccatatttgatgtctcagccgccccccatttcactgctcccctcccgcggaaaacaccagagaggaggaaatgatcccggcggcgtttctccatccccccaacagtgaggctgtgttggggggtttcccctgaccatcctctccccacccccgtgactctgtgtatttctgtccccagctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgcaccgttccctgccctctccgctggctgctcccacatgcattccacccagcccctccccacgcccctgccgcccaccatcccgccttgctgccccccaccttttgcctcaggtgaggggaccagtggagggggggaagggcggtggactgtggtgggaatggggcgggggaggctcggtgggcaccaacctgcctcctaatccggagtctctcccccctccccgatgtctccccctttctcatcgatgttgactgactccccgatttgttcactttctctctccatctccttggtccatctctgtccatctgtctcttgtcatccgtccttttgtgtctctgtctgcctgactctgtctgtcttgccttctctgtctctctgggtatctgttgtcctccccttccatttctttctctctctgtctctttctccctgccttgggtctctctgtctgacccttccctgcaccccatcttcgtgcttcccccctgtgtctgcacacctccccaccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaa

SEQ ID NO: 92232 - DNA, 1049 bp, Homo sapiens
cagtgagccaagatcacaccactgcactccagcctgggctacaaatagagtgagactccctctcaaaaaaaagaagaagaagaagaagaagaaaagaagcaattaagataaagataaaagaacaagactattactctggccacttcagttaaagaggtctggctgggcacagtggctgccgcctataaccccagcactttgggaggccaaggtgggagtatcatttgagcctagaaatttgagaccagcctgggcaacagagcaagaccatttcctcaaaaccaaaaaacttaggtgtggtggtgcatgcctgtagacccagctacttgggaggctgaggtgggaggactgtctgagcccaggagtctgggaggctgcagtgagccatgattgtgccatggtgctccagcctggggggacagagtaagaccccatctctgggggaagaaaaggagttctgcaaaggactttttgaggaggtgacacagaacctggagggtgaaaagggccaggcaggcagaagaaacagcaagtgcacaggccctgagcttccctgggggagggggtggaggatgagcttggcttgttcaagggacagcaaggagcacagtgaggctgatcccagtggccaaggggagagggctgctggagtccagggagaaagatcaggacggattttcggccatggtgaggaggcgggactttatcttaaacgtgaagggaagccacctgaaggtatgtgatccatcatgcattcattcaacagccgtctgtggaatcttctttagaaatgcagagacacatcctaaaggatccctgtccacagcctaaggagatgccataggggaacctggggggcttccaggaatggcctcacctaaacccctgtgtttcacagacattcagggaaggccatgaccaacccaccaccccaggccacagagcacaagggccgagaccccaggcttccgggctcctagtccagaggggggactgtctggctcctcttgttccatcccccccacctctcctttttgtaacctccccgt

SEQ ID NO: 92233 - DNA, 1048 bp, Homo sapiens
ggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcaggtgagcctgggcgtcagggatcgggggcacaggtggagacccggggaggactggggaggtagctgccggggttcagagaacctggggtggtt

SEQ ID NO: 92234 - DNA, 1834 bp, Homo sapiens
gggctggaggtttggctcccaagaagcgaggaaatgggttcggaactcttctgccaagtcccagtagatctacccggtaaacttccggtgagtttccaacttccgtgcggggcagcagcttcggctggtcctaagcggaccggaagttcgtcaagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccaggtaggtgcacccgagagtggggagacgcaggaggagccccgaacccggggcttctcggcgctccccgcgtactccgctctgcccccttctctccttccatttcctcccctcggtaattcgcgcctcccgcggctgtttccagggcaacaggagtagttcactccgcgagaggccgtccacgagacccccgcgcgcagccatgagccccgccccccgctgttgcttggagaggggcgggacctggagagaggtgcgagggcggagcatgaatggaggaggcggggcggggcatgatgggaggtgatggggcgggacctgcagcgcggtgcgggggcggggcatgaagggaggaggcggggctgggggcggggcatgatgggaggagatgtggcggggcctggagcgaggttgtgggggtgcagtaggaagggaggaggcggggcgggggcggggcatgatgggaggggatggggacctggagcgaggttgtgggggtgaggcttggagggagggatgcatatggggcggggcaaggtgttgggaggcccatgatgggggctttaggggctgaacctggaaggttgagggcggagcatagtaggaggaggtggggtcagaatgagaaatagggatgcttggggcagaagtgaggtagagtcttaagaagaggaggtggggggaaactacatggcatggaggccgtgaaggcagagcatgattaaaggagaatgggccctacctagaaaaagcaggtggattggacctgagggggcggggcctacagcaggggcggggcttaagaccaagctgaaggctggcgtggaacagaagggggcaggtcttgttagaaggatggggagggtttgtaggctggcaggaaccagggttgtggctgagagtagggtctttggagagatggaaaaaaaagggaaagccctgtcaggacctgtaactgacctaacctaacccttcttagccccacaaggctctcaatcccctgtattctacaggctgctccgtgaccccaccatgtcctctcctaccacgagttccctggatacccccctgcctggtgagtgactctcttccccacccagcccttatcacacacgagcagaagctcactgtacctctcccggattccaccctcttccaggaaatggcccccctcagcctggcgccccttcttcttcacccactgtaaaggaggagggtccggagccgtggcccgggggtccggaccctgatgtcccaggcactgatgaggccagctcagcctgcagcacagactggggtgagacagggccctggagttgatgtgggggcttggggaggggtttaggaagggagaaagaaatagaaatgggaatgggaggccctgatctttgctttttgttcttgctttctccttaacatatacatctttctaaattgcaatttccctgaatgtgagcagcaactcctctctccctccatcctctggctctttgcctggggatctcctgtgggcccatctctctggttcctgtttct

SEQ ID NO: 92235 - DNA, 1035 bp, Homo sapiens
actgggagccaggtctagtccaagcacagaggcgggccccacgctggctcccacgcctggtcggggaggggccctcctttctgttggggtgggcctcccaaagcctggcagggcaggggctcagccagcgcccacctgcctcctccctcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacagaaacaggaaaataaaatatgaatacaatccagcccggagctggagtgcaagatggagagggcgcgggcttctagggacctcagtgacactgggtgcccgaacctgattgagcaggtgggactgggtgtccccaggctgttgggaaaagggtggcacatagggtcccagtgttgggtggtgtgtcgcctgctgtgaaagttcaggacagaggcctcagcctcagggtcacctccctggacaaggtgaatcagaactcacccttgaaggataaacaggatttaagtgaatgaggggacctggacttctgtccgaacaacaagtgtttgctgaggcctcctgtgggccaggcactgggttggc

SEQ ID NO: 92236 - DNA, 1031 bp, Homo sapiens
tgaggggcaggagtcaggcccctgcatcctcctgcctcgcaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggtagctctcgctccacgccccacaccatttcccggggtccccgccagcctccgcgtcctgagccatcagctcctgggtgctgcgacgcccatgtctgtgggtctgggtgggtgtctgtgggtctgggtgggcccctgtgcaattaggcttgagcacttcccctctgggttctgcaggattttcaggggtggctggggttctagaacattctggaagtaggggaatccgaggcagggcaaccaccagggtgacccaatgtgctcccacccccaggcctggtccaccttcatccgtatcatggaccccgacgtgatcaccggttacaacatccagaacttcgaccttccgtacctcatctctcgggcccagaccctcaaggtgagggctgggcaggtgggaggcttctctcagatgccccaggtgtggcctccgggccctgggcctccttcccactccctctccacatggcttggtgcatcttgctctgtgtgcctcagccgattgcctgcaggggcagcctaggcctggtcctgccctgctccaagtcgaaaaagttactgtggcttttatcagaggcaaggagggcgttacggtggagtaagagaaggctgtgcattcaaggtcggcctgaagcttgcaggggttcaacaagccatgaagcagccactgaatcccagtcttcctttaggttatatcagcataaggaaaagaatcataatggaggaggaggggggagtgtgttgactgatggggcaaattccggatgcttcttgagtctgcatgtgtgtaagggtggattcctctgcccgagttgctgtaaca

SEQ ID NO: 92237 - DNA, 1336 bp, Homo sapiens
tgccttattttcctgcttttctctatgtctggccagcttggtaatggaaaaacaaaacaggctgggtgtggtggctcacgcctctaatcccagcactttgggaggatgaggcgagaggatcgatggagcccaggagttcaagaccagccagggcaacatagcaagaccctgcctctattaaagagaaaacaagaaaaaatccattctaaaatacagaacaaactcttaggacccccagtgtatattccacagcgtggcgctgatgcccgggccatggtactcctcctccccttccctgggtgtccctcaccctctgccctgtccccagctcaggcttcttctggcctcagtctcccccaggctgggccccagcaccctgcaaggcctcctgcagccaggcgccctccagcgccctcagcatccatctcagcccagctccacgccgcctcctgcctctgcccccacctggccgcctgctcacagtgtccccaaatctcttcctgtttcctgcctaggtacagcccgcagacactgggctccatccttggcccccagtccatcagggcccctgactctcgctatcccagccttggctgcagcttagtccttactccggactccctccccagtctccagccacccacacccagccccagaccgtctttctgcccccagggttgctctcgaccccctagggttgttataaggatgttgtggttggtctcaatctccgttcttcaggcttatgtgacggggacccgcagcctgctgcacaccctgcctctcctcctcaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtatgggcgggaggtggggtgtgtccctgtccttggaaggccactgcccaggcccgcagcccaccagcccacccacccacctaggtgctgctgcgggagtacaagctccgctcctacacgctcaatgccgtgagcttccacttcctgggcgagcagaaggaggacgtgcagcacagcatcatcaccgacctgcaggtgcctgctgcctccctgacctctcaccccaacctctgacctccacctcacccttccccggcctctgacctcaacttcacgcccccacgtctgacctcactctttgacctgctgttatgacctgtgaccttacctgacgcccactttttcctgacctctgaccccagatttctctccactcctgtgacctctgtcactatgacctt

SEQ ID NO: 92238 - DNA, 1051 bp, Homo sapiens
cggcgatcctcccgccttggcctcctgagccgccacgcccagttctcacactgtactgtttccccgtggcttaacgctctctcgtgccaggccttggacttggagcctcgcagagtggggaggtctctgcctcagggctcacccagccgtagtttctcctctctttcatgggatgcttcatcgactcgcctgtctggatctcatgttttagggactatctggatttatcccagtctctgtttcagattggggtctctggtgtgggggctctggcattgccgaggggcctcaggagccacttccagccatacagtgtctcggtccatcccaccaggctcagggcacggctcccatgtcctcaaactgcgtctgggaccctgtctaccttcagtttctggggggcgtctccagattggggcttggcctcctcaggctcagggtcttggccatggctccctcccaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccggtgtgtggggcctcctccctcagactcagggggctgggccccaaacccctcctccctcagacccaggagtctaggccccagcccctcctccctcagacccacgggtccaggcccccagccccctcctcctcagatcccggggtcagggcccccagccccttcctctcttagatacaagagtccagacccccagcccctcctcctctgggaacacaggtgtcaggcccagctcttcctcggtggtgaagcagtggaaagagtcggcttgggcagctgtgggttcaggccctgcctctgccactctgcagcctatggtaggaagggcccctctctgccctgagcctcagccctaagagctcatcctggtctccagccctgagacccgtggaggcaccagcctggccctcagtgc

SEQ ID NO: 92239 - DNA, 1144 bp, Homo sapiens
tagtgacgtaggggacctgggcgccctccccttacgcgacctcccctcatgccggtccccaccgtgggtgggtgatgcccacactcacctccttcccctctctctctctttctgtgtctgtctgtccatccttccgtccggctgcagtggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacg

SEQ ID NO: 92240 - DNA, 1162 bp, Homo sapiens
tatttttagtagagaccgggtttcaccatgttggccaggctggtcttgaactcctgacctcaagcgatccaccttagtctcctaaagtgctgggattacatgtgtgagccaccgcccctggcctctgtaggcttctttaacccatcagagagactccctggtaaggattaggggctaattactggtgcctcttcagctgtcagtccatcctcctttatttgtacccaccttccagtcagcaaggcacaacaatgttgttacaaaggaaacaaactcaatttggcccatttcctggaaatgcaatctcccaaacaggtttgtgtgaaccaaattccattttcctttgtttcccatgtgcagtcccagttgcatttccatgggagccaatccacccacccatagaatgacttgaaaatgtgtgaagttcagaagtttcataccaagaagtttgctgagcatgatgtttgtatattgattaggagtaaaaatgttcatttttacaaaatattacaacttctccctctcccctccttccacccagtatcccctgttcctcccccaggcattctggtcactgttcctttttgttgagatcattctcggtgtctcatatagctgggttgcagctccgttctttgccaggaggtggtaatagaggattccacgcactcagaatgcctcaggccggcgcctgtggcttctctcaatggagggaagtgtcctgcagggggcgctgttggtccttcaggcaaggtcgggttccctcgaagtctctgtcttagcagttgctggtcttcagaaacattgggcaccaattttctcatttctgaaatggaattcaggtgaggtcccctcagtgctgaggtgcttcatgttgtcagaggaagagttgggaagggagcggaatggagcagaaaggcgtcatccgctgctcactgagctcagataggaggccagggatcggcagattcaggagcccactcctggccaaccccaggggccccacccagtcctgtccctgctccttacgtgctgtgtatctttaggcaagttgcttcctgtctctgagcgtcgtctttgtttccgccttcctgggcctacggcaggcctgattcctccaggcagtgtccagagttccggacagatggaaaaggaagagaga

SEQ ID NO: 92241 - DNA, 1036 bp, Homo sapiens
ctggatctctgggtggtgatggagctacaggaggtcgtggtgcagttctctgccattgctgacccctcctttcctgctccatcgtgcaggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaactgggcctcctgtcctctctgagactgggaaaccggattggaacatgctggctctgcaagcagacaaatttgtgtttctttcaatgactgggcaacttaatgatctctctgagcctcagtttataaaaatggtgttagtcaggatcattgtgagtacagaacacaaaattcaacccaaagccataaacagaattgaaagacctctgtccatggaaagcctatgaacacattgaacacagagggacttcaggctgttcaagggactctcacttctgctttcctctttttttttttggatggagtttcactcttgttgcccaggctggagtgcagtggtgtgatctcggctcactgcaacctcgcggtttcaagcaattctcctgcctcggcctcctgagtagctgggattacagccgctcgccaccacgcctggctaattttt

SEQ ID NO: 92242 - DNA, 1038 bp, Homo sapiens
gccccttgtccgccctagaacccccatgggctgccgcccgccgccgcctcggctgccacccaggacacggcagagataagcgcaggtgagtgtggccatgcctgtcttggagtcctggccttctgcagcacccccacgacacctgtccatctgtgagccctggtctgtctgttcctaattcccctgcatccccttcaacccatcttgatgcctggctccgagccatgtgtcactaattccccctctccccacatccacctctccttcctagcctcctctcatttatgtgctcattgaaccttcccttatgaacccatgtctgtctgcccagccctcctgtctccttttgtctatctgcgatctctagccatcatctgctgtccttgcccacccatccatcctcccgttcgaccgtttctctttcaaagatatttctgcccacactcctgcctgcccctcttcaccgtctctcgtcctctcgtctctcaagcccccgtgaattaattacatctcggttcattccttgtcactgtccatcccaagtctcaatccttgactttccttctgcctgcctgttcacctctccatctcttcggagcctcagtctgcccttcacattatctctgtctcccctccctgtatctctccctccctcaacttggtccccatctctgcatctccacctctccacccccagctcccaccatacctatccacctccaatctctctacccacatccatccttctctcctggccctccccgcgtctaccccagtctggcctccttggtccctggaccctccaactgctttcctaccctaagcccctgtcatcctgctcctactgtctaaaatgcttttctttaaaatgcttttcccatcctggcgccactgccccccgcctgtggctggctccatgtcatccttcaggtttgggagagccctccctgaccgcccccctctgagttcctttgtgacacattctccagctgtgtcctgtggagcgcttctcacagacagtctgacagtgaccggttt

SEQ ID NO: 92243 - DNA, 1072 bp, Homo sapiens
cttcgggaggccaaggtgggcagatcacctgaggtcaggagttcgaaaccagcctggccaacatggtgaaattccacctctactaaaaatacaaaaattagctgggagtggcggcatgtacctgtcatcccagctatacaggaggctgaggcaggagaatcacttgaacccgggaggcggaggttgcagtgagccgagattgtgccactgcactccagcctgggtgatagagcaacactcggtctcaaaaaaaaaaaaaaaaaaaaaaaattaaccaggcatagtagcacatgcctgtcatcttagttacttgggaggctgaggtgggaggatcacctgagtgcaagagttcaaggcttcattgagctatgattgtgccactgcactccagcctggatgacagagtgagactgcgtcattaaagaaacagaccaaccaaaaagacaagtgtaaatttcaattaattaaaattaatttgtaaaattcaatttctctgttgcactggccacatttgaagtattcaacagttacctgtggctggtggctaccaaattggacagtatagatatggaacatttcatcatcacagagagctctattggttctagtccagagtttcctggggtctgtattacatgcctctcactacacttcccttcctgaattgggactgtctgtttctatgtttgtctcattgattcattcattccagaaatatttattgaggacttcctttatgccagggactgtgacagatactgcagatacgacaaattagacaaatgtcccagcccacaggaagggcaagcaggccataaacagcataaattcgtaaaatataacattggtcagatggaggtaagagggaggagagagggagaatgtaatttaaaatatgggctggtgccaggcgcggtggctcacacctttaatcccaacattttgggagttcaaggtgggtggatcatttgaggtcaggagtttgagaccagcctgaccaacatggtgaaaccccatctctactaaaaatacaaaaaaattagctaggcgtggtggtgcatgcctacggtcc

SEQ ID NO: 92244 - DNA, 1534 bp, Homo sapiens
cccgacgcacagctgctccagctaaacggcccctcccttctctccctcagatgctttcctgaagagcccctaatgcagtcagatgccagccacaaagatctgcagtatacccctggagttaacagatcctcttcatgtatctcccatgcacactcacccccaaacccacatcctgctcacacacgcccctcccagcctccagacctgcgctatccaagccagtagccactggccacctggggctgtttaaatttaaattaaatagaatgaagtaaaattaaaatttcagttcctcaggctcactagccacgttcaagtgctcaggggcccacacgtgcctgccatatagggtggtgcagttgcagaccatccccatgatgggggaaacgttctgttgggtggcactgctacaggctgtcctcacacgaggttgctgccaagactttctcctattaatgttcattattgccagccttccacacccagagctgtccttcaagtgggggcaggaagtggcctccagccccagtgaggccggcccgatccttgcccttacccaagcttacctgtcccctggcttcctgctgtgccccttctttgagatcctggacctaataacacctcccacttggtcagagaccctccagcatccagactctgtcctctcacttgtccccaacaacccacctgtaggaagtggaatgggtgggtactgtggcccctaatgtctttcaatggctcatccaagatcgcccccagggggaaggctgggtgggatgtcagagtgcaagtgtcctctggaggcatctacccaagtcccacattgttcacacggaatcagagtggcccagggagggaaagggccaggctcaaggttgcacaagggcatcacggcagaactgagactgtcattggccactgtaggtcacccaggacggtccagtccccctggcccttcagaatgagctggttaatgtgtgactgtcatctgtgtttttctactgggttctctctccgttcctaggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggtgctcctgattcaggccatgaagggctggggtgggggacccagtccctgaggcatccaaggggctggggctgggaaccagatgccagggtcctcacagagcatgggggtgagaataacatggtccccaaagaggaaatggtgggggtgaaggcagaaagaccctaagggggcataggctggggaacctgatgccttgacccctgagagggatgggctgtcctcttgacccccttaaggaggcagaccagacgcctgggccttggaatgactgaacatttgggttttgaggctgacagcctgggtcccagagcaggaagcggggctaaaaggtgatggggag

SEQ ID NO: 92245 - DNA, 1068 bp, Homo sapiens
gagcagcgtgggccggggctcaccctggtctggacagaccagctcgaggacagtcttgcttctcggagccagctcaggcggccagacccagagctgcctctctctccacccgctccctccctcgccacacgtgggtccagccccctgaccttatcctcagccacgggcaccgtgtgcaccgggatcggcctccagcgggcctcggggctccctggagcagcctcgggaaacagcccggcaaggttggcctgggcactctccagcgtgcggtcaaagtccgtgctgcggatgtacacctggagcggggtggagagagggcacgcggggggtcgtggttggggacagaggtcagctgtcgtggcaaatcagaagcctcagattcactttggagtaggggtcagacactgagaatcatgtggccttcgaagttggaagttgggatcaagggtccagaggctaatgtcaggagcagttgggctggacgtcctaagctggacagccatgttggatttagggggtcaattgagtcaatgagggtcaaaaaggaagatcagaatcagtagaggctggaggttagaggtcaagtttaggagggcagcttggaggacttggagtcagagttcaatacatgttcttcagaggttaggaggactgtctgtagctgggggatgtcagaagacataggaggagacagaaaaggtaggtcagaattgataaagcgtagaggttaaaggttagaggtcaagagggcaagttacgtcaacaagggtcaaagatcgaaatcaagtttggggtcaaatgtcagaggccagaggtctgactggagtcaatgggacttagaaaacagagatggaggccagaaaataaagtcagagttgatggaggtcagaggtcgagatgtgacaggttgagatggggtcagaagtcagtgtgggttagtcagtgtatcgggggtcagagattagaggtagagggcaagtcaggttgatggaggtcaaaggccagaggtggaggcccaaagagagcgttgtagtcagtggaggtcacaggtgggaggtcagggggcca

SEQ ID NO: 92246 - DNA, 2436 bp, Homo sapiens
agtttaaacaaggacccccctcttcctacaaagcatatttctatgcaaaatggggcttttggtgtttctgaggttgttaaacagcagcacccactgagcgagcacccacagtgttagtgcttttgcggagaataaactgaacttatcctgccagggtcccagtgagaggcagctgccccttccccatgtcacagaaggttctggtgaagtcagagcagcttagaagagctgggccgggggcagcagaggcgattgaggggtatcccgttaggcatgggaggcccaagcagaagggtttggccccgtcctctcactgaaccccacagatgtgcctgtctgcaggcatctctagtcccgttttccagagaaacactgctgctggggggcggggaggggtgaggtcagtgggcctagatcatacaaggagccatacccaggctgagctggatggggaggggaggtagcctggcacccccagggaccaagtgtcattcagtttgttgcctgatctctcagcactcttctgtgatgtcccccttaggacagtaggtggtcctgggacccacatcaggagggggtgagggcaccggggcctccatgatgtccagcactgggctccgactgccactgaggacacggtgccccccgggacctttgacacccgggggtctgaggggccctggctctggggagggctggtgggtatcttggctgccctgcaccccactgaccttctcccctcccctgtgccctcctgcctccaggtgctgaagggcctgaccatcactcattaagaacagaggaggctgcctgttactcctggtgttggtgagaaggcagatgtagacaggtgcccagcaagtgctgagccaggcgctgccctaagcactgggctcattaaccttagtaaccctgttggggggcggaggtgggatgggggctggggctgggttgcagtgagatgtccagtgtccagggttcttgaaagggctgcacttggggaccccgtgatgtccagcactgggctctgactgcccctgaggacacggtgcaccccgggacctttgacatccggggttctgaggggccccactccgggaggtgatggtgggggtgtggctgtttcccccattcgtgccttttctgtgtccttcccctgacagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttataaggat

SEQ ID NO: 92247 - DNA, 1002 bp, Homo sapiens
gtgaggcagaggttgcagtgagccgagattgtgccactgcactccagcctgggcaacagagcaagactgtgtctcaaaaaaaaaaaaaaatttagccaggcgtggtggcacatgcctgtaatcccagctattcaggaagctaaggcaggagaatcacttgaacccgggaagcagaggttgcagtgagccaagattgtaccattgcacttcagcctggacaacaagagtgaaactcccatctcaaaaaaaaaaacacccatctcacaactatggaaaacttggcaggcaggcctgggtccaaaccccagctctgctgtttacaggcttggagacattcaccaggccatcactcttttgcgcctcactgctgtgtctgtggaacaggcaccgagcaaatggcccggggcactagcgcttcccgccttctgaaggtggggcttgaataagaagaggaatgcgtggactggagggaacaagcatttgcgtttcaggggaaagaactaatcaaacatgtcaaaactcagcagtggaaaagagacagtaactaccaggtgattctgtcacgttacttcatgggttttgtaggctgaatgcaatgtgtctttaagcacagcttagcctgcagtgaaccgtttatatataaactgatagaattcagggaactcctattttcacaataaaaataacaggctttatcaggagaattgtttcaaagagcaaaatcagacaagcatgagtgtgtgttatcagaaaagagacaggtgttctcagctctgggaagattttcatttgttccttaggtgtcaggagctggaaccgtggctgcagcgaaatagaactgaaagtgtgttctccgggttcttggaggtttcagctatttctggcagggaagctggcttttgggcagggttggctgggattgcagttcccctgagtatctttctgagggtcctgtgcttttttttttttttttttttttgagagggagtcttgctctgtcgc

SEQ ID NO: 92248 - DNA, 1134 bp, Homo sapiens
ggtcctacccatcccatgaggacagtcccccgaggacctgtgacactggggaggttggggcatcttggtgtctccatgagcaaaactggtcattcctaccttctggatgagttttgcatttcctactctttttgagacaagtcttgctctgtcgcccaggttggagtgcagtggcacgacttggctcactgcaacctccgcctcctgggttcaagcaattctcctgcctcagcctcccgagtagctgagattacaggcattctccaccacgcctggctaattttgtattttcaatagagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtaagtggcctcaggacctggttgcagaggggctggggctcccatgatgtccagcactgggctctgatcacccctgaggacacagtgcaccccaggacctttgacacctgggggtctgaggggccccagttttaatggcttgtggacttgcagactgtttcctcccccactctcactgtgtctttctgtgttacaggtgcagcttcaagcttaggaccacccaccatgcctatccaggtaagaacccttgctcctgctccttcactcacctgggtttaaaatatctcactgtctaggttgacttcataccgtacctctagaaactgattgatgtgccaatgattgtactcagtgtttacatacaaaaaccatctcaggctgggcgcagtggcttacacctgtaattccagcactttgggaggctgaggtaggtggattacctgaggtcaggagttcgagaccagcccagccaacatggtgaaaccccgtctctactaaaaatacaaaaaattaggccgggcacagtggctcacgcctgtaatcccagcactttgggaagccgaggcaggtggatcatgaggtcaggggttcaagaccagcctgaccaacatggtgaaaacccccatctctactaaaaatacaaaaaatagctgggcgtggtggcgggtgcctgtaa

SEQ ID NO: 92249 - DNA, 1013 bp, Homo sapiens
gccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgaggttcttaagtttattactttttccggctgtgtggaaagacgcacgtgtcctgaagggttcgaggctgcgacgggagcggccatgtagtcgcgtggaaagggtcagggcgtttgcaaggacccagagagcgccctccggggcgagcctgggagttttctgcggggatggtggtggctgtttgggccgcctgggagtttgcgactcctatagctggcgcgagcggggatgctggggcggacccccctccgtctgccccgcggcggagctcgccccttgtgctgcccgcacgccgcgggcctccgccatcttgtcgatttggttgggggagaggggtgggcgggctgggaggcgacattgagttctttccgagtgtttccattttcgtgctacctacaggtgcttccttaggaattctctcttgcttttaaaattctggatggctggcatttttgtgcaacctagaacaaagactgggggacgggagagggttttggggggttccatgggggcacagatagggtatcgagttaccaaagaagtgagagtgaagtttctaggtgaattgccgggtttgagagtcgtgtaggaatggatatagaaggaagcaaacgaggcctttgcttacctgcgggagtcgttctgaccgttcatgccacgtgagagggttttgttaacg

SEQ ID NO: 92250 - DNA, 1064 bp, Homo sapiens
tgagttttaggttaagtaggggtgatttgggacaactctaagggtgtgactgggggatgactttaggggtccctgggggtgaccttgtgagtgagattggagtttctttggggtttctaggaggtgactttggggaggtgagtaggggtgattttgaggatgtgccagactttggggttgtctgttgggctgcttgtgggtatcagcagagatgactttggagggtgaccaagaggggtatctggggttgactctggggcccctgtccccctctccccagttctcatccatatgagcaagggcttcatgttactggccgtggccctgtgctgagtcctcctcccgcccatggccctctcctcctggccagtggtcctccgcctgaacatggccgactttgtcttcagtttcctctgcctcggcattggtaggtgttggcttggggggcgggggccctccctaaccccagccctgctctctggctttctggaggtgtatctagacttccgtgctgctcccctcggggcctctgtcttagcatgtctctggggagctctgactcagttctactctatctgtgggatgtctctctctcccccactctctgtttccctttctttttttgtcccctctctccaggtatctttctgtctgttgtgagggcgtgtgtgtgtgtgtgtgtgtgtgtgtgtgtgtgtctgcttgtcacggagggtgggagaggatgtctcagtccctcttttcttactgggggtcatagggctcactgtccagccttctgtctctggccccaccccattgcagggctcctgatttctcttcagcctgacgctcttttcagttaacggcaaggcggtgcacccaagtccggtggtgtcctacctggtgacctcctacctgtgctgggacgccagcgacttgatgctgcactccggtgagggcggggcctcgggaggagggcggggcctcgggaagcgggtggggcctagggtgggactcggagtacagcggcccacctagccatctcccaggagccgtgtcctacctaagcccagtgggcatgt

SEQ ID NO: 92251 - DNA, 1055 bp, Homo sapiens
cccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttttcacccctctgtccttttgagctcttttttgctctgtctcttcatttgccttttgcactctcaaaatctttcatcttcccattcgctgtctgtatttctccataactatatctttcttcctctgtctccgcccacccacatttttctctttccctttctctctttggggaccctcccccatgctcccctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaattgtatgtgggggcagactgtgtagcccaaggcggggatggggactcctgcgtccaagggagaaagggccagggaagcaggtgaggtcgggctgcagccctttttctcccgggttcgtagtctcatttccagatgatctccagtgtgtggacctcaaaatcctgcctaatgatgagtgcaaaaaagcccacgtcca

SEQ ID NO: 92252 - DNA, 1034 bp, Homo sapiens
ccctcctctctctctggtctctgtccctctctctctgggtctctgtcaccctctctctctgggtctctgtcaccctctctctctggtctctgttccccctcctctctctgtgggtctctgtccctctctctctgggtctctgttcccctctctctctggtctctgttccccctcctctctctctggatctctgtccccctctccctggggctctgtccccctctctccctggctctctgtcttcctctctctggggctctgtccccctctctctctggtctctgttcccctctctctgggtctctgtccctctctctctgggtctctgtccctctctctctggatctctgtccccctctctctctgggtctctgttcccctctctctgggtctctgtcccctctcctctctctgtgtctctctcccccctcctctctctgtgtctctgtcccccctcctatctctgtgtctctctcccccctcctctctctgggtctctgtccccccctctctgggtctctgtctccctctctctggggctctgtccccctctctctctggatctctgttcccctctctctgggtctctgtctcccctcctctctctgtgtctctgtcccccctcctctctctgggtctctgtccccaccccgtcccccaggtctttgcacaccctctctgtcacagtgtctcttctgaatctgtgaatgtcactcctcgcagtgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatggtaggtggcctcagtgacccaggagtgcaggccccagccctcctccctcagacccaggagtcc

SEQ ID NO: 92253 - DNA, 1107 bp, Homo sapiens
gggtctgagtggggaggggctgggcctgaatgctttctccttctcagctccagcaggagaggcccttcctcgcctggcagcccctgagcggctcagcagggcaccatggcaagatcccttctcctgcccctgcagatcttactgctatccttagccttggaaactgcaggagaagaaggtgaaagctggactgggaagtctgacctcacctcagggcccccactgaccctctccaaggagtccctgagtcagaacccttccctcctcaaacagcttccatcctgggaggaccagactgtcggctgaagcccccgctcttcctgcttctgctgactcagggggtctctgtcccctccaggccctgcctcctgtgctcagggtctctctgtggttccccagatgagatgcgcctcctgggtttctgagtgggctccttctgtctgtctctatccctatctcttgctttctctgtatttctccacacattttcatctgtctctgtccatctctgactctgggaatccctgaggtgcagcctcagccttcccctaatgctagctacccacgtgctcctccatgtctccatccagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaagtaggtgccgcccaagtctctgctggaggtgcaccagcgtctccagctcgctatgggggtggaagggcagtctttctgtgcctacggctctattctcctctctctgggtctctgtcctcctctctctgggcctctgtaccccctctccctggggctctgtccccctctctccctggctctctgtctccctctctctgggtctctgtccccctctctctggatctctgttcccctctctctgtgtctctgtcccccattctctctaggtctctgttccccctcctctctctctgggtctctgtccctctctctctggtctctgtccccctctctctctggatctctgtccccctctccctgggcctctgt

SEQ ID NO: 92254 - DNA, 1027 bp, Homo sapiens
ggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgtgagtggatgatgggggcagaggtcagctggggcttaaggaaagagggggctggggtttcgactcaggaaggagagagctgaggactggactcctgggtctgaaggaggagggggctgggggcaatacccctgcctgggtcccaaactatccccaccattacaggaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgaggtagtgggcttgtccactaatgggagggagaggaggagctggttggcccagtggaacccaagctattggcaaagcttggtcccccagagggagacaaagaagggaaagtgatcatgatgttgagattcacaagcaggagtcatatgagaagcctcgaagatctgactactaacaagagtggtgagagaaagaaccaactagcagattgttaagcagggccagaaaagcccatcctgtatggcggagagcactaccctatgggacctttggttgtataggattttatataatcttaacacacttgggatatttggacttctcagaggcccaggaaaacaggctcctaagcaccttctcccccacctccctccttttttttttttttttttttttttttttttttttt

SEQ ID NO: 92255 - DNA, 1041 bp, Homo sapiens
tggcttctatccgttgcaggcaaccacctcctcctagagctcaaggagaatcagcgggagaggagtgacgggcccagaaatgcggaaaaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgcagtggaacgagaggccgttgaagagcgagacctgccagggctgcgagccgcgcgcgcacggggagccataggcttcggggtccaagcgcgtgtcgttttgggggagcagcgccgcctctgcggctggagaaagaaaggggacggaatcaaagcacggagggcagggtctgggtttggggttggagctgggctgtggcactggactgcgttcggggacgggggacgcagccagaacgcgagggtggtagggaaatattgggggtttcgcgtgcaccgaagggaatgggaggagaagaagcgcgtgaaagtggaaggaagctgggatagggtagcgtggagtaatgagacagaatagggtgggtctggagggcagggactgaacgcagcgcgcctggagagctggctagaacgtcgctggtcgatagaggggcggggattgaacgcggcggggaggtaagggtgcggggatagaactcggggatcggggagaggaaggggtgtgaataacaaaacgggattgaaaaccaggagaggggtggggcgcagtggtttacgcctgtaatcccagcactttgggaagccgaggcggttggaccgcttgagctcgggaattcaagaccagcccgggcaacacagcaagacccagtctctacaaaaacaaacaaacaacaacaacaacaacaaaaaagtagtcgcggaggcatgcgcctgtagtca

SEQ ID NO: 92256 - DNA, 1028 bp, Homo sapiens
aactcgtttttgagcctaaccccatcctttatcccacccataatcccagctttatcgctaaacctatcacctttcccagtgcctacccatcctgtctcggccccactcctaagcaccgtccccacctcctccctggctaacaccatgctcaacgctttctctgaccgacattctctctccccgtgcccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatctactgagtgcttactatgtgctagaccctgatccaatggcttttattttattttattttttgacagagtctcgctctgtcacccaggctggagtacagtggtgctatctctgctcactgcaacctccacctcctgggttcaagcaattctcctgcctcagcctcctgaatagctgggattacaggtgcctaccaccacatccggctaatttttgtattttttagtagagatggggcttcaccatgttggccaggctggtctcgaactcctgacctcagatgatctgccctccttggcctcccaaactcctgggattacagacgtgagccaccgcgcccgcccggctttcatttattaattaaaagaaat

SEQ ID NO: 92257 - DNA, 1080 bp, Homo sapiens
aaacgctatgacctccaatctcagatatgtgattttggatagaatcccaatttccatcctcagattttgaccagattgtacaacctctggatcccatgaccttaattctacggtgacctctaaccccagacccatgacccacaatgcccatatcctatacatacatatatatatatatatgccttttgctccagtgtgatgacctctgacacactctgacctctgacctctgatccctgacttcatacccagtcctttaacccctttggctcccaagaccccaatccaccataatctctgaccccaaaccatgatcctgatgtcccatcccacaccctgaccctttacccatccttcctctgaggtgtcatgattcgacctctcgccctgcatcccagacttgtacccatcctgacccctgacccctggccctgggccccttactccgtgggtggttggtgatgccccagcctgagacgtggcactcggtgccagcggttgcacagtcattgggcaggggcaggggttgaacgctgctggttacgcggacgggcaggcgcagccgcagcagccggaggtcgtgctcgtggctcgtcgaggctcccaggtagccgggatgggtcacagagaagccgctgtgccggatctgctcggtccagtcgagctggctgaggctgtgttcccccaggcgcacccagtacctgctgccggtggcgacggctgagcgggtggcaggcacgcagtcccccaccttgcacccctccacggacactcaggcgctcctgccgctccccactgttctgcccctcactgtctgtcctctcacccgcaactctcattctccgagtctctcttacaggctcttattcccaacctccatcaccctctttccatcttgggtgttccctgtttctcctaccatgtccctgcatctgtgtctctctctctccttttttttttttttttttttttcaagaccgagtctcgctctgtcgcccaggctggagtgcagtggcaccatcttggctcactacaacctccacctcccaggttcaagcaattcacctgcctcagcctccc

SEQ ID NO: 92258 - DNA, 1063 bp, Homo sapiens
tccgggagaactcaccaagaacacacaggagcaaaaagatgctgagccccatggtgggtcacttccaaagtctgggggaaaaggggaatctcagaggtcaccctttccctgtgccccccacctctgccctctctgcttctctttgaaggtcaccaaggggatgacctgcttgtcctctctctacctgctcccctgtgtgtcactccctcattggcagtcgcctacctccttctcaccttgtctctttgtctgccagatcctctacgtggctgtcactgtttggcctgtcctcgtcgctgctatctctccgtccacctacctgcctgtcttctcatgtgctggccactccgccagccaactctaccactctgcacctggctcctcagccacctgtcatgttgctcaaccggtccctttccttccatctgtcgctccagacagaccactgacaaagctcttaactctctttgtcctggcccatccagtttccgggttaagggaaggggaccacgaagacaggggtggggcgtgctctaattctgcagaaactcttctcagctaatcacacttaattgagctttacagctaaacggagtggggaaggaggaaaggacccagggtgggaagacccagccccactccctctctcctctgcaagcccgtcagcagccccaggactgatgactcaaggtgactagggagctgggttctaatcctgactccagtgacaaaggagggtggggagaccttggacacctggggcccatccccatgcagtgcaggggaggggcagggggaaggagaggctgtgaaagcaggagagtggacgggaggggcaggaagcccaagctagaaagagtcccagaaagagaagaagagttgaaggaacagacttccaaataggtgatcaggcaggggtagaagagagtttctgaactgagttcatatatgtacatatgaagtggatcaatctaattccataaagtttttctttgctaagaacttctattgcttaaataaaacccacagagagaaaaaaaaaagacacagggaaggagaaatg

SEQ ID NO: 92259 - DNA, 1031 bp, Homo sapiens
tggggtcaaagaggctggcaagggccagacagcacagagtcctgcacaccttgggaaggctttttggattttattttaaagaaagttgagcctgggaacaacatctgactttctttgtttgaagagtcctcagcctactttgagaagactggatcggagggatgtaaaagtggaaggatttaggttaatgttgtagtcatttgggctacagaagatggggcatggaccaagatggtggcagaagtgtggagataactggatatttgggagataaaaccaataggaactggttgtgagtgatgaaggaaagaagagaagcaaagatgactcccaggtttggggctgagcactgaggtgggaaatactggagcgaacagttttgattgagaagaatcaagttgggaatacaaagcttaagatgcctgtaaggcatccaaatcaacagtgtttgagttttgagcttaaagaagagttcagggctggagatgattagcctatagctggtatttaaagccatggaggcaaccagtatatatgcagtgaaaggatagagagatgggtggaaagatgattggatggatgcatggatggatatatggatagatggatggatggatggttggattggatggatggatggatggatggatggatggatggatggatggatggatgaataaatggaccagtggatggagggacagatgagtggatggatggttggatggatggatggatggatggatggatagatggttagatgactacctaaatggatgaatggatagatggatgagtagacggatggacaaatcaataggatgaatgggggatggatgattggatagattgatggatagatattgcctaggtggatgtgtaggtcagtctcacttctacctcctgaaatccatcttctggtagaatgatataaaaaatgcatgtggagagaaagtcaggctcctgcttacctatcagcaacatcctcattttgtgaactcttctgttaacccccagtggaggatttggta

SEQ ID NO: 92260 - DNA, 1021 bp, Homo sapiens
gccctggtggcccaggccaatgatacctaccttgtcctgatcaggactgtaacaagggtggcctccctggaggttgtgacaaatgggccttaatatacacccccatccctctggagaggacacaacctaatcctgggtataacctgcttgtcgctccctctctttacccatgaagccagcttcttaagctacttctcttcttcttgcataatgggtgcaatccaagaagccttccctaaggcagtggcttccttacaccggacctatttataaccatcctatccccagcgctagaagaagctactccactcgcgcacacgtctccctggtctattccgggcagaggtgcaatccagacaatctccccgatggcagggaccctgcaatccggaatccatatgtaacccacctcctctctctccctgtctaggagaagccgacccctcccgcaatgcccgccccgccgtgcgcctcctgccatgctgcacgcgccgccctccgccgtccgctctcgggccaagcgctgtgcggtgcctgcttctgcgccgccttcgaggccgaggtgctgcacacggtgctcgccggccgcctgctgccgcccggcgcggtggtggccgtgggcgcctcgggcggcaaggactccacggtgctggcgcacgtgctgcgcgcgctggcgccgcgcctgggcatctcactgcagctcgtggccgtcgatgagggcatcggtggctaccgggacgcggcgttggcggccgtgcggcgccaggcggcgcgctgggagctgccgctcacggtcgtggcctacgaagacctctttgggggctggacgatggacgccgtggcccgcagcacagccggctccggccgcagccgctcctgctgcaccttctgtggagtgctgcggcgccgggcgctggaggaaggggcgcgccgcgtgggagccacgcacatcgtgacaggtgagcgtagtacgggccgcagagcggcactctccgaggcagtggggcgaatgcacaggcga

SEQ ID NO: 92261 - DNA, 1089 bp, Homo sapiens
gctggatggttctctccgtggtcacaccagctccggggaacgtcacctgacagatgaggttggtgccgtggtcctgaggccgtgggatgatcgtgagcactgaggagtggagggtcctggggcccagggaggtgggggcagctgacatccaggagaagatggggggtgttccctgctcacagacccagggcacagagcaggtcaggttgctgggatggccagactttaggaactccgggatgaggatgtcgggcctgtgggtcagggctgttgtggacagaggtggggacgcaggatcaggagggggatccaaggtgcagccctgtgggaagctcaggctctggtccagttcctcccctgagcctgacgtgctttattcccatccccattccaggacatgagtcccatctgagcccttcccagtggcccccataaccttccccttgtgccactcctggagcccgtgccttacctgtcacatacacagagagcggggaatatttgtaactaaattttgttcttcctctcgccacccaaaagaagtatgaaccgttgtccctcctcctggcgtctctgatgctcagggagcagttgttccttgagggatcaccgaggaggtggaatcggccctgggtctccttctgcactttttgagttgagttgtttgtggccactggagtctcctggtctacactgaccccttcccggaaccagtggccataagcaggggtagaatctttccagccatactcgaggtagaagaccgaacagtgcacaaagatgcacagaccctcctgcaccgtcacggactctggcatctccagccggaatcttgcatcctgagcgagggccctgtggagacatgagggtcagatgggctcatccccacggcccctctccccagggccactcacctgcccacagcaggggcagcggcagcagcagcggcagcatctctgaggcagaggcttcctgggcttcctgtgtgagcagagaagagggctgtggggaggagcatgagatcttggcagttcacagaagaggaacctcaaacccacacgtggtcagaggtcatccgcctctgcacag

SEQ ID NO: 92262 - DNA, 1041 bp, Homo sapiens
tgcccgcggtcggaccgggccacgcaggcacctacgcctgcctggcggcgaacccgcgtaccggccgccgccgccgctcgctgctcaaccttacagtggcgggtgagaggctggagcgggagtaggggaatgcctgggagaggggcggggccagaacgagggcggggctagaggaaaggggcggggccagcaaggaggagcagcataccggtgggtggggcagggccagcgggagggcgggtcaccaagaaggagctgggatacccgtggtggggcgggccagcgcggaggggcggagacacctaggataagaggcggggccagaaagaggataagggaaggagccaaatagagtggcagggatgaccaggactgacgggccggcccagcactgagagggcggacattcctgggcatggaacactcgacaaagtcgacaagcggagttaaatggcaaagagtgggagttagaaaaggaaagaactaatttgcttaagtgggatcagcaaagggagaagttacctggcaaggggggcggagtcaccagggaaaggggcgaggtcatttagaaagcgggcagaattgtcttagaaaggggaaggggtccacaaggaagggcggagatatctgggaaaaggggaggcttctcggagtgcaatccaggagggggcgaagtaacctggcagaagtgggtggagctggaaaggaaggggctgagttacgtttgggaagagaaatatcattgtgtgaagatgcagttttcttaagaaagttgggcagtcagcagggctgcgggctacccacttagcgaggaagttaatgggaaaagggaacgggatcgcaggaaaagtggggagtgtgagcgcctatggggtggggctagtgaagaagggtggagtcaccgcgcggggaggcggggctggagaagaaatgagaaagggactccatcttcattctctcccttctctccgcagacctgccccccggggccccacagtgctcagttgaagggggtcccggggaccgcagcctccgcttccg

SEQ ID NO: 92263 - DNA, 2244 bp, Homo sapiens
ctctcatctgtaaagtggggataataacatttacctcataaagttcctgcgaggattcgatgacttgatacatcagttgcttagcacagggctcagcactcagtacatgttccctgtcaggaaggcagggaggcctcactggcagcatcaggacatgggacatcaggacatacaccgtggctctcagggaaaggaaaaagaccctctcccaggtgtacaagctcgattctaaacctcatgggaccctgcattgttcgctccctcattcattcactagtccatgcgtgtactcagtagtggcataagcagactgctcgggtcggacctgaattagcctcacccactctcctcctacactgtccctccccagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatggtgagcccctggccagcgggcactgagggcctgggggtggcaagcacattgccagcccagtgccccccggtggtcgcacgtggggagggaaggatccaaaggaggtctcgtgcacaggaagccgtcacctggagtttggctgatagagagagtttgctgggtcatctctgccaatactgagagttcatgggggctgctttggctagcagggagggcttgctggtatctaggccagtagaaagccttcgctgggcagcagaaggtgttccctttgtcattccagccagtggaacaagttcactgggtcatctaggttcattagggagggtccccttggtaatttttgccaatgtgaagttaccatgtagatcatcttagttaactaggaagggtgcatggggtctcttggctaacaggtagagttcactaatcatcatggccagtagatgggttcgctgggtcatcttggccaatattaacagtttagtgggtcatctccgccaatagagaatattcatctcagccaacagggagggttcactggatcatctcaactaatggggagggttcaatgagtcatttcagccattacagagtgttcactacatcatctcagcctatagggagggttcagcgcatcatctcagcctatagggagggttcagcgcatcatctcaacctatagggagggttctgcgcatcatctcagtctatagggagggttcagcacatcatctcagtctatagggagggttcagcgcatcatctcaacctatagggagggttctgcgcatcatctcagcctatagggagggttcagcgcatcatctcagtctataggcagggttcagcgcatcatctcagcctatagggagggttcagcgcatcatctcagcctatagggagggttcagcgcatcatctcagcctatagggagggttctgcgcatcatctcagtctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagtctatagggagggttcagtgcatcatctcagcctattgggagccttcagcatgccatctcaaccaaaagtccactgagtcattactaccaaaaggatgggtttgccactctgttgcagccagtgaagggcttcctgatttggttacctaaaggaggactgctgcagtagttgggcctcccagggcctcctagccagcaggagttgtccacaccaggtgtggccctgtgagaagtttcgcgtgtcctggccagtgggtgggtccagagggttcagcccatgggactggtctgcaggcctggcacccatgggaaggaggtggcaggaagggtggcaggagttccacagccctgtgaacaatggcttcccatgtgcagaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaac

SEQ ID NO: 92264 - DNA, 1042 bp, Homo sapiens
tgcgcgcgtgtgtgtgtgtgcatgtgcgtgtgcgtgtgtgtgtaacaccacatgtgtgggtctgtgcaggggtgtgtctaggggcaaagtgtgcccacgtgtgtgagctcatgaaagttgtgctgagggtcctcccccttctcctctccccgacccctgctctgggagtttcttgatgtgcccgtggatggggatggtcccagccccctccccgccgctttgctcctagctgcccttccctcagtcctgggaagctcatccagcatccagcatctcttacccatgaggaagaccctcctccacaggctccatctgggtctggaaaggtccatgagctgcctggggtcctccaggaggaggggtccctccagagacacagccacctcctctgctccctccaagacctgtgtctcctggcacagaggctgccggtctcgtctcccagccttcagggcggcctttcctccccagggtgcactctgaccagcaggggtggggcctggggaagacggctcttgagagcccaaccttatctttatggctttatgttgcctttagttcattatttatttacttatttttataataatttacatttttttctctggtcatgaaaaaacggaaaaacacaggctcactgttgggaaaacaaagaaaaccagaaaatacagccaagtgcctcaaagataggacatcaaactcctcaactgtatgtcctgtttccatttggtttggttttcctatgcagggcccagctttttttttttttttttttttttcacggagtctcgctctgtcaccaggctggagtgcaatggcatgatcttggctcaccgcaacctcgtcttccgggtccaagtgattcacctgcctcagcctcccgagtagctgggactacaggctcgtgccaccacacccagctaatttttgtgtttttagtagagacggggttacatcatgctggccaggatggtcttgatctcttgacctcgttatccgcccacctcggcctcccaaagtgctgagattacaggtgtgagcc

SEQ ID NO: 92265 - DNA, 1122 bp, Homo sapiens
ttaaccatcccactgcccaatctcttctccctgcatagttcaccgctgatacctgtttccccaacttcacttggtagcaaaggatgactatgtaccaggaattgacatgcagacctctcatttttttacctgtccctctaggtaaaccttaatatcccttataaacacaaagagaagggaagttgctagaagaaaccccacagctatttagaaccatggccgactctaaaccctctcttgctcccatcagcttcaggtcctgggggctgatctgtctgccccagatgatccctgacaacctagttcctggcttatccctccccttctggctctgcttcccctctggagggagggctggctcctgagtcccagcccccagccaacatcccacccttgtcccagagcaatgagggcacctgattgagtagtggttgatcagagcatggatcaggactccacagatgtaaacgccacccagcactgtcagcatgatgaggaacatcaccatggatcctgagatggagaaatctctgtggacaacaggtaagatccctgaaggaagaggacacctgggggtcaggaccacgattgacccattcatgcattcactcatctcttcacccacccacatatccattcttcaaagatttgtcaacatctattatcagcaaagcactgttccaggtacgagggattcagcagccaacaaaacaaactccctgtacccatgggcctgacattctagctgggaagtggacagtggacaattaagcaaagagatgtctcacactgcaagcaaccataagtgaatagagaagaataaaccctcataaggggagagacagtgactggaaggggggtgtgtgacacagggtcattaactcattgcataaatgttcactgagcaccaactatgtgctacacactgtgccaagcactgaggacaaatggaaaacagaaagctcgcccaaggtggatcacctgaggtcaagagttcaagaccagcctgggcaacatggtgaaaccccatctctactctattttgtaaaaatacaaaaattagctgggcacagtggcgtgtgcctgtaatcccagctactcaagaggctgaggcaggagaat

SEQ ID NO: 92266 - DNA, 1033 bp, Homo sapiens
gctaacacttggcattaacaaaattggtgaatttatagccctactgataggtgaaagggctgtttcatttttttttgtttttggttttggtttttttgagacagagtctcactctgtcacctaggctagggtgcagtggcacgatcttggcttactgcaacctctgcctcctgggttcaagtgattctcctgcctcagcctcccgagtagctgggactacaggcacccgccaccacactcggctaattttttgtatttttagtagagacagggtttcaccctgttagccaggatggtctcgatctcctgaccttgtgatctgcccacctcggcctcccaaagtgctggaattataggcgtgagccaccgcacccagcctgtttcattgcttaagtgttatttttctaataactgaatggtgagagcctctcatcttatctgttatctgattggctttttcatttgtttgttgcattttcttaccgcttatctctttacgtccatggagttttctgccttttttttccagtttttttgcccctaattttatttattttcttttctttgctggatctgctgtcttcttttcctcccagttgtggcacctctagcttggggccctgttcttccatatgggcatcttttcttttttttgaggcagagtttcactcttgttgcccaggctggagtgcaatggcacgatcttggctcaccgcaacctccgcctcccaggtttgagtgattctcctgcctcagcctcccaagtagctgtgattacaggcatgcaccaccatgcccggctaattttgtatttctagtagagacggggtttctccttgttggtcaggctggtctcgaactcccgacctcaggtgttccgcctggcttggcctcccaaagtgctgagattacaggcgtgagccaccgtgcccggctatgggcatcttttcccacaggaattgacttaaaggacccatccattctgaactcttagtcctcatatttttattctaatgatttatatatcagtacc

SEQ ID NO: 92267 - DNA, 1053 bp, Homo sapiens
gagatcagaaattggaatcatcatcatccaaataaggaattctcacctgataaattttgtgagatttttctgtttctgggctcagaaacacagtcctctaatttaatttattactttggaattcttaccagtttttcttgttttaattaagaaaaaagtgaccctttttcttaatcccagtggtattacaacaaactagatccccattttctcatatttagacaattttgttcccagtgagatatgttgatttcaggtttttgagtttagtcaagatactgacagattttatgaccccaaacatggctattttgtttcttttttcctcagtagatatgataaaaacaggcagttctatttcctactgtgtaggattaacaaattcttttcagtgatattgtcctcatggccacatatttccaatttaaaaatatacctgaatagttttcatcactcatgctctgctccattgtttttgtatgttgtttaatgtctactccatagaatgattcactttgcatacactctgctgattactttgtactttcttaatcttcattatatcaatgtttagcatgaggaaaccattgtatttaagatataggattaggatttttgtatttaggatacagaaattactgattttctgaaaatgggcagaaaagaatatttcacagtattttaaaaggatgctttaaatatttgctgagataaattcaaaagaacggagattgtatttggatggagaggacaatggcattaaatgttaaaagtattagcctttgtgcatcaatcatgtctatttcatggaaggctactcaaaaagtaagtgtatcaacatgggaagcatggatagcaaatgctggtgaagttcagaaaaatgatgtcagcctagaggtggagtgacattgggaattaattttaagggcatagtacctataactggttcaagaagccattttgaattgaaacaaagaagcagatgaagcaagcttaatgggaatagaggacatgagagtgtgcttggatttgagaataaattggacttctttt

SEQ ID NO: 92268 - DNA, 1050 bp, Homo sapiens
cccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcagtgaatgtgggaaagcctttacccagaagtcaacactcagcttgcaccagagaatccactcagggcagaagtcctatgtgtgtatcgaatgcgggcaggcctt

SEQ ID NO: 92269 - DNA, 1153 bp, Homo sapiens
agcctcatctcctgtgctccttggctcctggcttcggaggctctagtcagacttaagggctttgttgtcctcccagcacctccttggtttcctgccttgggccttcgcttcagctgtgccctctgcctggaagggccttagtggaggtcatgccacaaccacgccttctctggaggtcctctctgccgtctccagctgccaggattcctcccgccctgggctctcacagcctctggcctctccctgtgtcatacccagatcacccgggattgggactgtctgcggctggctctgtctcttccatcagactgtgagctccatctgcaagggcagattcgggtctgattcacctttgagcccccagtgggtgggggtggggggtggagatactaaagctggtgggggcgaagctgggagagcaggaagggggagagagagacgggcagaccctgactggttcggggagagaggggaggagaaagcgagagagaggaagaacagagacacagagacaggaagggagggagagaaacagagaaaagggaagaataaatgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtcc

SEQ ID NO: 92270 - DNA, 1011 bp, Homo sapiens
ggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaagggggcgggaccagctagttgccatggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtgaccttgaacaagtcctgacccttctctctccgcctcagtttccccaaggagacactggttggcgggtgggggagatgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctgactctcgcccccgcctgagggtctgggaggttgggaaggagggaagggggaagagagctggccgtagacccgtctccggcccccgcctccccctttcctcctccgcccctttcccgcctctcctccccctcctcaggtcgctaccccagccctgggccccttctcaaaccacccccaccccacc

SEQ ID NO: 92271 - DNA, 1065 bp, Homo sapiens
tgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggcc

SEQ ID NO: 92272 - DNA, 1071 bp, Homo sapiens
caggggctgaaggtggtgagggggaagggacgctgcagaaattgcctagagctggaagtccagatggggtcgggtaggcataggttctgccatggctgcatggctcacactcttactggctatgaagttctgggtgtgtcactgcccctctcctggcctcaacttacccatctgtaaagtgggacaatcttcttgcctcctaggatggccatggagctcagtgcaggggttggggctgcctgatgagcctgatcttagggaaggcatcttcctctaggatagaacacacacacactcgcacacagacacgctcagagacatacactcacactcacacacacacacagatttcttataaagtgattccacatttttgaggtgtgaggcaattagagggcgggaaaacaggaacagcagagtggatcactcaggtgacagcagtgaaaagagacaaggtgtgactgtcctggtgagacaggcacatgtgacagccttgaggtgtgtggctgtgcgaagagacctcagggctgggggccacgcaatgccgatgggcagcatgggcggtaatcatgcctgatcaccatggccatgatccccacgaggtgccagaccctggaactgtggaggctcggagttgcaggagttacagagccctgcgctatagaataaactggcttcctcttaggtccaggagctcagggcttattcccacacccacagtcgctccttttgcttcctgctttgccctccaagcgtcctgtcaacaatcccggaagagggaaggttcccatccacccagggggcatccagggccagcctggagaaggcctcagctgtggctctccccatctccaccctaaagggagacctgaggccctaaacctctccatgtgggggtgtgcaggattccaagaaatgccctttctccccacataggctgccttgttacagaagcttttgaaaagatgaggaacctttggatctgggaatggaagccttctgtggggccgcatgggggacaaacttggaggggagagagaagaggctgggtgagggtccaggccagagcgg

SEQ ID NO: 92273 - DNA, 1022 bp, Homo sapiens
ttaaagtgtgtcagattgggttactcctctacccagaatcctttagtgactccctgttgccattgagacaaaatccaattccttgtcaaagcctcagaggttccacaggtctggcctttgctgacctcaccagcagccttgtcccatacccctttcctccttgatcttgccaccctgcggtttttctctggcctttcctccttcctcgcattcatcatgatacttcttgccctctctagggtcttggttcacactgtttcctgcctagaataatattttctccttttttttgtctagttaactcttatgatttcccctgagtagccattacatctattaaccccgctaatccccttgacaagtctgcgcggctggcactgtattgacttaactgactctacctctccctcaggccccttgctactttccagccccagtggcctccttattaggtccctggaacatgcaagtctcagtcccatttccaggcctttgctgtgcttcatacttgaaatgactttcctctgagtatcacaaacccacctctctcattgcacagatcccagatcaaatgtctccttctctaactacctctctctccctgtttgacattgcccaatttcaccttgttcactgagctcatctggacctaatgttaactcttttttttttttgagtttcgctcttgttgcccaggctggagtgcaatggtgcgatgtcggctcactgcaacctccacctcccgggttcaagcgattctgctgcctcagcctcccgagtagctgggaacacaggcatgcgccaccacacctggctaattttgtatttttggaagagacagggtttcgccattttggccaggctgatctcaaactcctcacctcaggtgatccacctgtctcagcctcccaaagtgctaggggattacaggcgtgagccaccgctcccagccgttaactcattttttaatttggttttgcctttcctacctgaaagggaagctccttttgagcatgtactca

SEQ ID NO: 92274 - DNA, 1047 bp, Homo sapiens
gaatcctgtcctcaacctcatacgcactccaacttgcctgtcattgaactatacccactgtgactgcaaacctgcccaccccagtctcatcaccaatcccatatccattctcagccccatccaaaacccactgcaacctcaaacctggctccaactctgtctttgactccaagcctatcccatcttcttccccagccccagccccaatcgtcatccatatcctttttccaacctcactccccacaccaaactcagcttgagcccaagcagcatcctcaccgccagcttccagttttatcccatccccaattcctgccctgctgcatctttgttcccaaccccagtcacatcctcagccccatccggcttcccttctccctttccaccccatccacagccctcccaatctctgcccctgcttacctagaggaccgctgatgcaggatacacagtggaagtagctctgacaagcccgctccacattgaaggctacccagtatcgcaggctgcttaggaagctgacccaggagtccagagggttaaggatccgcacgtccccaccaacagcccctacccgggggtcctcgtccagtacccgcacgagctccagcagtgccatggggtccaaccttgtgtccgagtcacagacctgtaaggtggaaggggccaggatcagcacagacccctgcatcaggctgatgcttgagaggaaggcatcaaggggtgcaatgcagctggggcactctgcaaccgatctgaacataattttgagattttttaaagtcattttcaatgtgtagtcacagtttaacatgtactccaagatgcacatccttgtatgaacatgaacaataagacatataccatctcctctggtgtgtgagtgagacccctaacttgctactaagcaatagaatatggcagaagttatgggatataactgccatgattatattacctaatatggaaatggtgaataggttttgcaatgtaattaagtccccaaatctcttgactataagttaatcaaaaggagattatcctggg

SEQ ID NO: 92275 - DNA, 1044 bp, Homo sapiens
ggctcatagaaactatgagataataaatgtgtttcgttcaagctgccaaacatatggtaacttgttatgcagcaatggaaaactaatataatgcattagaattgctacaccaggccaggtgtggtggctcacacctgtaatcccagcactttgggaggctgaagtgggcagatcacctgaggtcaggagtttgagaccagcctagccaacatggtgaaaccctgtccctgcaaaaatacaaaaattagccaggcatgatgacaggtgcctgtaataccagctactggggaggctgaggtgggagaatcacttgaacccaggagacagaggttgcagtgagccgagattcaaccattgcactccagcctgggcaacggagtgagattccatctcaaaaaaaaaaaaagattgctacaccaaatgggatggatgaatgagataaataaatgaaattaatctgtatattgaatacatagatagatggctgagtggttgaatgaaagaatctcaacactgaaggaggggaaaggaaggagggaagaaggaaagaagaaagggaacaaatctccacatttaatagataaatgaatgaataaatgagtaaatgatctccatattggatggatagatggtatatccatgagtgagtaaagaaaaagaatttctacactgaatgaagtaaggaagaacttttatttatttatttatttgagacggagttttgctcttgttgcccaggctggagtgcaatggtgcaatctcggctcaccgcaccctccgcctcccgggttcaaaagattctcctccctcagcctcccgagtagctgggattataggcattcgccaccatgctcggctaatttttgtatttttagtagagacagggtttcaccatgttggccaggctagtctagaactcctgacctcaggtgatccgcccacctcagcctctcaaagtggccggctggaagggtttaattttacattgaatggatggataactgaatcagtggatgaatgaacaaatgaatctctatattgaat

SEQ ID NO: 92276 - DNA, 1375 bp, Homo sapiens
gcaggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggca

SEQ ID NO: 92277 - DNA, 1046 bp, Homo sapiens
ggaggtgagggggctgtgctctgtatggggtttgatcagggatgggtctgtgtcctgaagggaagcatagtccagcccagctccccactgttgcagggtgtgtgggggcttctctgggaggggaacaagttctgaagaaaagggtgaaaaacttacttggtctttgtgtaggagtttattatgcttgcatccccctggtgcactgggctgtctctccacatgctgaggccttccctgtgggcatggttgtggcacagaaaggaatgtgttgtttccaaggattaaacaacatatttttgactttcagatttgacttttaaagaattaattatattgactgagagagaggcccaggagagaaagaagaaagaaaaggagccagggatggctcttcctcaggtaaagtgataatcttggtggattgttctgtctcctccctttttgaaatgcagggcattggagctgcaaatcttctctgagtctgaagtatcctgcctgacacatttgctcgcactcacccatgccttccttcagtccctctcttctgcacttagattccagatctcacagtgactcagtgacatgagcttgggaagaggctccactgggcatggtcctgggaagggctcacacccagacatggatggagacagggtgtgagttctgtggtgtcagcttttgggcagcagagattgtttaggggcaacatctgaatgcactgtcagctctcagtagaccaggagtagagaagctgtatgtggaagtcacatgttaatatgcaaaaatacctcataaattcttgaaaagatgcctctaaggggagatcttttctgcctgattttataccacatttgaagctataatgaatcagtcactctttctaactccacaatcttaatgaccgggaatggaatggaaaactaggtacagacatcagtgatagaggttgttttattccatcattgattttaaaatatgaaatcaacctgaatgtcagattaatttagccattctcagcatatccatcccacagagaatgtggtgtt

SEQ ID NO: 92278 - DNA, 1039 bp, Homo sapiens
cgttcagcttttgcaaggcatcggagaattcatactggagagaagccttacaaatgcaaagaatgtggcaaggtcttcagtcaatgttcacgtcttacagtgcatcggagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgaca

SEQ ID NO: 92279 - DNA, 1261 bp, Homo sapiens
tcagctctgtctaggcagcagggaaggagaacctgttgggcagttacaaccaaaagggagggttcttggatctcatgcaagaaagaattaggggtgagttcacactgtaaagtgaaagcaagtttactaagcaagtaaaggaacaaggcagggtgcagtggctcacgcctgtaatcccagcacattgagagaggctgaggtgggcagattgcttgaacccaggagttcaagagcaacctgggcaacattacaaaactctatctctacaaaaaatacaaaaattagccaagggtaatggtgtgcaccagtagtccaagctagttggaaggctgaggttggaaattgcttgagcctgggagaatttttttttttgaggcagtgtctggctccggtcacccaagcagtagtgcagtaatgccatctcggctcagactctaattcaacacggaatgttgagcttctgagcgtgatatagcggaagtgccttctcttccggtctctctggtcttggccgcagaagccagatgacgaagggaacgtcattgtttggaaagcgtcgcaataagacgcacacgttgtgttgccgccgtggctctaaggcctaccaccttcagaagtcgacctgtggcaaatgtggctacgctgccaagcgcaagagaaagtataactggagtgccaaggctaaaagacaaaataccaccggaactggtggaatgaggcacctaaaaattgtataccacagattcaggcatggattctatgaaggaacaatacttaaacccaagagggcagctgttgcagcatccagttcatcttaagaatgtctatgattagtcatgcaataaatgttctggttttaaaaaatacaaaaaaaaatactgaatgtttactcctgaaacttatgatgcctaggttgagaaagactcaattttcctcatgctaaatactttatacatgtcctttattcatgcatacataggacactttacacaatataattgttgaaagtgcttctgaaatactgttcaaattgtctataatatttttacacatgcactataaaaattaaatttatcagacaataaatattaaataatttaataaaattgcatttttcaaaggctctaacaatgcatatttgagttatcatattaaacattgtattctatgatttttcaactgtaatataattttttttgagatgggatcttgctctcttgcccaggctgcagtgtggtggtgcaatcacggctcatgcagc

SEQ ID NO: 92280 - DNA, 1049 bp, Homo sapiens
attataaaaccccatctctactaaaaacacaaaaactgaggtgagaggatcacttgagcctggggaggtggaggctgcatgagccgtgattgcaccaccacactgcagcctgggcaagagagcaagatcccatctcaaaaaaaattatattacagttgaaaaatcatagaatacaatgtttaatatgataactcaaatatgcattgttagagcctttgaaaaatgcaattttattaaattatttaatatttattgtctgataaatttaatttttatagtgcatgtgtaaaaatattatagacaatttgaacagtatttcagaagcactttcaacaattatattgtgtaaagtgtcctatgtatgcatgaataaaggacatgtataaagtatttagcatgaggaaaattgagtctttctcaacctaggcatcataagtttcaggagtaaacattcagtatttttttttgtattttttaaaaccagaacatttattgcatgactaatcatagacattcttaagatgaactggatgctgcaacagctgccctcttgggtttaagtattgttccttcatagaatccatgcctgaatctgtggtatacaatttttaggtgcctcattccaccagttccggtggtattttgtcttttagccttggcactccagttatactttctcttgcgcttggcagcgtagccacatttgccacaggtcgacttctgaaggtggtaggccttagagccacggcggcaacacaacgtgtgcgtcttattgcgacgctttccaaacaatgacgttcccttcgtcatctggcttctgcggccaagaccagagagaccggaagagaaggcacttccgctatatcacgctcagaagctcaacattccgtgttgaattagagtctgagccgagatggcattactgcactactgcttgggtgaccggagccagacactgcctcaaaaaaaaaaattctcccaggctcaagcaatttccaacctcagccttccaactagcttggactactggtgcacaccattacccttgg

SEQ ID NO: 92281 - DNA, 2209 bp, Homo sapiens
gggcgcccccacgcccgcccttccttcttctcccagcattgccccccccacgtttcagcacagcgctggccgcagtctgacaggaaagggacggagccaagatggcggcggccgacggcgacgactcgctgtaccccatcgcggtgctcatagacgaactccgcaatgaggacgttcaggtccggaggctacgggggacttggggaagacgcggaggggtacctgggggcacgggcggccctcgcggagaagactcagcgttcgctgggagtggcggaagggggcgacggccaatcagcgtgcgtctcttatctccccggttgcccggactccttgagacggcgctcccgattgggtgtcggcccagtggagggcgggggccagcgctagcctcgagggtcccgggcctgccctgtgcgcgcggcggtccgcggtcctgggaggttgtggccagggctggggtctgcggactgggtctgggagagaggaggactccgtgattggcggcggcctctgaatggcctcttggggatgtggggcgcgcatgacttgctccaagtaggggagggccgccgggtgggtcgggacctgggaaggtttttttgttttctgggtttcgactgctgggccaagtggggaccgagaggcgaaggcctgccatcctaattcctgctcttcctccgcctctcattttggtttaggtgtcctaagaggacggggacgcaaaaacacccccccaccaaaggtggggactagccaagtttaggagcgaattaggttgtagaaacccgcctccccatctccccggatcctcccattgaccaggataggggttgagggatttgctaagcagatgaacatttatttatttcttttttttgagacagtctctgtgtcgcccaggctggggctggggagcagtggcgcgatctcggctcagtgcaacctctgcataccgggttcaaaccatcctcgcccctcagctccctaattagctgcgattaccggcgcgagccaccacgcccgactaatttttgtatttttagcagagacggggtttcaccatgttggccaggcttggtcgggaactcttgacctcaagcgatccacccgcctcggcctcccaaagtgttggaattacaggcgtgagccaccgcgcccagcccggatgaacattcctggttatgggatgaggtgacccaaggctctgagccgggctggtgtgggattgagaacagttagaactgcaagtccacctcccacctgctgtgtgaccttgtgcaaattacttcaccgctttgggtctctgtgttccataaaatatgggctaattgtagtcctggtcttgctggagggacttgtgagggactgaacgaattatgacacaaataaaaagtagaatggtgtcaggcctgttgtaagggctcgataaatattagctgtaattattgggagtggtgattaaagaggtcccatcctccctttaggtctgttttcccatttataaaattggacaaggtgcactgggtaacctgccaaacgtgggtctcgcctcctaggttcctggtatatcactgtttctggtggcatacaggttgtggttgtattcccggcccttccacttgttactgattgacaagggcaagttagttaatctctctaggcctgtttcctcttctctttaatggggttaattacctagttcatagggcggttgtatgaattcttttgttcagtaaatatatgccatgtatgagatatgatgctggggatatagtggagacaccagttgctatacaggatccagatgtgaaacaggtcagcagagctgaatagatgagtgtttgaaaagtgatgggaaggaaacaaataggatgtagtggtagcgaatccatattgaattgggcctctattctgtgcagggcgctgttctaagcactggtatatagcaggaacaagacagaaaaaactctaggccttggggagtttattttgtagtgaggagagacagacaataaacagagtatactggggataagcattagggagacaaataaaaataagagagatggggtatatatagggcatgcagttttaaagtgtggtcaggggaggccttgttgagatcctgtttgagaacacgcctgaaagcagagggcacagcaagtacaaagtggggtggggcagatccattttaagaaggccaatc

SEQ ID NO: 92282 - DNA, 1042 bp, Homo sapiens
aaaatgggactccagctagtgacatgggtgcaggtgtgtggatgtgtttagccgaggaccgggcacagaggaagcgtgttataaacgtggctgctgctgttaaagtacagtgcattggcatgttacatgatactgtgtataggagaaagtgatgaagagagaggaggagagggagtacagttttcaacagagtggtcctggaaagtgcaactgagtaggtgtcaccttcataagacccaagggatgcttttgcatttgttgctgctgccactactattgttgttatttaatgattccctcgaggtcacagggtctcttggtgggtgtttgccaaattactcttgagcatcttcacatgtaaccaagcaaggcttccaggggctgactgggttgagagctgtcagaactcacgcgtgtctgggatttctaacattctcccctcctcttcttgttctctcattagcttcgcctcaacagcatcaagaagctgtccaccatcgccttggcccttggggttgaaaggacccgaagtgagcttctgcctttccttacaggtaacaaaggggacccctggggcccagatgtggggactcttgggaggtggttttcactatataagagaagacttgtggatttaacatattgtttgtgaatatctgccctgtgttagacactatggagtgggaaaagggattcagagaagtgcagtcttgctctaaaagaatggtctggaatgatggagacagatggtgaaagggatctagaagcaggtagaacgaggtttgagttgcagctccaacagttggaagctggtgactttagacaagttagtttacctgtttcttatatttttcatctgtagattgggataatcatccatgtgccaaagtgttgatctgagcattcaatgttaataacaattgctaatacttatgatatgcttactgtatgccaggtggtgttctacaccgtatcttgtgaggattgagttcatataaagtgtttagaaagctgcctgtactcagtaaacatacatcactat

SEQ ID NO: 92283 - DNA, 1056 bp, Homo sapiens
tatagatgaagaaaccaaggtgtagagaggtgaagtgattcatttgcccaaggtcatgcagtgaggaggtaactgagaagggatatttatctagtcattctggcctttaacttgacagcattggttaatgactgatttcaaatctgagctctaccactttctaggtgtgtgactttgggcaagatattttacatctgcctgcttcagattcttcacaggtgaaatgggcataattatgtaacctaacatgaagactaaataagatactgtaaagtgcttataacactgtatagtacgtgccgcctaagcgatagctgccaggctgttactaagcactgctgtttgtgaggatgtaggtaaagcatttaatacactgtctgacacagactggaccacaattaatagtaaattctctgttatcattattcccattactacttcatattttatacttattaccagctgaaatcacagctgaaggttcagagtgctttgtcactaaactcttgtgtatgggaacatcttacttggacctagtgatgatcctggggaggaaggagcttgagattgttacccctccccacactggacagatggggtattggagcctaaagaggtgcagtgactcgcctacagtggcacagctagtgactgaggggtgcaggtgtgtctgactggatggtgcatgaagagtaggtgtctgctcgtatgacactgaacaaatggccccaaaccaggtggcttctattggtgaactgttggggagacttgaaagctttagaatgctgaagcatggcaggataataaagtggtgaagaagttgtagaggaaaaatgttggacctgggtttgcaataagcagctctgccactgacttgctaggaaaacctgagtaggtcactccacctctcttagcctcatttcccttgtctgtaaaggagtctaataagaggagtacctaacactcggggtgtgtagggaaaactctgtgactttcctctactttcacaccacagcaatcataacacagaacatgacttctgtgaccatatgtctg

SEQ ID NO: 92284 - DNA, 1105 bp, Homo sapiens
agagggcagaagcaggacttagggctctcttatcccagccaagcctgtaccttaatatctgtggcagcccaggtggagagtgggggagcaagtgggcggatggaagaactgagtgctgacagcctgaggaagcagaatggagtccatgtgttctgagcttgggctggggtcagagttgagatgggatagtcacgaagtctgtcttggttccacagataccatctatgatgaagatgaggtcctcctggccctggcagaacagctgggaaccttcactaccctggtgggaggcccagagtacgtgcactgcctgctggtgagtggaaggcaggaagtcctcttgcccaccccttagggtcggcccatggtcctgccggcctagggcagggaggggagcgtgtcagagagcgtggggatcacgtcagaacagccgggccatggacatccgctttaatccaacaagtcaggagtggcttttaatatcgtgaactcagggtgcagttatcatcctttctgtttagtggtcaggtaggtgcccagtgccaggccttacctgggattctacatagggctgtgggtttagagtcaggttgggttctactgcttatttgctgtgtgacttgtaagagaattacttaccctctctgtgctgtacctttctcatctgcacaatggggttatgaaaacctttttaaattaccttgaagagccctagcacagtacttggcacttagtaggtactaaccgatgttaactgcaattgtcattattgttgctgtgacatcatatccagcctttggggtaggagggattccctgtttatgggtgagccacctggagcactgagaggttaagcgtctcttcagattgtatgactagtagatggcagagctgggattcttggtctgtccatttgactgtctgccaggtccccaccccactgcctgcctgtgtgtcccgtgctaggtgatggccaaggacacaaagatgggccagatcccaacaagcagcgttgtttgagagaagatgatctgggaaggcagaccgtacaggttacctagtcccctggttttcactgttctcagagtgctgggccactgctgct

SEQ ID NO: 92285 - DNA, 2299 bp, Homo sapiens
gtagatgttctacacagtgtcagtgatgatcattgcactttgagaggctaagaactttctcctcagaaagcaacgtgtgtaattttaaggtttatggaccccagtgaaactccttcaaggacccctaaataagaacctttgtggaaggcacgctgacagagaccttctgctggctggcataatattacgtttttcctttgagtcattcattgcaaccatttttaaaggctattttaatgaaggtcgggatgggtaatagggaagttttctctgaggagatgagcccatgatggggtgcaggatggggctccagggctgcggatggtggagagggagctgtccagtgactttgtgttctcaccacagccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtgagtctctgcctccttggaagctccaagctcccatctcagctccaaccttctctaaagcctcagactccttttggtctagctggggcccaaatgcccctgaactctctccactcccactcctgcttaccacctgataggccacatcctcgagagttggtctctggacacggccacgtgtcagtttacccacctctgcccccttgctcacttaggaattgagatgatgacaggtcctccttcccactggttaatgtgaggatttaaaagaattatcacacataaagtgcttagagcaaaatctggaacataaaaactttcagcaacttacatctgatggtatctccagcctgtcccaggtccagtgcctttggcagataaaccacctcagttttcagcctcctgctcgtctactttgcaaacgattgaccgtcaagcccgggtttgagcctgactcactccagaactctggtttatggctgtacacttgcttagatacttacactggcccccaccgcctttgatcgaagcaattgctgctgaaaaataaagcctttctgtggctctagacctgcctcttagttaagcagttttttgtttgtttgttttttgagataggatctcgctctgtcatccaggctgaagtgcactggtgcagtcatagcccactgcagcctcaacctcctgggctcaagcattcctcctgccttagcctctcaaatagctgggaccacaggtgtgcaacaccacgctgggctcattttttatttttggcagagatggggtctcactatgttgctcaggctggtcttgaactcctgggctcaagcaatcctcctgccttggtcttccaaagtgttcagattacaggtatgagccactgtgcctggctcgttggttaagcaatttttatgggaatgatgtaatcgtcagcacttagcattgactagatttattatgcgcaatctgcgaagtgtctcacacacactattttcatttaaacctcatgcggacctgtggggtaggtactgttactatcagctccgtttcatagggctgggaagacagagagggggtcatcacttgcccaaggtcattcagctaaaacctggacccacacaactgcagagtctgtgcttgctcctctctgccatactgcctgctgcctcaggatccccgtccccgactcccaggtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggtgagttttgcttcctggccctctgctctcccgtccttctggtggttcctgcccatgaaagagaatcccagagctcagcaaggcctctgctgccctcccactgttcctctcctctccctaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagaggtagatgagcgaccgttgacattgtcccactggtggggacactgacactctcagaagggaagcatataggagctgaggtttc

SEQ ID NO: 92286 - DNA, 2152 bp, Homo sapiens
cccaagcctgccaggcttgttcacttggttattgattcatttcagtgctcctttatttatttatttttttagactaaaatagttttaataaggaaatagttttcttccttcccttctcccatgttgtggattgatacccagaaaggaacccttgttagcaagcagcggagctaggattagaagaatcatgtctgcctgttttttccagggtgctgtattttcctactgtgattcttaaagtcttttcaaaatggataaacatttcttgtgatactattgtaaggtttaaaaatctgcttaagttagtgatccatgctgcttgctttttgtgtgccgttaatgtgttcccagaacggggagctgggcttggacaggagtagtccctcgggagatgtccataaaagttgatgcagctgagctctttccatcctgtcctgggttgctgtgtgcattgcattctctcagaatccttctttcctctcctcagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctggtgagtgaggaggcctgggggccaggcagtgctgcctcaggggaggtgcagtatgtccagggctgtgatggggaaacggggctttgaaggcttagtggaggctgtgacaactgcctggggagtcgaaggaagggacccaggaaatagggccttaaaagatgcattggattcaataagagagaggagggaaaggagcacctcagacaaagttgagaagtgtccggtctttctagggtgggtgtaggttccatgggatgtggctagcagctccccctgtttgctctcctggaacgcttaccttggaacccttggtttctcctgtagggagtggagttctttgatgagaaacttaactccttgtgcatggcctggcttgtggatcatggtgagtaccttcacaggagcagcaagaggagatgggagctccagaaaggcaggatggattggctggggctgtggcgggcagtggaggaggctagagtcactccccacgccgctggatgctcgtatggaccagctcgcatgcttgttagagtcctagagaagtgttgagtgggaggaggacgaaacagatcacccaggggttgcctggtatagtggagagccagagggccactgagcagccagaccagggttttgaatcctgcccttggggctgtcagatctaaaacaagtcacctgctgtctttgaatgagccccacactcattctttgaaacttcttattctggtgccttggggccattatgagaatggctcattgtttacactaagagaggtaaaaaataaaaggtaatatttatctctgtgaagccctgtttgaagtaataagtgccacataatttaggcaaatcacttcttagagccttagtttgcccatctgtaaaatgaagccagtagtggaacctacctcttggagtggttgaaaagatactgtataaaaaaaaacagttactagatatagcacatagtaagtccttttttctctctttggctcacatgcagcctggcacctaggggctgctttgtaagccatggtgagtgtgacctacattttgcccacatcagttcttcacctccaaatccctgtctctctcaccctcacccttctgcagtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgagccttccacctgcctgctggcccatccctagggaactggagcgcgtgggagaggagggatgctagagggttccccaagggagacacctggcttgggaatggagacatggagtgcatcttctatccagagatgagtccttggggaactgcaggcaagggggtggggctcccagggtcagggtcatagggcctctgggactggggacttggatggtgagg

SEQ ID NO: 92287 - DNA, 1058 bp, Homo sapiens
cagttccctgaactcatctttagattcagtataagcccaataatcttaacaggttctttagtggaaaattgacacttctaatgaacaaagttgtctgatttacactaccagagacgaagacttatgacaccacaataattaaaatagatgtgaacacaagcatatttaaatcgcccaatagaatggaatcaagggtacagaaacagtcccacatgtgtttaacagtaggcatctctgcagttcagtggagaaatgtatgttttttaaaaaacatagctgagtcaatttgatatccatttaggaataaaagaaggctcgcctcaatgcataaacaaattaatttgagatgacagaccagaaccagaaagattttaaaaataaaggacctagaagaaaatgtaggaaaatatcttcttgagttagcgtaggcacagatttgttaaacagcaaaccagaggaagtgatgggtaagttgaccttctgtaaaatgtaacgctgtttctcaaaagacagcattttgagagtaaaatgcaagccactgactggaggaagatgttttaatatatgtttctgagaaaggactcatccacaatacctgtctacaaatcaggcaagacaagaaagagatggggaaaaagacttgaataggcacttgaaaaaggatctccaaatagccagtaagcatatgacaagggtgttcagcatcattagccttcaggaaaatgcaaattaaatctcagtgacatatgactacacgcctcccagaacagccaacattaaaaaagactcagtggtgcaaatggtgaagacatagaagagctggaactctcatccattgcacgtggggctgtacatttagggtttgatcactctgaaaacgggagtggatctggagtggaatttggtgaagcttgttatacaaacagcctgtgaaacagcccttccactcctgggtctctatccaggagaaatgagtgctgtttctgtcagaagaatgttcatggtagctttattcatagtagccgtaaaaatggaaacaacctccatgtctgtccaca

SEQ ID NO: 92288 - DNA, 1055 bp, Homo sapiens
caggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtagttggtcctctggccttagtcatcagcttggaggagggggcaccaccccagagccacaacatctgcgcttttctctggagaagatcttgttacaggacccattatacccctatgtcccgaaagaatactctggggatccccccaggagtgctgctggcctttggggtagagggtccatgaggtgctctgggtggtgtcctgtagtgcagttcagattcatagatgtcggccgagtatttggggggttaagagcaggtgccttggaaccagactgcctgggtccaaattgtggctccttcagttaatagacgtgtgactaggagtagcttgttaagtctttatgagctcagttttgtattgtgtaaaatgagagttacagtaatacctagattgcagggtgggtggcgaggaccaagtgaattagtacctggaaagtgtgtaacagtttcaacatgagaagtacacaacatgag

SEQ ID NO: 92289 - DNA, 1011 bp, Homo sapiens
ttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtcttta

SEQ ID NO: 92290 - DNA, 1057 bp, Homo sapiens
acattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcatactgattgtgttcagggtgcttttctgagagaaagacaccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttggaggatgtagaacaattttttttttctttgtggaatcaacatacaattttgggaaaatgtaatcatactctgcacttgaattattctctctacactctgccttagaatatttatatggatataatgaaaatcccatagaaagtgcagttttcatactcttacactctgaaagctgccaca

SEQ ID NO: 92291 - DNA, 3086 bp, Homo sapiens
atcaactaactttgattgcaaaaaaagaaactaaaacctctgtgcatgttcgttcccttctcaccctgcattttgaattttttatgtcgcaatttatgttgtgtactgcctatcacttaacaaactgttgtgcttatttttaatagttttatcttttagccctcttagtaaatatacaaatggtttgcacaccatgattatgatattaatattagtgtaacagttacatcgtgtcattttctttggatttgaagaactccctttatcatttcttgtaaaacaggtctgatcatggtaaattcccttagctttgtttgtctggggaagactttctctcctttatgactgaacgattgctttgctggctacagtattgtaggttgggaactaggcttccatactattaatttgaattacatggaatcaactttattaaacaatcctctttcctttgtgttcctaaaaattgaatattattgttctgaagtttcataaatctgtttaatataagaattgcttttggtttaatattgtttttcggtgtaatattgtttttcggtgtaaaatacttgtttacgtactacaattaattggaaacctatggatctttatatcttgtagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaac

SEQ ID NO: 92292 - DNA, 1054 bp, Homo sapiens
ctgagaaatcaacactgatttaaagactatcataacctcttatagaagagtataagaagacagaattaaggaaacattctgcccaaaaatacctgtgtgtgtgaggatgtggtgaaaacagacccagtttctcctactgtactctcacaacggaaaacacatctgtgatcccagatgtcctgggttttcccacacacaccaagggagcaattctgcactggacaccagctgagtgacctcctattcagttcaattctgacactgtctacctggacatagcatcagatcccacaggttgagggctcaatccaacaagagtgtgcccacttcaatgccagttgcaaacacagatggtctctgcttctcactgactggcttatacatcatgaattcccatgaccccctcctcaggtttgattaatttgctagaatggctcagagaaatcagggaaacactttatttatattgacccatttattatataggatattacagagtatacagatgaacagccagatgtaagcagtctattgggtaaggtatgggagaaggagcatggcgtggtggtgcatgcctgtaatcccaactacttgggaggctgagtgctgtctttggtgggggtcggtgggggcgtcctcagagcctccgtgtgtttccctatcctgaagcttgttcaggccctgtcctttcgggttattatgggggcttcattaagtgggcacgattgcttacatctttggctactggtgatcagccgagccttcagcccccatcccctcagggtaagttgggggatggggctcgaagtcccaactctgtaatccagccttggtctttctggtgaccaccccgccattctgaaactatcttggggcctccagccaccagtcatctcattagcttacaaaggcacttatcactccagagattccaagtgagatgtatgtcaggaaagggggatgaagaccatatgtatattttattatatcacaacttggatatcggcccacttactccagtttaatctattctgtcttctcattttatgtgaag

SEQ ID NO: 92293 - DNA, 1124 bp, Homo sapiens
cccccaaccccgtgctctctgaaacatgtgctgtgtccactcagggttaaatggattaagggcggtgcaagatgtgctttgttgaacagatgcttgaaggcagcatgctccttaagagtcatcaccactccctaatctcaggtacccagggacacaaacactgcggaaggccgcagggtcctctgcctaggaaaaccagagacttttgttcacttgtttatctgctgaccttccctccactattgtcctatgaccctgacaaatccccctctgcgaggaacacccaagaatgatcaataaaaaaaataaaaataaaaataaaaaaataaaaaaaaaaacctctaggcttaggggctttgtgttaaatgcgagttacaataaaattgccgacgttcatccaagggtgctgtttcccaatgtgtcatacggcaacagaaaatgtcttccaactggggtgtttagaccacttccttttaaagtgattattatatggttaaactatcttggtattggttttgtttttgcctttgttctttcttctcttttctttcgttgccttgggttttgttttgttttgtttatgtagactggaagtccatattttatttctctagtgacatatttacagttcaatataaattaaaggcctgcttgtatgccaaatccaggtcccttgggtggttcagtcaaaggggtaagacctccagctggctcacaagagaagcgtccactccttggcccaggttttgggattttgccagccttgagctcatcaataatttcttcaatatccttagctgtcaaatcttcatagtaattgtcatttatttgaaccattggtgcgttcacacaggcccctaaacattccacttctacaagagtgaaaagtttgtcaggtgtagtctccccaagctttattccaagctttttctgaatggcctccagtatgctgtcagagtttggaagcatgcagggtgtagtagtgcagacctgaatgtgatacttttcaactggctttcgattatacattgtataaaaagttgctacttcatatactcttattggaggtacttgtaaaacttctgcaaccttgttcatagcagagatgggcaaccacccattct

SEQ ID NO: 92294 - DNA, 2743 bp, Homo sapiens
ccagctactcggggagactgaggcaggagaattatttgaaccggagaggccgagtttccagtgagccaagatcacgccactgcacttcagcctgggcaacagagaaagactttttctcaaaaaaaaaaaaaaaatacaaaaaattagctgggtgtggtggcagttacctgtaatcccagctacttgggaggctgaggcaggagaatcacttgaacccaggaggcagaggttgcagtgagccaagattgtgccactgcactccatcctgggcaacaagagtgaaactgcatctcaaaaaaaaaaaaaaagtatttgggtgtgctgacacgtgcctgtagtccctacttgggaggctggcacacacacacacacacacacacacacacacacacacacacacacccatacccatatatatggtttgggggataggatgtggcccgagatcttcacttatttagcttctgaagttgaacctgttctccccaaccttgacccttttccagttgtcctgctgtccatgctatgcctggtattggcccattggcccaaacgcctgttctctggagagctgatctacatcgcagcggctgtgttgctgctggtgctcattgtgggattcactttcaccgtctggagacagccccagagcaacactcctctttacttcaaggtaggtggccttatgtccccacaccaccctcctgagtcagtggactctgcatgcctcaagctctaaatactctacgggaccaggggtaaaaagggcagttgcgaaaaaccaatggactgttcatggacaccccctccagcccccacatatcagtacttcccaaaacctgtctcttccagaacacccaatggaatacctactcagaacaggcattgagccaggtgaggtggctcacacctgtaatcccagcactttgggaggccaaggcgggtggatcacttgaggcgaggagttcgggaccagcctgaccaacatggtgaaattccggttctactaaaaatacaaaaattagccgggcatggtggtgtgtgccggtaatcccagctactcaggaggctgaggcaggagaatcgcttgaacccaggaggcggatgttgcattcagctgagatcgcgccactgcactccagcctgggtgacacagcaagactctgtctcaaaaaaaaaaaaaaaagaataggcattgaatatgcgactgcaacagagctgaggccttcccaccccttggaataagggtcccttgcagacgttcgtggtgtgctcacggttaacgctttgcctgcaggtccccctgttgcctgttctcctctggtcagcatctctgcacatgtttacctgatgatgcagatgaccactgagacctgggcccaatgtggagtctggatgttgattggtgagtggcttcctggaaaaaaagaggcctcttgggtgtctgagcccaacactcttcctgcgacctttccctatagctgtctcaggctaacagtgtggggtgtgcctgtagtcccagctactcaggagatgaaggcaggagcatcgcttgagaccaggagctccagaccagcctgggcaacatggcgagactccacctctaccaaaataaaaaactggccgcacgcagtggctcgcacctataatcccagcacttcagggggccaaggcaggtgggtcacctaagatcaggagctcaagaacagcctggccaacatggtgaaaccccatctctactaaaaatacaaaaaagtagccgggcgtggtggcgggcgcctgtaatcccacctactcaggaggctgaggcatgagaattgcttgaacccaggaggcagagtttgcggtgagccgagatcatgccattgcactccagcgcaggcgacaggagctgagattgtgccactgcactccagcctgggtgacagagtgagatgctgtctcaaaaaaaaaaaaaaaaaaaaaaaaaaattagccaggcacggtggcacctgcctgtagtcacatctattctgaaggctgaggtgggaggatcgcttgaacccaggaggtcgaggctgcagtgagccatgatcatgccactgcactccagcctgggcaatggagcgaagctctatttctaaataaaagaaacaagaaaacctccaaataaacaaaccacagtataatcgctatagggcatttataagggaaggggtgactacatttcctttcattgtctcatttccctgctaggatttgctatgtattttggatatgggatcccacacagcttggagaacaatcaacagccaccagcgtcaagctcccaaactcctcatgaaaacatccctagtcccttgctgaattagtttaaccacggaaaagggatggtccagtccactggaggtgtcctctggatgaagggaaagtgtgaagctctgtggagcatgaaggtgggatacacttaaagccccttgtgcattgccagtgagcaaacactttttaaaaaactttattttgttgtttgtttgtttgtttgtttgtttgtttgttatagaggtgaggacttgctctgttgcccaggcggaacttgaactcctgggctcaagtgatcctcctgcctcagtcttccaagcagctgggactacaggtaccccatcatacccagcttaacaaaatatctttatttgatttgattttttttctttttgagacagagtctcgctctattgcccagtctggagtgcagtggcatgatctt

SEQ ID NO: 92295 - DNA, 1019 bp, Homo sapiens
caagatgtaataatcaaatcaaggtaatatcataaccatcacttcaaacattgattatttccttgcattgggaacactgaaaacctatttttccagctctttttttttttttttggagacagagtctcgctctgtagcccaggctgcagtgcagtggcacgatctcagctcactgcaacctccgcctcccaggtccacgcgattctcctgcctcagcctccggagtagctgggattacaggcatgtgctaccacacccagctaatttttgtatttttagtagagatgacgtttcaccatgttggccagggtggtcttgaactcctgacctcaggtgatccgctcaccttagccttccaaagtgcttttccagctcttataagttgttaacgacagtcaccctctagtgctgtggaacattggaactcaccctgttttgagccctgactatagcaatcatggctttcctgtttgagttcagtgaccttgtgagcctcttgtccatcgggactatgcttgcttactccttggtggctttttctgttcttgtcctcaggtgagactggggtcctagacacgtgaggattgatggggttcccagccctcttctgcctgcctcctggcccctcggtgcattgctacacatacaggagtgggaggagtacaacagcccctgcttatccacgggggacacgttccaagacccccagtacatgcccgaaaccgcggatagtaccagtccctatacatgatcattttcccatccataactcagttgcctaatgtgacttaacacggccggtagcgttcacagcatggacacactggacaaaaggatgatttacatcctgggcatgggcagcgtggaatgccgctacttgaagctgcacacaattgaaaacttatcaattacggcggggcgcggtggctcacgcctgtaatcccagaactttgggaggccgagacaggtggctcacttgaggtcaggagtttgagaccagcctggccaacatggtgaaa

SEQ ID NO: 92296 - DNA, 1524 bp, Homo sapiens
tgaaacagggtcttgctctgtccctcaggctggagtgcagtagcacgatcatggctcactgcagcctctacctcccaggctcaagcaatcatctagagtagctaggactagaggtgtgcaccaccacacctagctaagtttttaaatttttgtagagatggggttttgccatgttgcccaggctggtctcaacctctgggctcaagtgatccacctgactcagcctcccaaagtgctgggattataggcgtgagccattgcaactggccagaggtgccctcttggacacaggagtggggcctggggtgcagaacctggactattgtgggaatagggggaatctgggttgacggagccagatgatggggagtggggatggcagtgggggccccgggcttgtggaattaactgagcagttggagttaactgagtcgtcccagaaagacggctgcacaccttaccaatgtttcttgttccttctgtccccgtagctcgggctccctgggctctggagggtttgtgccttttggctttggcgtgattctccatggagcggccacgtgtttctttgcatttgtgggttttgatggcattgccaccacaggtaacacggtcattctgtctcatcgggggtttgggcactgtttgggctgccgctgggcacaggtttcattaaaggctaccctgttctcagatggggaagagggaagagggttttgtaccttcacttccgtgcattttcctggcccagtgcgtatacctgtcctgcaggagaagaagccctccaccctcaccgcccggtgcatatacctgtcccgcaggagaagaagccctccaccctcaccgcccggtgcatatacctgtcccgcaggagaagaagccctccaccctcaccgcctccaccctcaccgctccatccccttgggcactgtgacctcgatcttcatctgcttcttggcctattttggtgtctcagcggcgctcaccctcatagtgcccctactacctgatatgtcccgagaaccccttgccggaggcttttgtccacattggatgggcccccatcagatatgctgtggccgtcggcaccctctgtgccctttcctccaggtcagtgctggatgctctctccctgtctgctgtctggttctcgggtgtcctgggccttggtaaagggaggagacgtttcacccacggaggcgacagagcagaagccccagtccctcttgcttcctgagtccccatgcgtgttcccgttttctcctgcatgcagcctcctgggtgccacgttccccacgcctcgcgtgctctagtcaatggctgaggacaggctccttttctgcggactcgcccggatccacgcccacaccagcacccctgtggtggccactgtcgttgctgggacccttgcaggtaaaggcccagaatccaggctttctttcatccattttctatgagttagttcctcatcctcccccacagcccatccatttttgcttttattattattcatcaattttttta

SEQ ID NO: 92297 - DNA, 1092 bp, Homo sapiens
tcactgcaacctctgcctcccagcttcacaccattctcctgcctcagcctcccgagtagctgggactacaggcgcccgccaccatgcccggctaatttttctgtgtatttttagtagatacagggtttcaccatgttagccaggatggtctcaatctccttacctcgtgatccgcccgcctcagcctcccagagtgctgggattacaggcgtgagccactgcgcctggcctgaaatgaaccatttgaaagcatgcagttcagtggcatttagtacatccacggcattgtgcagctgccacttccatctaattgggaaacgttttcatcacccctgcgggaaaccctgcaccctttaggcggtcgttccccattccctttggctcctggcaaccacggatctgccttctgtctctgtgggtttatttattctggatattccatgtttcccacaggactgctggctctgggagctcgggagtcagcctggggttccaaagtcttcacaggtgtgaaccttttggttctgagctgcgtcatcttctccggcttcatcaagggagatctgcacaactggcagctcacagacgccgactacaaatgggccgagctggggtggtccaacgacacccacaggtgagggcacaggtttattttatttttttttattttttaattttaattttaatttttatttatttttatttatttatttatttactttttttttttgagatggagtctcactctgtcacccaggctggagtgcagtggcacgatctcggctcatgcaacctctgcctcccgggttcaagcgattctcctgcctcagcctccgagtagctgggattacaggtacctgccaccatgctcggctaatttttgtatttttaatagagatggggttttaccacgttggccaggctggtctcgaactcctgacctccattgatctgtccacctctgactcccaaagtgctaggatttcaggtgtgacccactgtgcctggcctgtttttttattttcaaatttacctttatttttattttttgagatggagtctcactctgtcgcccaggccaaatttcggtcg

SEQ ID NO: 92298 - DNA, 1026 bp, Homo sapiens
gcgatctcggctcactgcaacctccacctcccgggttcaagcgattctcctgcctcagcctcctgagtagctgggactacaggtgcccgccaccatgcctggctaatttttttttatttttagtagagacagggtttcaccatcttggccaggctaatctcaaactcctgacctcgtgatccacctgcctcggcctctcgaagtgctaggattacatacatgagccaccacgcctggccagctctgtcaaacattaatttgatcccaagcagagggacttttgatctcaatctgcatgagtctgtctctaggaaggaggctgatcattatgctgggggggtgatgagcaccctcccatcttcctctgtccagatctcaggggagagccagcagataggaccattcagcagccaatgtccaaataaggttttgttactcgaagcgctgccaacctactgtgggtcattttattcaggtccatcccaaataacctgtggacacaagagttgatattattccagtgtactactgtggcattcaattaataagccttaagtatctattgtgcactaccgtggtaagataattccatgatcctccagaaattccacccaacgctgctggaaagtaggcttactacatgctacatgcaagtccccaagctgtgttaactgcataatttttttttttttgagacacagtctcattctgtcacccaggctggagtgcagtggtgcaatctcagctcactgcaacctccacctcccaggttcaagcgattctcctgcctcagcctccccagtagctgggactacaggcgcccaccaccacgcccggctaattttttgtatttttagtagagacaaggtttcacccgtgttagccaggatggtcctagtctcctaacctcgtgatccgcccacctcggcctcccaaagtgctgggattacaggtgtgagccaccacacctggccaattcataatttatcatagccttatgaagatgcaactatgttctccattttt

SEQ ID NO: 92299 - DNA, 2028 bp, Homo sapiens
ggcaaggaaggggtgggggcggaacagaccaggaaggagggggtaggaagggagcggaagaaaggagtgaggtgagacgggggcggggacctgagctggggggctctgcactaaacaaaccctaaacatgcggggtttctatggtaacggtcttccctggcctacccgggagactcctctagggctgtgtcgaggagggcagcccccaggagtctccacgccgccagctgttgtgtcttcctgttttgtcaccacggcaaccgtgacctcagccctccaccctgctcactggggtggggcgggagctccacgctacttttactctggggggcgtggtctgctcttggccccgcctcggggcggggctgggatagcccagactcggggaagtccctgtccaccgccctagccggagctgcgccccgccccggccccgcccccgtcccgcccgcgctggctccccagccctccaaccccacccagccctcagacccttccagctgccgctgtcgtctttgcttcagccgcagtcgccactggctgcctgaggtgaggttgtggggaccccagagggcataagcaacagtctagggtctttatggccagagagaggaatgggctgggtctcagaatgtctgggtccctagaaagactggggctgggccaggattcttggggttctgcagaggagagggctgaggacctggactgtggaggtcatacgtctggaagagtggggaaggggacctggactccggggtctgagggaggaggggctgggggtctggactcccgggtccgaggcaggaggggctggggggtctggactcctgggtccgagggaggaggggctgagggcctggactcctgggtctgagggaggaggagctgggcctggactcctgagtctgagggaggaggggctgggtctgcgggagtagagagatggggactcgtaggtgccctagttggaggctggaatctggtacgtggaggtcctttaggaggggaagcgcttagggttaggtgtcctgggtttgggaatgagaatggaaggaattcagaattactgacccctccccatccaggggacagacagaatcggaactttgggctcctgaaaggccgagggaggggggtgttaagatccagccccgtgcttccgaagtgcagaaggagctgggaaaggaggagaagacagggctgcgtcccgcacctctgggtgccgagagccgaagctggggttccggggcccgattctcagcgtgagcgatgggtgtggcgtctggagtggacgagggaggacactgaggggctgggtgtggcccggagagtcgggtgcgctgcgaggaatcccggaggggtgtttcctcaccctccagggtctggctgcgcattcctgagctctgatctcgggcgatggctggaggccctaagggcggggtggacccctcccctcccctcccctcggcgcgcccccctcccctgcgcgcccccctccgcggctagcccaccttccgcgggggacagaatgagtgacgccctcgctcgtcctcctcccctgcttgggacggggcagtagcccgccttctagagcacgggacgctgggccagtcccgatttccttctccttcgagggtcctggaggggcgtgggggcaggcagtgtctggctccgggtggagcctcccaggtgctcccgcaagccccgaatggcgattagggaggccgtgggaggcgtagctgggcctcgggcctgacgccagcaccgcgtgcagtttccggcctggagcctgagcccctcagaggcccgggtccctgcccactccggtcttagagatgctcttgggggggctctcagcccatgtttatagggatccagaaatgcaggcctccaaccctgagagtcggggtccccaccccccggaaatccgggagagggcgggcagccccggaggcgggcgggggtccgggcaccgcctcctggtccctgacacattccagatgcctgggccgactcgaagccctt

SEQ ID NO: 92300 - DNA, 3733 bp, Homo sapiens
aaccggaggggacaggctcatccctgtatgcccaggactgtccccatttgaaaacccaaggctgggcccggtggctcacgcctataatcccagcactttgggaggccaaggccagcggatcatgaggtcaggagatcgagaccatcctggctaacacagtgaaaccccgtctctactaaaaatacaaaaaaattagccgggcgtggtggcacatgcctgtaatctcagctactcgggaggctgaggcaggagaatcacttgaacctgagtagcagaggttgtagtgagctgagattgtgccaatgcactccagcctgggccacagagcaagactctgtctcaaaaaaaaaaaaagaaaagaaaaccgaaagccccacatcttgggaactccctaattagagctcatattaatttgtccctggggtaggcaatggctaagggacctggattcttatgtttgtgactgtataaggacactgtctttcccctttttgcagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaaggacttgtgctttcttaatgaggagggcggccgagcacggcgggcggatcacttgaggtcaggagtttgagaccagcctggccaacatggtgaaaccccgtctctacaaaaaaataaaaaagaaaagcgggggaggactctcggagaggggcaagggccagattcttgggtctagtgggagaatagggttggtgccaagacaaccttggcctcatcagaagatactagctggatctaggtcttctaaatgacttcctcaaaccaggagggctgggtgggatagaaatgaactagacttctccctccttggagtctgtcccctgagcac

SEQ ID NO: 92301 - DNA, 1093 bp, Homo sapiens
cctgattttgatgttctggaatctgtaatcgagattctggttctatgtctctgggttccaatgttctgggactcagcagactgtgaagatgttccaggattccaggtccaggagcctgcctagatctgggagggtggaattagggttctggagctaggttctggagtgaggaggaattggagcaagattgggttttaagacggggtgcaagaatgtggagaagggacgaggtcccagctgagagtcagaggggcgaaagggggaagctgagatcggctacctgggatggaggcagccagggtggccagggtgatggtgcccgtttccgaacccacagggctgcgagaggaccaggcagctcgcggtcaaacccctgagccgccaggcggaggatgggaggatgtcatgtgtgatgtcatcttaaattggggtatcaaatgaggtcaaggcacaggatcagagttagaaggtcatgggtcaagttcttggtgttagaattgggtgttaggctcaagatacaaatcttgagtgtaaacttcagtgggggcctctgctcaaagtcttagatagggctgaggtcaagggtgtgaagccctggtatggggttagagatccttggttagtgacccactttgggaatttctggatgtagttcagagacagggtgcaagaaaatgtatcagggcatcagattagggcatggagttaagactgggtagcctgggttagagtttctggccagctcaagttgtagagcatccagggttcaagcccaatgccctgtgctctgggatctaggtcctggctcagagttgaggttattgatccttgttggagtctggtgttcacaaccgggggcttcgatcgtcacacagagacagggctgcaggatgccaggtcctagagctgaaatcattgatctgcctaatagtttctgagtcactgatccacactcaaggttagggactctggtggcatctgatttctaaattagggtctcaggtcagcaggtgaggttaggttttggcagggggacctggttctggggttaagaagctcaaattagaatttctgctcggagtcacagtatttg

SEQ ID NO: 92302 - DNA, 1033 bp, Homo sapiens
accatctgagggggtgcttgagcctgcctgggccaggaccacgcatgatgcagtctggaccattggcggccctacaccacctgggggatggagtttcgaccagccggggttggattagaccagcagaggtgaggcctgggccagctaagagtgggccggagccctctgggttggagcttagaccagcagggaagcgcctagagcatcgggcggggagttgtgttcacttctggcaggacttgggtcagccagatccaggacgggggtctagaccactcggggtggggcctagaccgcctgggggtggcgcctgggcccgctggcgcaggcgggcaggggtcggggccgggggcgggggcggggccgggggtggcctcgaggctcccgtctgaccgtccccgcccaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcg

SEQ ID NO: 92303 - DNA, 1043 bp, Homo sapiens
taaaatatttttattttcttctttgttaggtaatgttatgccagagtcagattggaaagtaagtcacgatatatagggctaaataaaacccatctgatgagaatttatggtttgtagggcatgagaccccagaccccttagataagaatctgggcaagataaaaaaaaaaaatcagagctgagtcctcactatggtaattcagtgagtgtgactaccagcatagatgtccataaaggatatccattagggccacccattttaataatgtttgccaggacccttcaatcaaaacaaaatccattctcagaatagcttagaatcaaaggaggactttttgggtttttttggttcaagaaggattgggcaagaaaactgcagggagtgaaggaatgctgagctttggaagcaattagaaccaagaaaacaaaagctgaaagcactgttactcactcccgcttcccggatgctccctgagtcatctttgtgtttctccataaagactggcttcctccacatggcgagacagatggccaccaagaactcccaagcttaaaaaagaatgactctctgtggcaagaaaacaaagagacactcctccccaccttgctactccctatgtggcctccacactgcaacctgggactgtgtagtgaggggagggggagcgaagaagtttgcgttagtctgttttcacactgctgataaagacatacctgagactgagtaatttatttttatttttatttttatttatttatttttttgagacgcactctgtcacccaggctggagtgcagtggcacgatctccgctcactgcaagctccgcctcccggggtcacaccattctcctgcctcagcctcctgagtagctgggactacaggcgcccgccaccgcgcccggctaattttttgtatttttagtagagacggggtttcactgtgttatccaggatggtctcgatctcctgacctcatgatccacccgcctcggcctcccagagtgctgggattacaggcgtgagccactgcgcccagtcagt

SEQ ID NO: 92304 - DNA, 1686 bp, Homo sapiens
agaccagcctggccaacatggtgaaaccttgtctctactaaaatacaaaattagctgggtgtggtggtgcgtgcctgtaatcccacctacttgggaggctgaggcaggagaattgctttaacccaggagacggaggttgcagtgaactgagattgcaccactgcactctagcctgggcaacagagggagactccatctcaaaataataataataataataaattttaaaaagggcttcctgagagcaggggagggcatcgggtccagcatcaggctctgcttccttccagggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcgcagtgacgtccttctactgttggtgacaggtacagacagggtgcctgccaatgacatacgggggacaggggatgagggaggaagtggaggaacagagggagaaaaggggtcccaccttcagagtagttgggggtgatgggagagggagagagacaggaacgaaattgcatatgttggttttatactttgtcgcccaggccagagtgcagtggtgccatctcggctcactgcaacttccgcctcctgggctcaagtgattctcctgctccagcctcctgagcagctgggattacaggtgcctgccaccatgcccggctaatttttgtatttttagtagagacagggtttcgccatgttgggcaggctggtctcgaactcctgacctcaggtgatccacccgccttggcctcccaaagtgctgggattacaggtgtgagccaccatgccaggccttacacaggtcttgtaggagggagaatctctgtcctggggtcggagtaggaagtggaggaaggtagaagagatcaggaatctctcatttcccacactccacgagagcctccggccaggagaacaggggtgagtgggggattccagacttctccccaggacctcagaacctgacttctcttacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacaggtaagggcgtgtatggttttgaggaactgtgtgtgttgtttttaatcagagattgttttgttcttctgtgaatctcatttcttcattacttacaatatcatcgctcttaacaaaatcttccctttctggcctggcgtggtggctcatgcctgtcatcccagcactttgggaggccgaggtggatggatcatctgaggtcaa

SEQ ID NO: 92305 - DNA, 1097 bp, Homo sapiens
ctgtgatcccagctatttgggaggctgaggcaggagaatcacttgaacccgggaggcggaggttgcagtgagccgagattgcgtcactctactccagcctgggcgacagagcgcaactctgtctctggaatgaatgaaagaaagaaagaatgaatgaaagaaagaaagaatgaatgaaagaaagaaagaaagaaaaagaaagaaagagcgagactctgtctctggaatgaatgaaagaaagaatgaatgaaagaaagaaaaaagaaagaaagaaaggaaagaaaaagaaagaaagaaagaaatggtaagaatgagtgctgttttcaaacagaagatgagaatggaaggatttgtgggaaaggcctggagcagggggaggtgacagccacacaggatggtcaaggagaatcgctgggaaaggatggaggagctggaagtcgagcagaagccacagtccagtgtggggagaatgagaactcctgagcgtatgacctctaagggtctgttctcagcaggagactctgggacgatctccaggggtcagggcagggggtgacgtggctccaggtaggggcttctggctcacggaggattgtcttgcaggactgtgcgtgggccaaggagacacaaggggagatggtgagtgtttcttcaactacaccctccttggcctgtcatcccaaatcccctgctgttctcttccccttccccctctttttctcttttttttttgacggagtctcactctttcgccaggctggagtgcggtggtgcaatctcggcttacagcaacctccgcctcctgggctcaagtgattctcctgtctcagcctcccaagtagctgggactacgggtgcttgccaccacgcccagctaatttttgtatttttagtagagacggagtttcaccatgttggccaggatggtctcgatctcatgacctcgtgatctgcctgccttggcctcccaaggtgctgggattacaggcgtgagccaccgcacccagcccgcttcccttcttaaaatgggattcctgattgggctcaggggttcacgcctgtaatcccagcactttgggaggccaaggtgggtggat

SEQ ID NO: 92306 - DNA, 1294 bp, Homo sapiens
ggcaggagaaccgcttgaacctggggggtggaggttgcaatgagatgagattttgccacttcactccagcctgggcgaaagagtggaactctgtctcaaaagaaaaaaaaaaaatggtgatgaaggcctggcacagtggctcatgcctgtaatcccagcagtttgggaggccgaggcaggtggatcacttgaggcgaggagttcaagactagcccagctaacttgtgaaacctcatcttaactaaaaatacaaacattagccgggcatggtggcatgcgcctataatcccagctacttgggaggctgaggccggagaattgcttgaacccaggaggctgaagttgcaatgacctgagatcgtgccactggactccagcccaggtaacagaaccagacaccatctcaaaaaaaaaaaaaagagtgaagtgctttcatctcttcaatacgaacccttcagggccaagtctgaagcattttcggggttacctgtttgatgcctgaaatctgcctgagacagaggagcatttcctgtgagtcaagtgctcgaacactggtgtgtgtaaggagcatgttgcaatcagcaacatcaacatgtttcctgaatgtggatatgggaggggaaactgaaaggctaggaaaggctgttactgcccacactctggggtgggagagaggcagcgacgactccagctcttctcccatctgtggactgcagaacccaagacggactctgggagggctaaggagccatcatgatccctaagctgctttccctcctctgtttcagtaagtctcacagggctatccactgggactgcagaaaatcatggaactggtgggatagttgggctggggatggaaataataacatcaactttggcttactgagcacacgggaggagtgagacgtcctgctgagtgcagtgcagacattccctggaaacgagtgctctgcaaacttcaactcctgtagtttcaacttcgtgagttttgctgaatgcctccaccacctggcttcattggcttaccccttttctcaggatcaactctgactttttgtgtgtaagtaaaagtattcagaatagaaaccttattttattttattttattttatttttttgagacagagttttgctcttgttgcccaggctgtagtgcaatggcatgatctcggctcaccacaacctctgcctcccgggttcaagcgattctcctgcttcagcctcctgagtaactggattacaggggtgcgccaccatgcctggttaatttttgtatttttagtagagacag

SEQ ID NO: 92307 - DNA, 1078 bp, Homo sapiens
tatttttttagtagaggcggggtttcaccgtgttagccaggattgtctcgatctcctgaccttgtgatccactcacctcggcctcccaaagtgctgggattacaggtgtgagccaccgcgcctggcctgtgcttcgagtttctattacctttccagatttctgtctctctctgggttcccatctgtggtggtttcttggtctccatcttctcaggtttctgtcctgtttccccatctcttttgaccctagctctctagtgcgcgggatctctccctcgctatctctctggttttccgtgtctctcagtctctgtatttcccgcctctttctgcatcactgattctctgacccttcccctctcacccctggggtcccccttccctctctgaacataaagcgacagaccagctcttctctccagggccctggagacgtgctggtctcagtggcccacctcctgccccacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatgtgtgtgatcagaggtgggaacaagtagacggtggccggggtgagtgtggggtcagtttattgggcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagacagggtctcactctgttgcccaggctggagtgcagtggtgccatcatagttcactgcagcctctgcctcccaggctcaagtgatcctcccacctcagcttcccaagtagctgggactacaggcacttgccaaccaagcctaacatgttt

SEQ ID NO: 92308 - DNA, 1050 bp, Homo sapiens
tgagaggatggggcgggaagggcgggaggccagactgcagagctgctgagtcagcaaacaggaacgggggaactccctgtgtgccaggtgctgtcctgggtactcggctgtgggtacagccaacgcaggcacagcactggtccctgcagagcttccggagttggggaggccctgaatgtcagtctgaggactcggtcattagccttggggctgtggggagccgtaggaggtttcacacggtcagttctggggtagatggggtcaagtctagactggtgtggagggagagggattgaaggcaggaacacaagttcagggatgtctgcagacatcagcctgtccctggtttactcttcagcccctccttcctgacccctcccaacttcatcctccgcctcctccagctgcgggacccgagagggggtagggatttagatactcacacccatgcctccgtgtcctcacagtgatgggaccagtggaggccgcgcctgaataccgcgtcatcgtggatgccaacaacctgaccgtggagatcgaaaacgagctgagtgagtgctggggggcaggcggagacagccccgtgtgacgtccctcacgccccctctcccttccccactggcctttcccagggtcctgcccctaagcccaagctcagatcgaggttgacctgctgtcacagagtggctgaaataagaaggaagtgcgttctctcgcgtatgagtctgaggagcactcggggatggtgtggccgcttggctgcctgtagggccccggctctttccatcctgttggtcggccacctgcctcacggtgcgaggtgactgccccacctccagccatcacctccgcattcccaccagcaaggcgcttcttttctttaagaacatgtcactgcagctcacgttttacagaccagaactaattcccctggtcacacctagcggtaaggacggctgagaaaggctgtatgctggtgcccgtgtgccaggccacaagccagggcttcagttactaaaggaagaaggggacatgggtgttagggccaac

SEQ ID NO: 92309 - DNA, 1042 bp, Homo sapiens
gggcagatggtgtggatgcttgacgtggtggaggcaggaatggtgtggatgcttcaggcggtggaggcaggagaggcccccagtgcagagaccctgactgtcccagtgtccctaagaagagacctgaggaggtgctgagcaagagaggttctcgagccttcctgagttcccgagcctcccctatcttctctgctcgcccccaggagctgggcaacagcctggacaagtgcaagaacaatgagaacctgcagcagatcctcaccaatgccaccatcatggtcgtcagcgtcaccgcctccaccacccaggggtatgtccgcttcgagggaggcgccgggccctaatgggattggggattaggctggagctacacacgcaggtgtacacacgcacacacacatacacacatgcacacacacacacagaaccgagagggctggggctgggcacaccaggcaggcgggagatccaggaggctgggcccacccgcccctgcaggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgagtccccgggctgggtcccatggagcgggggtctgctgacactgtgaccttgggaaagctacatccttttctgtagaatgggggctttggcacctggacctcagcaccccgtctccctggacatcacagaggtcagccagcctggcacacagcaaagcctcgtctgtgggaaaaacactcacccacagctccttctccctcccctgtgccggaaacccagagatgaccacacccaggccctgttgtcagggagctcctggtttggtgaaaatggttccaaaacacagccatccctggaacggcgttagtgtggcttagcacaaacgtggtggtcagcttcctgttgggggcctcctccctgcacccccagg

SEQ ID NO: 92310 - DNA, 1010 bp, Homo sapiens
tcagcctgggccacctgggcaagtcgggcagtgggcgtgtgcggcagacacaggtaaacgaggccaccaaggccaggatctccaagacgctgcaggtatgggccagacccaggtggggctggggaccgagggacacaaggtggggggagcccagatcgcagcctccctgtcctccccacagcggaccctgcagaagcagagcgtcgtatatggcgggaagtccaccatccgcgaccgctcctcgggcacggcctccagcgtggccttcaccccactccaggtacctcccctgggccggctctgtccccagccctgagaccttggcaaggccccttgccctctgcccctgtgaagaaggccaggatgagtctcctcatggggctgttgtggagggtgtggtgacgaggtatgcagaggacgtagacagctcctggcacacaggaagaggttagcagagacgagagcccagcgctgagcagtcctcgtgagcacgcactgctttagaaccaggcccacagctgtgttcagggcacccagttcctctgtcgggctgtgagcgggtaacactgctcagcctccaggccctccagttcaaaacggccaggacggttaaggtaacctcaggaccccactcgagaaagttcccggctaggcgggcttggatgtcaagtgtgggtccaggccccagccagtcagcagtgagcagcgtggagcatggcagtcaccgcatcgtcggagcctcggtttaccatccacagagcagggcgagcctgcaccacggaggcgagacagcagcgagctcatctgcccagtcagcgggtgtctacgcagcacctgctgagttctgtcagtgttcccggctctggggatgaagcaacgaatgagagacaagtcttaccttcttggagccagtgggtggccgggcgcagacagctcagtaagatgtccagtgtaggagaaggcagaaatgccaggccgggcgcagacagctcagtaagatgtccagtgta

SEQ ID NO: 92311 - DNA, 1045 bp, Homo sapiens
cccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaagatctgtccttggggagtgatcatttttcaaacagccggggcaactagaagaatcagagctgtggagctttgagaaaagagcttggccctcgggtccaagcggtgtctaggcccactcccttccccgttactttctcgtcatgggatcccagaaggaaaaagccctctccaaccccctggagagccgcagtcactttgatagcaaatgatgtggctgccaacagccgcagatctcagcgcaggccgaccgggattgctgtccacctcaggccagcctcctcacctttccaagcctccacacctacgcccaggtgcccaggactggaaagaatgcacagaaagcacttagcatgggacttgccatcagcgccctataaccaggtcctgttatgattgggttttttagagacggggtctctgttgcccaggttggagtacagtgatgcgatgaagctcactaaagcctcaaactcctgggctgggattacaggcatgaaccagcacagctggcctcctggttaatttaaattttttttttttttctgaggtggagtctcgctctgttgcccaggctagagtacagtggtgcaatcttggctcactgcaacctctacctcccgggttcaagcaattctcctgcctcagcctcctgagtag

SEQ ID NO: 92312 - DNA, 1361 bp, Homo sapiens
tgggggagtcacccttcccaggaccgaggccgccctccgcatccctcctcactgctcccgggagcgcagcctcccctggatctcaggttccagctgcccgtctgtatcggatgggagcctcttgggagaggagtggaggagaaactccccgttagttggagcctttgccgaagtttccacctctgtagtctgcagctcttccctctcatagcgagtagcgccctgggtggctccagcctcgccatcccgctgcactgggcgcctgcctttttgggggagtttggctttcccccacctggggtacaggaccgtcctcagtgtggcccacgtctggtctcagctctcacacttctttgatcctggcgtctgcccctggctttgcagccttgaactcccctgcatcgtgactctccgaccttctgggtgtgggcgtctcccagtgatatcaggaccactgtggtcttgttgctgggggctgctgggatcccctggcgctcaggtgcctggtgaaagacactaagccgccacgctgtccatgttagtgagctcccactgcgggcagcaccagcccctctttctgagcagtccctgcctctcagtgcagggcggccacccaccccggggtgagctctcctgtccttttggtgaggggttttgatgtctcccctccctcccttcacccctgcctgagtatgaggcttcttccatcttcacaccagtctcctcctttagggtgtcagctctccaaggaccaagaagcccactgcccttgatatttgcatcagatcccacactgtgggtttgttgacttcccatctacccttacgctgggtgtcagcagttggagaacaagggtttcgccttctggccccgctgctggtaccccatgagagtaggaagcttcctagacccgggttcctgtactgcgaggtgggggctcttccctctggggctgtgccttctctccagggtaaggaccctttcttggtgtcacctcccccagggataaggttcttgccatccttggtattggtatggctgcttttctggatttgaggtgtccacgcctctgcatgtgtccccaccgtaaggctgaggacccctctcggatgcaggtgcccccggctcatgcttccaaaaccccctcttgatttgtcactgtatggggtaaggcatagtttcctggctgtgtggatgtaagatacctgagtctcaagcgggagactccactgtagaccctgtccctgggaccagagacttctctggtgtagactttccaaggtgggagattccagccccccacccttggcatggggcatctcagtggagatgactacctctaccccaggccctaacgcatc

SEQ ID NO: 92313 - DNA, 3905 bp, Homo sapiens
agttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagatcggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtactagactgacttcctgctgcacctgtagccacatgctccctcttctgaggactgctctttagatacctgccacctgggcaggattctcacagccttgttcctccctggccaggtgagattgatcgctgcctcaagaaggtgtccgagggcgtggagcagtttgaagatatttggcagaaggtacaggggctgagaccctaataatctgggtcttcagagaggagggcacaggaaggcggctcaggacctctgggtgttgaccagcgggaggggctacatatgcagatgctgaggacctaagagaatcagctctaagatggattgggggtaggggttggggggggtcctcgagtccctagcataaggaagaatcactggagtgggtactgggacatcccctcccacactgacttctcaattctctccatccctcagctccacaatgcagccaacgcgaaccagaaagaaaagtatgaggctgacctaaagaaggagattaagaagctacaagtgagggggctgggggcctggacgcctttgtcctgagggtagagggaactgggagagtggactgctgggtcccagggagaaggagctgtgggccccagttcctgggtcctgaggtctgactttcttgcttttcccatctgcagcggctgagggaccaaatcaagacatgggtagcgtccaacgagatcaaggacaagaggcagcttatagacaaccgcaagctcattgagacggtaggagcccagagcctgagtcccagagaggtgggaaggtcaccagattcttgagatcccaaggggcggaggcagagcggccagaccccagaggtcctcaagagaagtaaggtttctgcacctaagggaagtgaagaggcagcggactcagagctcagaaagtagggtcacgaggctcaggtcggagtgtctgctggcccttagtcagctcctttcccacctttgagagcccccctgccaactgcactctctacagcaaatggaacggttcaaagttgtggaacgagagaccaaaaccaaagcttacagcaaagagggcctgggcctggcccagaaggtagatcctgcccagaaggagaaggaagaggttggccagtggctcacggtgagttggggtagagaagaggaggtgaactctgaggatcctgagccctgggtgtaggcggaaccctagctgatgggcttcctcttcctctccctcccctagaataccatcgacacgctcaacatgcaggtggaccagtttgagagtgaagtggagtcactgtcagtgcagacacgcaagaagaagggcgacaaggatgtgagtgagggagacccgacacctttgggatggggatgggcatgggaatgggctggccagcaggaggccagtcatttatgctcctgggagttggggcctggattcctcaggcggacagggccaacagccgggattagggatttgagagacaggattgggagggcttagcagctgcacgcgtggggcaggaaggaggtcagacagaatctcagggtcccctgggtgtctgggtagaccgtggggcctttgtgaagaggagcgacttgggggaaggtgagtgcaggttgagcttgggccacagagtaaaagtgagacctgaaggacacccatggcaagaggcctcctggcacccagagggccctggtcctagggagagcacagtgggtagagacaaggcagaacatggagaaggcagagaaccaggcctgaaggaagacaggagtctgggacaaagctggatgttggggtcccaggttctaaaatccgggattgtggggtatgagttcaaagggatacaaactgtacagacttgctgaaaccagaaagacagggaggggagagccgggtcctcagggaagctgtgggtgggagagggtcaggaagtggaagatgacagggttgggtgtcagactctgaggggtttgggaaccaggggctttcggggagatgatgggtccttgaacagagcagagatttggaaccaaggctaagatgttaaatcctaaaggggccttgaggggagggcaggagcgaggcttaggaatctgggctctctcagggataaatgggtagggttgggggcctagtgatgacagatatcacaattctaaacagcaagctcctcacaaatgggggttatcattgttactgctggagcaggtcggagggtatctgtatgccagaggcagtcacagtggtgggcgggctcagttgagaaatctgggctgtcaggtgaggtgcagatggaggccaagtcgtgggatggcacaaggacctctgggtcttttagaggtttccaaggactcctggagccagaaaggtgtggggagaggaggg

SEQ ID NO: 92314 - DNA, 1028 bp, Homo sapiens
ggacgacgttgagtactatgttgactcatcccaggaccccgacttcgaggagaacgagtttctctacgatgacctggacctcgaggacattcgtgaggccctggggctgatcgtggcacaggaagtgagggcccagaatgggctgtgtgagccagctaagcatgcccttcttctgcccccacagcacaggcgctggtcgccacctcccctcccagccacagccacatggaggatgagatcttcaaccagtccagcagcacgcccacctcaaccacctccagctctcccatcccgcccagcccagccaactgtaccacggtgaggccccacgggacactagtaccttgtgtttccagcagggcaggactcgaggagacaaatctgggtcactccaaagtggctatgggagcgtaattgaggaaacacagatctaggtatccagggtctaggctcttggagcacacgctaaggtcctatatctgggtccctaaaggacataaagagcaatagggtgcatcccgcgccagtttaggtcctggatctgggaagtgggaggggccggtgcctgggctgcctgaggaggctgggtagctggccaccttgggcagggatccaagggttggcttccctgtggagagcaggttcccagatccttaagaggctggtgggtcagtgctggctcccagaaaacaagaagactggagagcctgaattgagatggtttctccaggcagattaaggacagccatttgaccagctctggggccgcaatggcagtcaattgggcccaggtccccggggcattcagagattggcggttctccatcagagccccagaggtcacacaggtttctattctgcctcccctacctcaggaaaactctgaagatgataagaagaggggacgttccacagacagtgaagtcagccaggtgggtgtgagcctggaccgggtgggcacgccattcactcctctgttgcttcccaaaggcatcttgaggcctgagcgccggccactgtgctgggct

SEQ ID NO: 92315 - DNA, 1072 bp, Homo sapiens
tccagagtccaataagcctaggaagcgatggggcctttgctgtgctgataatacacactgcaaatttctgagaggagacggtggcgggcagtgcttcttcaactcctttaacatctcccaggacaggagcacgctttcggaaacgctgctacagaacaatgttaggcaggagcagcatgggcctgaggcccctctgtgggctaacgggatggatggttccaaggggacaccctgagtgggcattgaggaggctggtgtggagactaaggggacccgcaggtagtagtgagggcgggcaacagggccaggaggtgatgaggagagacactgaggcaggtactccaggggccaggctgggctctgccaccttcccaggcccccactgccaagcagcgatgcccaggagagaagtgggtagtcagtcctgttgggcgcttggtaagcgcaaggtgcctgtggggtggctggaaagaagcccaggaggtggttaggctcagcagccggagtgctgtccacagattgcctgcggtagggataccatgagcacatttaccctcccaccactttctggagtgctggtaacttccagccctgtgagtagcttctgtgacccttcaggtgacattcagaattactatccaatttccagctgtttttccttctactcttggacattaggcggctccagctaatctcatattgagaacacttaagtgtttcccactagtcctctggcttccaacagatggatcttctctggctgacaacctaagttgtgtgtcagatccctgtgggggtgtccatggggcggtgtccaggcaggacttgggaagctgggcaggctggaaatcagtgtgagtgttttaagcatgaaggtgattgaagccatgagggtgagtaaggtcacccaggtccccaagagggcaggagcaggtgggggcagcgaggccagagaggaggctgctgggacaaagatggagcctgaggtgggggtggtgagggagaccagctggcccactgggtcctgaccctctgctctctcccacccgcagtctccagccaaaaacggctc

SEQ ID NO: 92316 - DNA, 1065 bp, Homo sapiens
ggctggcaagcagaatggcgccaccagtgagtgaggaggcagcggggtggggggcgtgggcggggctgggcagcaggcagcagccctttccatttactctttgttcccaggttacagctcagttgtggcagacagcccggcagaggtggctttgagcagcagtgggggcaacaatgccagcagccaggccttgggccccccttccggcccccacaacccacctcccagcacctcgtgagtgtctcggccatcggcagggttgggatggcagccttttgaaacagagaggcgcaggcgcctcacccccgcatcggtgggttctgaaccccccgcccttgctgctgggaatggccaagcgctatcctccatctccctcgggtgttacacccccacttctttccagcaaggaaactacatcagcctccctgctttgcccttcagaacattctaaaatacgttctcatctaagtggaagttttctcaagagccccataccctttcctccccatttctgttacctgcctgaggccaattgactgccaccggagggtcactgtttcacttttcaaagtgaattgtcccgaagtccttattcctctgcagccactccttcaaatcttagctcagaccattccactgggtctgcctgtttcccgaagaatgccctaagaaagatcagtgtgcacaaaggaaaggcctgcttcctgccccctcaccccagctccagctggcctgcccaagggggagtgggccctgtgaacacctgcccagggcaagtggttttgatcagcctgtggcctggtggagcacccgagaatcctcacccccacccccacagctctgctctgctgatgagaaaccattccaaagattgggctctgcctttgtttgcccagagaaccacttctttctcccatctgtctgccctcacctgcccctctcagatcccatctgatctgtgcagtctcccctctctccagccaggcctctctgcccatcccaccctcagggaccctcctctcaaccccctcttccatgctctctctccaggaaggaacccagtgc

SEQ ID NO: 92317 - DNA, 1043 bp, Homo sapiens
tctgtcacccaggctggagtgcagtggtgcaatctcagctgaatgcaacatccgcctcctgggttcaagcgattctcctgccgcagcctactgagtagctgggattacaggcgcctgccaccacgccaggctaatttttatatttttaatagagatggggttttgccatgttggtcaggcaggtcttgaactccgaacctcaggtgatccacccacctcgacctcccaaagtgctgggattacaggtgtgagccaccgtgcccggcccaaattttagaagtaggtggacaggatatttatagtgcgtgcatttttctggaaaaagggaaacagcagctttgagattttcagaaggggtccatatcttttaacaccaccaacaacaaaaatgaatcgctggggtgggtggtcgggaaccatggcaaggtttggagtagagaaggaacaacatgacttcattggaaaggtcccctggggctggtgaggacaggatagagggagggtggtctgggcaggagaggacaggcctgggctgtgtgggacatggtggcacgacagggaagggagccatccagtggggtttagaagcaggacggatagctgggcgtggtggctcacacctgtaatcccagctcttagggaggcagaggcgggaggatagcttgagcccaggagtttgagacctgcctgggcgatatagcgagacagaatggataagccttggcgactgactcgttgtggagagtccagcacagggctggggtttgggacagctgcacgtggctggaggagatgggaggaaccagccctgactttggggaacagaagcctgctgtaacctttgtaataggaaacgaggctgtggctgcggggctggagacccaacctacctgtttccagcaaggagactgaagcctagccgggctgggcccaccccgattccagtcaccccatgccagtcacaggcagacagctgagcatgtagacctcctgcctccttcaagacaggcgggagctctcccagcgtgtaggtgtccctagtg

SEQ ID NO: 92318 - DNA, 1006 bp, Homo sapiens
ttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtg

SEQ ID NO: 92319 - DNA, 1044 bp, Homo sapiens
gctgatttttattttttgtagtgatggggtcttgccgttttgcccaggctgctgtccaactgttgggctcaagcagtcctcccagctaggcctcccaaagtgctgggattccaggtgtgagccaccgcaccggcccctctgtctgtttttctgttactgtctctgtctctctgagtttcttgtcccccctgtctctcgttccttatccccatctctcagggtctcagtccctacccttggggtctccccggcgcccagtctctgcccctctcactccctcttcccaccttccttccaagctccctgtcctcctcctgcagacttgagctctgcccacctgcctgtctgaccgcggccctccctccccgccccacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtca

SEQ ID NO: 92320 - DNA, 1017 bp, Homo sapiens
caagtcgctttcgccccgcccccttgtaaatactcatgggtatctggcgaacctgttgactccgcctatcatcctagcgtcacttgtacccaactatctacgaagtaaaccgaagcttgtggccccacccacatccggccgagtctgtggccccgcccacatcggaacagtgaccctaaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtgggccagggtggcggcgcccagtggcgaggcgaggttacacggcggcagggtctctgcgggctggcgggtgcggggcggccccggaggcgcgttggaactcggggctggcgcaaccgcctgtggctctgccggggatgcgctggggtgcgcgggacgggttggggctgggcctgggcctgggcctggggaggggagggtgttcgatccccgggttctcagtaggagaggggtgtggagctccgaaggaggtgcaggttggagacccgggctcctctgggtggtctcgaagaagg

SEQ ID NO: 92321 - DNA, 1141 bp, Homo sapiens
aacactttgggaggccaagacaggtggatcacctgaggtcaggagtttgataccagtctggccaacatggtgaaaccccatctctactaaaaatactaaaactaactgggcgtggtggtgggtgcctgtatttccagctactcgggaggctgaagcaggagaatcatgtgaacccagggggcagaggttgtagtgagccaagatcgtgccattgcactccagcctgggggacaagagcgagactttgtctcaaaaaaaaaaaaaaaaaaaagcctagaagtggaatagttgtgtccaagagcatctgttttagagtatctatagtgatggctgaaatgatctcagatctcctcccagtggtcgttcccgtggcgtccagccgtctgccattggtcactgcttcagtgcctctctccttcccccaggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttcatgatttgaatgtttgcgacagtcctggaacccgtggatggtctcatctgcatgtacaggtgagaaaaaggcctggaggggggggactgacttgcccaaagtcacacacttagtaaatagcaggcctggcctttcaaaattggtttttctgactcctaaatctgcactctttctacctcactaaacttcctcttgaaaagatttctatgaaatttcccagatg

SEQ ID NO: 92322 - DNA, 1717 bp, Homo sapiens
gaggccgggagttcaagaccagcctgggcaacatggcaagacgccgactgttaaaaaaaaaaaaatgctacccgggcgtcgtggcgtgtgcctgtaatcccagctactggggaggaggtgggaggatcgctcgagcccgagaggttggtcggggcctcagtgagccgaaatcacgccactgcactccagcctgggcgacggagcgagaccctgtctcagaaagaaaaagaaaaaccaccgtccaggggcggagaaggaaggttctccctacttctcaggtttccactccctggccggaaaaaacctagtcctcccaggttagcacgccgctctagcccagcctcacgtctccactgcttctcagccagccaacgcctcttctgattggctctgacgtgcgtggtgcgtgaaaacgtcacgagacgccggcgttactataagagcgcagccgtggcgcttgcgcgcctctttctcagtgaccgggtggtttgcttaggtgaggtgcggcggtgtgctttttctctagggtttgggttggatggtggcccgggccttccgagtttccatgagtaagctaaagacgttaggaaacagagcagggtggttgaacgggagtgcagcacggttgtgggggcagatactgactatgagagcgttggaggttattctcgcgagatcggatctgggctccgcgaggttttggcgtagttgtgggactgcgcaggcgccgtttggagcccttacgctcacacttctctcccgcgcaggcgcagacggggaagcggagccaacatgccagtggcccggagctgggtttgtcgcaaaacttatgtgaccccgcggagacccttcgagaaatctcgtctcgaccaagagctgaagctgatcggtgagtggccaaggcttccgggaagtggttcggcttccgggaggcggttagcacgtggatgaaggtgcccatgtactctatctagtccgtcccctaaatttggtactattcgtggtttaggaaggttttgtgattccaaagctgccagtctagttgttgtgccagtacgtgggactacacttgtccacccccttctccccaccaggcgagtatgggctccggaacaaacgtgaggtctggagggtcaaatttaccctggccaagatccgcaaggccgcccgggaactgctgacgcttgatgagaaggacccacggcgtctgttcgaaggtgcgtatgggagtccacagcagagggatggggtgcagggcttgtgaggttcattctcccttctgttgcctctgttccagtgatgagagttgtgtcattggataaatggaaccagccttctaacttttagtggcacttgtgaagtaggaaaagtgtatctggatcagtctttgccctgtttcttaggtgtgtggcttttttgcccagttattggaccttcagtttagtaatgaccagagctaaagataggcctggcacacctgggcacccgtctatatctttatattctgtttatgtggcctgtttgctagtggatgagagtagactatgaagtggaatttctgggctaagtgatggtgataacagggtttgcacatttgcttggtttattgtttttttaattaagttttctcgttttatttagtcttttgagacggagtcttgctctgttgcccaggctggagtgccgtggcgccatttcggcttactgcaacccccgc

SEQ ID NO: 92323 - DNA, 1126 bp, Homo sapiens
actatgaatgatgacctgacaaccatagggtagtttggttttttgtattgttttgttttgtgacagggcctcactctgtcgcccaggctggagtgcagtggccccatctcaggtcactgcaacctccgcctcctgggttcaagcagttttccttcctcagcctcctgaatagctgggattacaggcagtgcgccaacggcctggctaatttttcgtaatcttagtggagacgggctttcgccatgttggccgggctggtctctcaaactcctgacctcaagtgatccgtctcggactcccgaagtgctgggattacaggtgtgagccaccactcccagcccgtagggtggttttgacagtgacatgggtcacggtgatggcgctgtactacttgtgcctcaccgccgcggcatggagctaccaagaggcggagccaggatttgaacccaagaagcctgaggtcagaaggcggaatcagtgtttcctcccactcttcccaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcaggtaccacctcggatgggcacctgaatcttcctccacctgcccctctgatggttgccctcactaagcctgctgtccctatctcctatgcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagct

SEQ ID NO: 92324 - DNA, 1214 bp, Homo sapiens
tttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaattggtgtgtgggggtctctcatccttgactctttcccctgctctaaacatgcagccttccctgggaggctcactcacttgggagtgcctaccagctagtggtccctggcctctcagtactattctacagtagtgaacacacatctttaccagaaacttctgtcatcaggggagagacgagtggtatttttggaaaaactgtgtcaaaaccagaaggaaattccaagtaagccggtgtttgcatataggggtgggagggagccggtcattgctaggcagggcaggcgccgagtggaggtgggggccttccctgcctgctggccctgggaccctgaccccgccaggcaagagacaggtgggacgggagctgaccagaggctgacgggttgctggggaaggtgaactgttggtgattgttggggaacacttcacagaatttgcttgctagtttcaaagcttgtgatgcggttgatgttgggcaagttcccagttttgt

SEQ ID NO: 92325 - DNA, 1032 bp, Homo sapiens
acgcctcccccagcctggcccgaggcaccaggaacaggtgcccccacacccccacccgccccctgatcccacacgattgtggaggggccttggcaggtccttgggaaaacctccattccaactgctggctgcagagagaaggaaacccaggctcggagaaggggcggttcctgctaaagattgcacagccaatggagggcagagcagaattgggacccaaggcttggggcccccagttggaagctccctccagcaagctggccctgacacctggagccccagctgccagcctgggaggggctgggacccaatctcccccaagattaggccagggatgtctcccaccttcactctgacatcccagaccccgaccccccagccacgcaggaagggggatctgagtgtggaacacacgggtgccctcggaggtctgatgtcacccccttccccaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctggtaatggggccccagggtgggtgggcggtggggacagggctccccaagctctttgctggccttcctgggggtgtcctccggggacatggaggaagcagacaggaaggaggaaactccctcgtccctgtccctgccatttgcaagcccacttcagcgcacagcaggaaggactgtcccatttgatggatggagaaagtgaggctctggagaggaagtgaatcaagggcagccatctggtgagaaggcgcaggggcagtcagatggcctggttttggtggctctcccattgaatagctgtgtgacctaagggagtgatagtctccctgggcctcaatttccacatctgtaaactgggcattatcatctcgcccacctcctgcgggggtaagatggagagaaag

SEQ ID NO: 92326 - DNA, 1022 bp, Homo sapiens
ttgtaggactctgaacaatggggcggggacactgggcgtccgacccgagggatgggggtggaggcccagccggggctgggaaccgggagggtgtcaggctcccgccccctccactgcgggacaccggccgggggcggggacgggaggggtctggggccccacattcaggtcccacaatggagctctgtgtgtcggtagggtgggggcgggggcacggcttctcgcccatcctccagcctccctcccacattcccttacttccctcccagctggcccgacgcttgggtcccgggtgggggaaggccgagagctccaggctcagcgtccccccaggagatggtggcagctgccccccttgtacccttaggaacccccaggaggtgggggcggagaacgtctcagcactgaagggttggcactgcaggccccaaggaccctagggcaccctaggacaggtgccaggagggctgcctgcctggcaaaggatgcgggggaagggtgtggggcaggcagtcctagggaggggaagacggcccatcccggagctgggtgtgactggggttctgctccagggaggtgcgagttaaatcgggggctccctcccccccaccactccacccaccattaacatcacaatgacgtccctccgctgggggagtgaggccttcccgttcccttggcaaccgacgggggccaggctgaagtcgcccttttcccacgggctggcccaatgaggtggggctgagatgggaggggtggataagaaggcgaggtggaggggatggggtgggaggggacggtggcccccggggtcctgggacccgctgagattcctctccctcctcctccgctcagcactggcattggcatcggtttctatggcaacagtgagaccagtgatggggtgtcccagctcagctctgcgctgctgcacgccaaccacacactcagcaccattgaccacctggtgaggggccagcaaccagtgggaccccagacccacacctggacgggctccccac

SEQ ID NO: 92327 - DNA, 1864 bp, Homo sapiens
tgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaaatcaaaaaacaaaacgctttcttctgattctaaaagtaatgcgcgtgtcctgacacaggaagacacaggcatctctggcacagaatagatggcctagaaatagatctaactgtgtgtgtgtgtgtgtgtgtgtgtatatatatatatatacacacatgacagaagacagatttcaagtcagtgtggaaaggacggttggtttagcagcagtagtgacatatcggctctccatctggccaaaaacttctatagataagatgggtggaagatctagatgtatgcaagtaaaggcacagaagaatttctagagaaattaggagggtgggcatggtggtgcatgcctgtggttccagctactcgggaggctgagactccttgcttgagcccgtttcgaggtagcagtgagctgtgatcgtgccactgcactccagcctgggcaacagagcaagaccctgcctctttttttttttttttttttgtttttgagacggagtctcgctctgtcacccaggttggagtgcagtggcgcgatctcggctcactgcaagctccgcctcccaggttcatgccattctcctgcctcagcctcccaagtagctgggactacaggcgcccgccaacacgtccggctaattttttgtatttttagtagaaacggggtttcaccgtgttagccaagatggtctcgatctcctgacctcgtgatccgcccgtctcggcctcccaaagtgctgggaatacaggcgtgagccaccgcgcccggccaagaccctgcctcttaaaaaaaaaaaaaaaaaaagacaaaaaacagagagaggctggctgcggtggctcatgactgtaatcccagcattttgagaggccaaggtgggtggatcccttgaggccaggagtttgagagcagagtggccaacatggtgaaaccccgtctctacttaaagaaaaaaaaaattagctgggcatggtggcacaggtctgtaagcccagctactcgggaggctgaggcaggagaattgcttgaacccgggaggtggaggttgcaccactgtactccagcctgggagatcaagtgagactccatctcagaaaaaaacaaaacaaaacaaaacaaaccagagaaattaggagaatatttgtatattgtctgcatgtcatgtatctgggtagggaaaatggggagggaggagtttaagcaggagatcataaaaccagaaaggaaaagatagcttagttggcaaattatagattgaaaaacataccgtaaagtcaaatggcaaattgacagactggggaacagtgagtgtgtgcgtgcgtgtgtgtgtgtgtgtgtgtgtgtgtgtgtgtgtgtgtatgttaacagttatgatgcagaaatgttattcttaaaagatataatctacaaaagctttcataaactaagaaaaagacaacccatttaaaagtaatcaattgagttgaatactcaataaaaattccaacatcagtaaacagacaaaaagattcaaactctaataattgggaaatgcaatttgaaagaatgagaaactacactttttcactacctagacacaatgaaattaacaagagtggtgatgtcctgggcgggcgaggacctagaggaacaggcactcaaaacacttctcctgaggctgtgagc

SEQ ID NO: 92328 - DNA, 4417 bp, Homo sapiens
gtgatgtggttctgaagagggaggccatgcccatgcccctggtctctaacgtgcgtgagtctcatggtagagacagtggctcactttgcagatacatggacccagtttcatcccttggcaattggccaccagtaaacaggcttgccctttgggggccgtgtgcctgtggatttgggctgctgacggcacatgtgcctctctgcttccacagtacgtgtcccaggcagaagcctcagctttgcagcagcagcagtactaccagtggtaccagcagtacaactatgcctacccctacagctactactatcccatggtgagtgcccagccagtggggcggggcagggcgaggtggagtctgctgggtcggggcgaggtgaagtggagtctgccgggatggggccgggtggtggatggactggagatcgcagtgataactgctcagaaaccctctaacttgcccaggaggtaaattcctaggtccccgccatgagccacaaggtcctacatacccggttctggtcccttctctcctcatgctcattctgccatggccatcgaagcagagacctccttgatgcccgcacccgccaggcccgctctcgctttgccctggctgcagtgctccctgtgttgccgcctcttggaggtctctgctcagatgccgccttcagagagcctctacctgacacactgattgaaagtagcattcctgcctcgcagcctgtccctctccctttctttgccatcttattgtttcatgatccttattgctggatgtattacatgttgatgtctccagccggacatgtaattccagcacaagcttcattacagcatgggttttccttttgttctgtcgtagtgcttagaagagttggcactcagtatcgttgattatattcttccgagaactagctaagtgagatgtgggattgatagaggtttttcttttcctaatatatgagaggatgtggtgcattaatatagtggagagagaaaggggtgagggattggtagagggtcatggctggtgtagttcctgagcaggctggggaagcggaaagggtaggcctcccactaaaccctccctccctgcgcctttgcagagcatgtaccagagctatggctccccttcccagtatgggatggccggctcctatggctcagccacaccccagcagccatccgcaccccaacaccaagggactctgaaccaggtaacatcctagcccagctcccataccctgctcaagcagaggaagtgtagatttttgaatgagctgtcaatgaggaatggcttgtactccttaagctgcttttttccttccaagcaactcctgatctgaaaatgaggaggacagagcatagtgtttgaacctggggtgggtttaaggctgagccaaggccagggctgagatgttgaaagacatctcatctttttccctagcatggtcacccacaggcgtgcacacaccggctgggttttgcattgaatgtgcagcttggaggaatggccgggctagtgcacaggaggcaggtagacctgggtttgaatcccagctgtcccacccctggtgtaattacgcatctcggtcagctctcgaaagcgggaaggatggtagcctcatccttgggctccatgagtgtgtgtgctcatgggtgtcttgtgctcagatggtagcgctggagtgggtgtgttgtcggtggctgttactccagcattgaaacgctgccagctgccgcttcatagcttagggccctgggaagtcgcttagtctctgagctggagccttgtcagctgtgaaaagggctgttaacaaatgttaacctcacagagttactgaggactcgaatgaactcacatttgggaaggtcacgggagggttgagtgctgagtgctgtgaccaccgcgtcctcacagcgagggctgagtgccactcgccagccccagaatctgcctcccgtgctcagcgcctgcttccttctgcagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcgtaagttggcagagctacgtggaggtcggagcggttgggccctcacaagagctcctgggtgtgaggcccgtggtgtgtgctgctccttgtttctgggtgttgtgatcgccaggctgggggtggggctgctctggaccaggcacatgtgtgctggagccctcctctagaacctgagcgctcctccctgcatttccacttcctcccgtcccctggggacccctggatgtgccggggaagggcctaaccatagctttcgctgccctcacagccgcccctgggactggaggtctcaagttcaacatccagaagcgaccctttgctgttaccacccagagctttggctccaacgcagagggccagcacagtggttttggcccccagcccaaccctgagaaagttcagaaccacaggtgacgtctgcccccttgccccgtcgcagccccacactctgcactcagcgtctatggtccagtcccactggccagctgcccaccctgagcctcagtgtgcgcctctgaaaagggcagaaggaccctctcttgggggttgctgtgagcactgaaggagacagaaggaaaacttggggactgcgtcccgctgtgtcagctcagagtggcggtggggatggtcttttgagtttgggatcgtctccagctgagcccctcatctgtcctcccgcagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggttagtctgggtgggggacataggtgggagggtggtgctgtgagaggcatgggctgggtatggaggtaggagagttgcgggtcccaggtaccaggagctccaaagagaaatgaaccggaaagttggatcctggggggatgaagtcctggttggagggaggccggtggggtggggtggggaccatgggtgctggagaggcgtgcattgctcagtggttaagcgcaccctctggagacggaaaacctgggttcgcgtctcatttctgcactgtagtagctgagccgcctggggtaagtgcctttcctttcggaggcgggtcggtaccttgagggaggtggtggcggctgtcctgccagtgtctggcggggttggtgacgccctgccctgctgtattctcaggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaaggtactgaggctcccggctggggctgtgtgtgagggagggggaggcgtttcaggcctgaccctcctgcttcttcctgcagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggtgagactgtgtgagggctcgacacacgggccagggtggaggagggtactggggacccatgggagaaggaggaggagggccggacaggtggacagccagctgccaaaggggcgaggctgaaggggggctggagacgcctgtcgcgctcactgcccctcatcccttcctaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctg

SEQ ID NO: 92329 - DNA, 1512 bp, Homo sapiens
catgtcttgtgggtttgttttctctttttttgggagagagtctggctctgtcgcccaagctggagtgcaatggcgtgatcttggctcaccgcagcctccgctccccggcttcaagcgattctcctgcctcagcctccctagtggctgggattacaggcgtctgccactacgcctggctgatttttgtatttttagtagagacggggtttcaccatgttggccaggttggtctcaaactcctgacctcagatgatccacacacctcggcctcccaaagtgctgggattacaggcgtgagccactgcgcctggccttttttttctttttttaatgttgcaactctcccaccaaataagtggaagccgttggccacgctacctgagttgtactccgagtgtgaattcagttccctttttcaggttttgaaaaagtcgctgtgcatggtcaagtgccactggaaagagaagcaggactacgcgtttgcctgcgagcagatgaagtcgatccggcaggatctgacggtgagactcgcgctgggaggggcctggcctcagccagtcctgcctcccgctccttgtgactcttgttctcgccccgctgccccaggtgcagggcatccgcaccgagttcacggtggaggtgtacgagacccatgcccggatcgccttggagaaggtgagctggcctctgcgggcctccccagcccctttcctgctgccgttctgccctcagcaccctcactctgctctcctccctcggtgcctctgccttccagggtgaccatgaagagtttaaccagtgccagacgcagctcaagtcgctgtacgccgagaacttgcctggcaatgtgggcgagtttactgcctaccgaatcctctactacatcttcaccaagaactcgggaggtgaggcccagtccccaggacagaggccatggtacccagggttgagccctgctgacttcaccctctttgtcttggtgctagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactcct

SEQ ID NO: 92330 - DNA, 2169 bp, Homo sapiens
gagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaacccccccccgggccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccaggcggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcag

SEQ ID NO: 92331 - DNA, 1047 bp, Homo sapiens
ggaagcacagagccctgggacagaacgaatccactggagaccaggaacaaggccagatactccatcccatccatgacacagcaccatgcagtgagatatcagtgttactatctcagccctgcgggctggtcagagcccagtgaccccctggagctggtgatgacaggtgagaggacactcaggggtcccagccccaggctctgccctcaggaagggggttggctctcaggggtgtctccctctcacagcccagccctggggatgatgtgggaggtgggagccccatttaacatggtgcctccttctctcctaggattctacagcaaacccaccctctcagccctgcccagccctgtggtggcctcaggggggaaagtgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatatgaacaccccccaggtgtggtcccaccccagtgaccccctggagattctgccctcaggtgagggagccacggccttgtctaacacactttccggacagctgacaggttgtggggagtttggctggtgactgaatctggaaaggacccagagtgatgtgttgatggatgggctgaaggcatgagggagaccccatggggaggctctgacatgggaggacagagctctccccctgtcctggcccctggagagaccctgaccctccagtgtggctctgatgtcggctacgacagattcactctgtacaaggagggggaatgtgacttcctccagcgccctggccagcagccccaggctgggctctcccaggccaacttcaccctgggccctgtgaggggctcccacgggggccagtacagatgctacggcgcacacaacctctcctccgagtggtcggcccccagtgaccccctggacatcctgatcgcag

SEQ ID NO: 92332 - DNA, 1092 bp, Homo sapiens
ttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggac

SEQ ID NO: 92333 - DNA, 1023 bp, Homo sapiens
gggacccggagctccctgaccggggagcggggcttccttccttctctctgagcgagtgtggactaaatgccctgtgggctgattgcagggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtag

SEQ ID NO: 92334 - DNA, 1029 bp, Homo sapiens
tccacacatggccttctccccatgtgtctctgtctctgttttcccttcctataaggacaccagtcattggattagggctcaccctaatgaccgcatcctgacatggccacttcggcacagaccctgtttccggcacaggccacattcacaggttgtgggagcacaggagtgtttctgctggtgcatcaggctggggtctgtcctcaccgggatgtctcctcctccacccctctcttccagaggaggagcgagtggacattctaatcaacaacgcgggtgtgatgcggtgcccccactggaccaccgaggacggcttcgagatgcagtttggcgttaaccacctgggtgaggcctgggcaggggctgcaccatgggttcaagcgatcctcccccgtcgtcctcccaaagtgctgggattttaggtgtgagtcaaaagtgaccttttcatcatccttaatccaggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggtacgggggcgctaggctcggcctccctcttgctttactctgagcctagagcggcctttccatgatcctaggctgatgggaggccaaacggtggatccagaacagagtcagcaaaagtagagcatgtggaccacgctgcccgcttctggtgcctgaagcagacatcactaatcgatcgttcttctgaggattgtctgttcatcccaggtggtctagtctgcctggatcagatgtccttccctgctgctgttgggcaggcagctcagccttttggctccagccagtgagtctcaaccaggggcagttttgacccgcagttgtcaatgcctggaaacacagtgatcacagctggct

SEQ ID NO: 92335 - DNA, 1052 bp, Homo sapiens
ggattcgaacctatttcactccagaactgcgtagcgccttatacgctgcggcaagtgtgacgtcattcgaacaaaccataggccccgcccccggactagccacgcccacaggctcctgaaaccaccaatcccagctgtgacagcgctcaggaccgatgctcataggtcccgtccctaggatccccgccccctccgcccgcgccccgcccctcgcagcccagttccggacgcgggcccagccgcgcctgcgcctccgctcgcctgtggctgcgtcgcgcgctcttcctcggagctacccaggcggctggtgtgcagcaagctccgcgccgacccctgacgcctgacgcctgtccccggcccggcatgagccgctacctgctgccgctgtcggcgctgggcacggtagcaggcgccgccgtgctgctcaagtgagtacattctagccccgcgtgcgcggtcaaggcgggcccccagcgcaggggccgggaaggcggcggagacccccgcccctcgcacccgggtccaggccccgtagctcccgacccgcagtgcccgcccggagtggggcaaacctgcgctctggccggccaggtcaccggcccaaggtcactcggagggaagggcgagcctgggcccttgtaaatgttgctttccttccagacttttaaactctttattttgttgttttgtattatttatttgttcgtttatttttaaaggcagaatctggctctgtcgcccaggctggagtgcagtggcgcgatcttggctcactgcagccttgacctcctgggctcaggtgatcctcccaccttggcgtccccaggagctgagatcacacgtgcgccaccacgcccggctaatttttgtatttttcgcagagacggggttttgccatgttggccaggctggtctcaaacacctgccctcaggtgatccgcctgcctcggcctccaaagtgctgggattacagacgtgagccacctcgcccagcctacttaatttaaactttcttaaaaattagcctctgtggctggtggccactgtattgc

SEQ ID NO: 92336 - DNA, 1159 bp, Homo sapiens
ggtggggcttagactgctgggaggtagagcctggcctgggggtgccggcggggctgggcttcacttgaggggcggggccgagatctcggaggcggagtctgagcgaggggatggggctgtgggcctgccggtggcggggcctggcccgtgggggaagggcttgtgggctgcctagtgggcgggcgggtgcccagcaggagcctaggacccttcagagcagtgctggcttcttctgctgacccctgtgctttctgtgtcctcaccagaggcaagaacgcttcgctgagaggccagccctcctggaactggagagattcgtgagtaggggcagtggggatgggggccagaggcgtccccagcctcacatccctaagtttggaccaagggagccacattgcccttcccagctggcccctggccttcccctgccctcctcagcctcactcagtttctgcactttccctgttcattccaggagcgcagggccctggaacgcaaggccgcagagctggaggaggagctgaaggtgggggctgtgggggctgtgggcagagggccgagggtgggtgggggtgcaacccgccagggctgcccagctgacccttgccgtcccccaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttcta

SEQ ID NO: 92337 - DNA, 1157 bp, Homo sapiens
cagctgcgggcgcctgctggacgcagggcacctcctgcccctgaggtgtgtggccatctgtaggaaaaccagtaagcccacgagccctcggtgcccgcctgggcagtgagctcctgcacagctgtttgtggtggtgttgctgtggggcacgtgtgctccacccctcccctgcagcccccttccctccttgcagcttcggaaccaaaaagaagcttcccagagccggggccaggagccccaagcgccctctagcagcaaacacagaaggtatagggagggaggagtccagggctggcggggtggctggaggccccgggcttgtaccccagcaccctctccttccccaacaggagctctgtgtgtcgtctgagcagtcgcgagaagatttccctccaggacttgtccaaggagcgccggcctggtggggctggggggccccccatccaggacgaggatgagggggaagaaggtcccaccggtgaggggcctgaatctggactcctgggtccgagggaggaggggtcgggttctctgaatctagaggcaactggcatcttctgtgacctgcccggtgttcccacatcacagaaccaccccctgcagaacccagaaccctcaatggcgtctcctccccgccgcaccccagccctaagagtcccgtggtgagtggatgccctgagaggtcctgtgaggctgggagggcccggaggtgggattccatacagcctgtgaacctctggcaggggcagatagggggaagactatagttcccagagtcgtcctggacaaccggcttcctttttaggctgtgcctgccccgggggctgatgggaattgtagtttgttgcagtcctttgggggctaacccttgaggtctgagaagagggatcctttctctctaactgagacctcctccttctcccagcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggtgagtgagggttgggccgggtccaggcccaggcccctgcccagtcgagggaactgccccttcctccccttct

SEQ ID NO: 92338 - DNA, 2101 bp, Homo sapiens
ttgaatccaggaggcagaggttgcagtcagtggagatcgtgccactgcactccagcctgggtgacagtgtgagactccgtctcaaaacaaaaccaaaccaaaacaaaacaaaaaaacatttgttgcagagtagaggtatatgtttatttgatgatactcattcgatgcttatttttgagcccctgctgtgtgccaggcagtctgttaggtgccagggaaatgggtaaacaagacagatctgggcctgtgtgcggctcatagcctcgtggggagacagacattttgggctgatcgctcttgctgcggggccgtcccatgcatcacaggatgtggggcagcctccctggcctccacctatgggatgttgggagcatccctggttgtgagaaccaaaaatgtctctggacgtggccaaatgtcccctggggggcagcattgccccagttgagaactgctggcttaagatataaatagggttatgggagaagacaagtgtgatgaggaggggctttggggtcaggagacagggggatgagggggtggtgactgccaaaaaggggctcagcgtgagatgctgcagggcacagaacactgcccggctgagagcagcaagtgcagaggccagcggcgagcggacgcttggggaaatagcgagggcccagcacagctggggcagggtgagctccgggcaaagcgtgggaaaggtgaagggcaaggtgggcgggaccagagagagggacttgtgcttataaggcctctttgtagaatatcccaggctgtccatctgttcccactttgtgaagctctttctcattgacacagaaactcattccagttctccaaaaatagacacgtcctaccgttaagctgagcttggagagtggccttggacttgtaaccctgcctttgccctcagattgaatggtttaaggtggttattgttttctcgcagaacactgtctcgggtgagggtttctcagcctgggcgctggcagcatgttgggtcaggtccctctccttgtggggctgctgctgagcgctctgagcgcagccgggtgtggagcagcctccctggcctccacccagccgatgccgctaacccttgccctaagttatgacaacaaagatgtctgcagacctgccgggtctcccctgggggacagcattgccctggttgggagtcactgctttaagccagcccgggtcctagagcactactgccctgagacagccctttgggggtcccatccttctgacaggcatgggggctggcaagggtcctgcacttgcatcctccggagctgcctccttacaccccgctgctgccaccttggaatcccacagccagggtgaccccctgccagcaccaggagcaggttccagaggccacctgcagggtcagggtttaacatgtaactgctggtccaaggggagggacaaggcctggtgcagaggggcctcttgtggcagcggatgctgggcagtggctctttaccagcctgtccagggacgtttcagtctcgtggcctgggacctcgttaccaaaccgctggccgaaatcagccctcggccaagggccccgccttggcctctgaccctgagcctccctggcccccaggttgctccttcaggctggctacgacccagagctccgggacggggacggctggactcccctgcacgcagcggcacactggggcgtggaggatgcctgccgcctgctggccgagcatggcgggggcatggactcactgacccatgcggtgagggccagtgcccaggctggtgaggggcagggcgtggggagggcccagcacctccttcattgtctgatcctgctcctcccctgacccaggggcagcgtccctgtgacctggccgatgaggaagtactgagcctgttggaggaactggcccggaaacaggaggacgtgagtgtcagggctgaggggcttaccccagactccccatgtcccctcagctcctcagaggagggtgcagagggggaacccccccgacttctgacacccaccaccccagcgacctgctatttccctcttggtgacccagccccagccccagcctcaggagagacccccagc

SEQ ID NO: 92339 - DNA, 1050 bp, Homo sapiens
tttttttgtagttttagtagagatggggtttcactgtgttggccaggctggtcttgaagtcctgagctcgtgatccacctgccttggcctctcaaagttgctgggattgcaggcatgagccactgcacccggccatggttttatattaaaaataataaaaatacggtgaatttctggttgaaatggggaaaggcctgtgatctccgttttcccagtgcttagcgctgactcagagaccctgagtgggacacacgactgcatggagtacagttgggaaacaactgggctagtctgggcctcctgagtctcagaggggagcagggggaagagctctgggcaagtcactgggctgaaccctggccagcccagtgtatgaccctgggtatttcaggtcatggggtgtgagtcctacctcgtgcctcttatcctcctaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggtgagttgggccagtctgttccatcttgctgtcttataccttcctgtggatcttgtcctttccctttctttttaaatgtatgtaccgaaggctatgtatttccctctaaatacagccttagctgtacccacaagttttgatgtgcagtcttttttttattgtcattcagtgtaaaatatttcccaatttgtaatcttttattatttatttattttgagacagggtcttgctatgtcacccaggctggagtgcagtggcacagtcgtggctcactgcagcctcaaactccccaggctcaggtgatcctcctacctcagcctcctgaatagtggggactacaggcgcacaccaccatgccccgctaatttttgtagagatggggtttcaccatgtggcccaggcttgtctcgaactcctgggctcaagtgatcctcctacctcagcctcccaaagtgc

SEQ ID NO: 92340 - DNA, 1006 bp, Homo sapiens
ggacctgcccctggacctggccgagtcggacgccatggaggggctgctgaaggcggagatcgcccgccgaggtgggctctggtgtgctgtgtgtggggtgggggacacctcctcacccgtggtctccaggctgagagctttagaggcggcctgggcaccgaggctgaccctgcttcctaggattgtctttctttgtgcctcagtttcctcacctgtgaaatgggggtgtaggggcctgcctccaggattgcttggagcccagcacacgcacaggatgagaactcaaacccctaccaactgggactgtcaatccccctgagtaactgaggggattggaatgccggggcggggtgggtgggtggagggactcacccaggagtgcgttaggtaggattgctggaaccctgccgcaggtctttctgggaggggatgcgtttacttgggggggagtaggggcatgcaggggttgccagggactggtctccctgtcctctgagactcatcgtaccccaggagccttcatatggggtccaggagcccctgaaactgtgtctggccaggttcatttttctagggaaggggtgttgcttctagcaggtgtgtgatggccacacaggatccctgggtccccagcatgtcttctaaagtcctgggcttgcctcccagctctgcctgtgactggtgactccaggcacgtccctgaagcttgcttccctgatttcctaaaacaggaccactggtgccgcttcatggggtggttgtcagggtctggctgggttggagtggaagggtgtgagcatggttcccggcagactccaggggaccgtgtggaaggaaagggagactgacgaggaaatgagataccggcagcctccgagacttctgacgcggctgtcctgacggggccgctggccaggctgaaaggataggattccgcgtgggttcaggggtccacgagagccatgcgggaggactagctagtgggacacgtgacggcggagatctg

SEQ ID NO: 92341 - DNA, 1025 bp, Homo sapiens
cgcccccctgctgtggctgttcccaagttcttagggtaccccacgtgggtttatcaaccacttggtgaggctggtaccctgcccccattcctgcaccccaattgccttagtggctagggggttgggggctagagtaggaggggctggagccaggattcttagggctgaacagagaagagctgggggcctgggctcctgggtttgagagaggaggggctggggcctggactcctgggtccgagggaggaggggctggggcctggactcctgggtctgagggtggagggactgggggcctggactcctgggtccgagggaggaggggctggggcctggactcgtgggtctgagggaggaggggctgggggcctggacttctgggtcttagggaggcggggctgggcctggacccctgggtctgaatggggagaggctgggggcctggactccttcatctgagggcggaagggctggggcctggcctcctgggttgaatggggaggggttgggcctggactctggagtccctggtgcccaggcctcaggcatctttcacagggatgcctgtactgggcaggtccttgaaagggaaaggcccattgctctccttgcccccctcccctatcgccatgacaactgggtggaaataaacgagccgagttcatcccgttcccagggcacgtgcggccccttcacagcccgagtttccatgacctcatgctcttggccctcgtagctccctcccgcctcctccagatgggcagctttggagaggtgagggacttggggggtaatttatcccgtggatctaggagtttagcttcactccttcctcagctccagttcaggtcccggagcccacccagtgtccacaaggcctggggcaagtccctcctccgaccccctggacttcggcttttgtccccccaagttttggacccctaagggaagaatgagaaacggtggcccgtgtcagcccctggctgcagggccccgtgcagagggggcctcagtgaactggagtg

SEQ ID NO: 92342 - DNA, 1031 bp, Homo sapiens
ccacacccgtccgcagggagcagccggaaggtgagtagggagtgggccggccctatgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaaggtgaggtcccggactccgcaggtctggagctggggggtgggggggcggggacgctgggcccgggaggagggggcgggatggggctcccgacggcctcggctcccggtcctctaacagcctctcacgtctcttccctctctcccctcccgcgcccgggcgtggccgctcccccctcgctccccaaaccctcgctgctcctccctcccctccccagcccccgaagagccggagccggtggcagagccaggtaaccgcggctgcttcgcttcccgagaccgatgtcgggggcccggggggacccccgatatcctcgggccccaacctccaagaccacccttccctccctccgcccccataacccgcccccaggcccggtcctttaagcccctgagagctcctgcgccctctcggggccgggaagggaaatggccccgcagtggctttaaccctttcccttccttcttaaagggaccgacacccaagccttcttccccagtctggaggaatctttacagaagggttggatgtttgcggagaagcaccaccccatccccccttatcttcgcctccaaccttgtctgttattttctcccccatatacattcaaaggttggggcttggaatttaggattgcagaggaggcgagcgctgggagtcagggtctccaaggtcgg

SEQ ID NO: 92343 - DNA, 1071 bp, Homo sapiens
tgcctgccaggctgaccttcccagaactttccaggagcctaccttagaggattttttaaaaagctgcaagaggacaaaaagtgttatctccaagtcctgtgtgcctgcccagctctgcccagctctgtgtatctctctggttttccgcccttatggctccgcctgtcagaggtgacccctctatccccttcccccagcagccccgaccccggaatctttcaccgtccacttcctgccgctcgattctgctcagactctccaccacaagagctgctacaacggccgattccagctcctctatgtggcctgtgggtaagcggggaggcagctgtgctcacaaagacccaggatcaggcccccagcccctcctccctcagacccaggagtccaggcccccagcccctccttgcttagacccaggggtccaggcccccagcccctcctccctcagacccaggagtccagacctcctgctcccttctttccccaggacccagactccagttttgccacccctcctccctcattgtctgggatcccagagccccatcctccctccggatttggagctgaatctcagcctgtcctccgtcctctctgcagtatggtccatcttctcatccctgagcttggggcctgtgtggcacccggagggaacttgattgtggaattagcccggtgagtcagtggggtggagggtggggaacatcctggctggggatcaaaatctgggtccctgacagggcgcttcccatctgcaggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttca

SEQ ID NO: 92344 - DNA, 1016 bp, Homo sapiens
tgcatgtggggagacctgcaaggaggctcggccagggtggggcctggtgctctgggatggtccttctcttaggccctgaggggtgacctcggggccattcccaggatgggccttcctcactggtaccccacccctctcccgccaggcatggccgcctttgccaccgcccacctcctctacgtctgggccttcggcttctctcccctgcagcccggcctgctgctgctcatcatcctggcccctggcccctacctcagccttgtgctccagcacctcgagccggatatggtcctgccggtggcagcctatgggctgatcctgatggccatgctgtggcgcggcctggcccagggcgggagtgccggctggggcgcgctgctcttcacgctctctgatggcgtgctggcctgggacaccttcgcccagcccctgccccatgcccacctggtgatcatgaccacctactatgctgcccagctcctcatcacactgtcagccctcaggagcccggtgcccaagactgactgactagggagcttgaagggccggtgttcaggccctctcctcctgcaaggacctgggcctcccagcccagcccagcctgagaaataccctcagcagcgaagcttcctgacgcctgtctgcaggcgccgctgccgccgtcgcttctggctgaagacgtttgaggacgatttgcggaattccaagtccactactgggttccagctgccttcccccggttctgactccagatccctggctcctcagccaggcccacatggagccctcccagccaccagcctgcctccatgttcactgtcggccccacagcctgcccgccccctgctgctgctctgaatccgttttccctgtgggtgtggaaccgtagatgttgctgttaccgtaggagaggcctcggggagggtcatgattgtgataaaccatcgcggttaatgacagcagaaggttctttgtcgctccccatggaccaggcctggtgcccagtgggaccctcc

SEQ ID NO: 92345 - DNA, 1727 bp, Homo sapiens
gaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacgattctgctggtcagaccttacgttctgggatgcggggtggggagcctgtattatccctgcaccccagaggctgggggtgctcctgacccagtctgcccccacactgtcctgccagagggagccctgtggctgcagaggccccaggctgggccaggcactggctgtgagggctcctgccaggtctaccccacctgtgggcagggccttgggcagaggatagaagccaccgacaggctcaaatccctgctcctgcccctgcttacccccagtaaccaagcccagcattgaggctgggtactggcgcccagtaggtctgagtctttcaggtagaaggtagaagtgtaggctgcgtgtgcagcgagtggcaccggtgagcggcgctgggaaaccggagcgtgtggaccgggccatgaggacagcgtcctcactggggtggcagttggcttggaggtcacctgggggctcgctcagctaacaggagagggtgcttgttccccgcattcgtggtggtccctcctggtcacccattgaagcagtgtttgtggtggagcccctgagggcttggtggggttgagcagaatgaggaaaggtttcatggagcagggagggagacggctagggcagcaagtgaaggacagactcgccttcccatccctccaggggcactcctgccagccagcccctctcccgcttcccatgatggggtggctgttggaattctgcaccccatctcttctgattgttggggcccaggacaaggggacaggcatttgtgggcctaacctccccaggcagataggaggaggaagccatgtcccagcaggctagggcagagggacccccagtgccaacagtgctttatcagcgggcgccaggcagggccatccccagggtgaggacaacatctccctgggccctgttatcagtcacagagtccacaggacgctccttgggttaacgtgtaaccatgagccctcccctccaccccctgaagccactcgctcccagattaggtcgctctggggctatcaggccagcatggacgctggcaaagcggggcagaccctgaagactcactgctcagcccaggtgagagccttctgagctgtgcctggggctggggggacagggccctggaaccccagcagccggcgggtctgggagctgctgtccttgagttggttgggccctgggaagctgggttctggcagcctggtccctgaatgggtccagcc

SEQ ID NO: 92346 - DNA, 1143 bp, Homo sapiens
acacccagccgagaccctttctccagaaaaaataaaaaagatgccctgtgttcattagcagctcctcctgatcttcccctttctcttcttagcccccggcaaccaccagactattctgtctctgtggatttgtctttggacatttcatataattggaatcatgtactacgtgatctgtgtgtggtttctttctctagcatgatgtttttgtggctcattcatgtggttgcatgtatcagtttcactccttttcctggctgattagcactctcctgtgtggatagaccagcttgggcatattcactcatcagtcagagccttctgggtcattgtgggcggtgctgccagccctgtatgcggtcatgagggccttgtgtggatgcctcctgtcctggggagccttccgggcttcctgttctctccaccatcttccctccagcagttggtgcctctgtgccctcctccttcgtaacacgtgtccctgtgtctgggtgaccatttttccctggatggtcagctcatgggaggggctcccagcaccaggctgcagagggcccggtggcccgaccaggatcctcacctgtctctccccgttccagcaacattccaacgcatcccagtccctgtgtgacatcatccgcctgagccgggagcagatgatccaagtccaggacagcccagagcctgaccaactgctggccaccctggagaagtgggtgtgcgggcaaggctaaggctggggggagctgacttggggaagccctgggcccctggcccctcaccctgacccctgcccctgcccccgcaggcaggagacgattgagcagctcttaagcaacatgttcgagggggagcagagccagtctgtcatcgtcagtgggatccaggtgctgctgaccctgctggagcccaggaggccgaggtgagggatacgggccacagaccatgcatgctgcccatccccaggggctctccggcccctcagaggcgggtctcggtgtccaccaagagaaatccccgcccgtggcaccttgctctgtggctgcctgtgctccctgcacagtggacagtacggggccgagggaggaatcttcttgtctgctttgacaagtgagggcactgaggctgaggccactgctgcag

SEQ ID NO: 92347 - DNA, 1033 bp, Homo sapiens
tctgcagtgtctctcccaaaagtagggatagtggacccagaccctcatggggagacagggcccgaggcccctcagtgcacagggtccagcctcttctcgcaggccctgcacatggtccacacctggggacttcaccaggcctgaggcctcaggtgtgaaatgaccccctggacctcaggcgaggcggccgggaggctggagatgggggaagaggggcaggctcgagggcaactgcaggagcctggtgctcactgggagccttaagcctgagtgatggaggcagtgagcctgcgggcagtcccggggcggggccgggctcagcatgaggcagagggctgggacttggggagaggctgtgcccaaggtgggcactcagcccctgtggtcagtgcctcgtccagtggggactccctggggcgtctgacgcggcgctggttgtgtctatgcctgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtgagttccccagctcctggccagcccgtccctatcagcatcacacataccttcactacgcaagcctcacagctaccctgaaatgcgtcagtgtcagtaaactccagtttggggatgaggaagacgaggctgggagcagccaggctcctgcacaaggcctcacagctcaccgggtgcagaccaagcctgtgctctggagggcagtggcacagtcacgggtcacggcagccacaaattcacgggcccaggtgatcctcccgcctcagttgcccgagtagctgggaccacaggcatgtgacgacatgcccggctggtttttctctttattcgccgccttttattttatt

SEQ ID NO: 92348 - DNA, 1150 bp, Homo sapiens
gagatcctggccccaggctggcctggcttcaagctagccaggaaggagaggaaaggaggcccaagaggcgttcgacctgcctgaggccatgtgtgggactctgtcctgcgttttgtcagcccaggctgctctcctaagctccgatgaagtctcttccctgggcctggtgctccacgtctccctgtctcttccctggggcctggggctgagtcaggcctgggggctggtgggcactgaggtgacaggtcagcagggctcgaggagatggtggaggcctgtgcagagggaatgactgaactggaagaagctgcagaagggcattggaggagagggactagcatctgtgcctgggagtgatggtggtgagggcctgcgggagaggcacccttggcctcttgtgccggctctgctctgttctcagcatcctctgtagtgacttgggggtagcagtggcctctgccttagctggtgatgcggttgtcaggaggcaggtaatgagcgtgagctctggtcagtgtcttaactggtgagagctccgtgaaggctgtctgctgggaccagatggccttcgagattccaggatgccgcctgacttaccgggctttggttgccccttgtcctgtgtggcggagtgatgacagctttcttgggggctgctggtgagcttggacatcatgtgcacagcacacatgcagagccaggaccattgtcatcaagtgcccagagcacaggtcacaggtcaggtctgtagtggaaggtctgtgtggaggctttctagggctctgcggagcagtgatgtagtacagggcaggggctcagaatggagttgcctggcatcttgttaatactctgtgtgtgtttccttattgccagtgagttcccatgcacgagcgtttaggggctggaaccaggctgaggaaccaggcactgtcctccagagggcgggagccagctccagatggggacagggtcagggccgggtgttgccagctttgttcttcccccacagaatctgtctatcccaccctgggttccttcaggtcctggtcagtgactattctgggagcccctcccttccaacttttcctcttccttgttccagcccaggtgctgggtgagaggatggttggggtgtgtttgtgtgtgagtg

SEQ ID NO: 92349 - DNA, 1066 bp, Homo sapiens
ttcacggggccttggaacggagccggtgcgcagctgcggctcactgagctgtctgggtttattccggggcagaccgttggcaccaacgggcgcaagcgcgtctgcggcggcggggttcaagagtgggcggtgtcgggagcgcccgggcgcacgcgcactgcaccgcccaggcgtgcaccccgccccccgcacctgcgcaccaacacagccgcgggagggcggggcctcctgcgtcgtcctgcgctagggggattgtgggatagtggcggagggagccgggcgtcggaggccctgaggccggccgcagagcccggagattgagcggctttggggaaggggtggttaaggaagtaggcctcggcttccgtcggtcgctgctcggctctgcggcccgtttggaccgcggaggaggtcgccttcccctcccgtggggcgctcggttggactgtggaaaccggggcaacttcccccgtcttcccggctgaggcgcctgcgtgggcctcgcgacccggctcgccaacccgcctcggcccgcacgcccacctcgcctgcggaccccggaggtgcctacgcggactagtgacgccccccgcccgtcggcaactccacccggcgctgaccccctcaactctgcaggacccggcgcgcgaggaccccacgacccgcgggcgcctgcgcggaccccgcgagccccggcgcctgcgcgagtccccgacgccgcccccgcccccactcaccgggccccgcagcaggggccggagccgccggcggcggggcgggggggggcgccccgatgagccccgagtgcgaggagccgccgccccccctcgcaggtgagcggcccgcgtcgcccgaccctctctctccagggccaggcgcccacgtcttcccctctccgcgtcccctcaggcttttccctctcgggacccccgcgggtcttttctgcttcggatcctttccctccttccttcgggtttcctctccacggcaccccgtttcttccccctcgaccctccccagtctcttaatctcttcacctcagctccgccgccaccctagtctcagt

SEQ ID NO: 92350 - DNA, 1210 bp, Homo sapiens
tattcgttgggagtcatagggtctccaaaagattgaaaagcagagaatacaaggaattgatggagagagacagagaaagtgggggggcgggggcttggaggagacagactcggggagacacggtgaggaaagaatgcgtggcaggcgggctccccaggacggagagggtgagggccagggggtggctggcagaggagaggggcacctggctggatggacagtcaggaggaacggactggcaggagggaggggaagggtggttttgtgggagtgtgggctctcagccccaggagttcaggtctgatgtgttcaggccattgttaaacagccagcccaggaggaaggagcaaacagggtggccaaggggggacataggcgctggggacgaaggggacccggcggaacaccccacattttcaccctgctcctgcagggctggttaaactcggggtccactgcatcacgggtcagaaggtcgccatcaagatcgtgaaccgggagaagctgtcggagtcggtgctgatgaaggtgtgtgcgcctgctgcagtgtgcctgcgggtgggggggcctccggggctgagggcaggggcggggccgtgctgacctcttttcccgtgtccccacccctcttgaccctcaggtggagcgggagatcgccatcctgaagctcatcgaacacccacatgtcctcaagctccacgacgtctacgagaacaagaaatatttgtaggtatttatagacacccagccctaccccatcctccctctccaggttaccagggtgggacttctccagaaacagggcctagggggacctgggggacctgcagctctccaggctggaccgctgaaggcccagttccttgcctgttgcacagggaagcccctgacacacagggaaccccactgttgtcacgctgtgttgggcctgaggccaagggcaaccatcctcctaccgtgtccccagctccagctcctcgccctgtggcactgcatggaatgcgctctgctagacaagcagggtgccctcgaccagacccaatctgctatgggcagatgcctcctgtttgtaaggcaaggggcctagcaaagcccaaaggatcttcccaaaccccaactctggagcactggagagcccccctcctcccccggcataacttcgggtgccgtggctggacaccccaacaatgggccgccttaggaggtctga

SEQ ID NO: 92351 - DNA, 1036 bp, Homo sapiens
gtgctgtgattacaggcgtgagccaccgcgcccggcaatgcctggctactttcttaactttcttttgagatggggtcttgcttgctatgttgcccaggctggtcttgaactcctgggctcaagcaatcctcccaccttggcctcccaaagtgctgggattactggcgtgagtcattgcgcccggacaactgctgatttattctcactacaggtgttcactggggacttacatgtgtcaactttaggtttgcaaaggcaagccagcaaaatgaaataaaacacacaaagacagatgccccagacatcggccctgacctcagggagttgatgatacagaagggaagggagatgccactcaacgaattaggcaacaaaatgcacagcgacaactctgatcgttgccaggaagaagggagcctaccacaggggggtctgaccttacaggagtggggaggaggagtgggggcaggggaagcttcctggaaatgtgacaactgagcagagagcttgaagaagtctagatatgaactaggtgagcaacaaggctaataggtagcagagtgtcccaggcagaaaggccctgtggtaggagcagggctgatagcctacgatctggctatatatatatatttttagatagggtctcactctgtcgcccaggctggagtgcagtgacgcgatctcaactcattgcaaactcaacctcctgggttcaagcgattctcctgcctcagcctcctgagtagctgggactacaggcatgcgccaccaagcccggctagtttttgtatttctagtagagatggggtttcaccatgttggccaggctggtctcaaacttctggccccaggtgatctgcctccgctcggcctcctgaagtgctgggattacaggtgtgagcctccgtgcccggcctggttatacttgttattacagtatcacaatgccctagaatcagctggtaaacagtcattgtatcaagccctccaggtgctcctggatgacttgttcctttctggggttcttcctggagac

SEQ ID NO: 92352 - DNA, 1052 bp, Homo sapiens
cgagaggctgcatcgcgagctgcgcagtgaggagtaagaccccaagacccctgcacccgtgtacccacgtggggcgagctgcagcagctccctgcgcacatgcagagtgctgggcgaggaaccctggcctctcatggggcatggtttgaagctcccgcctgggagtgatggaaccagcggagaaaacggcccagaaacacgctgagaaagtattaatagatgctgcgacatagtacttacatatacatagtacttacaaatagttcttgcctggatgttaggtgttacagtgttattataattgagtgaaacacagctgagatgtaccctaaaccagagaaactgaccatactgatacctagaaaaaatggaaccatgggcagaaatacagggagcggaggagacctcctctgagcattgatgttggacctcagccctctgctacctctttccacctttcccaccccctgccttagggagaaccaagaaaagatgatatattatctgcttttggatcggaaggagcggtatcccagctgtgaggaccaggacctgcctccccggaatgatgttggtgagaaggcagggctaggggaccagacacctgggtctcgagattggaagaggctggccacggggaccccagattcccaaggaaagaaggggctgcaggctctgagcttccagctttagactgcttgacttgctctttgacatttatcaaatcccctctccactctaggcctgtttccccatgtgtgcagtttctgaggcagttgtacacagctgggtgaaaccatctcttgattgggttgaaactgttgtccctcagaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagaggtgggagcccctgtccctccaggaggatccacaatccctgggtctaggagttcaagattc

SEQ ID NO: 92353 - DNA, 1786 bp, Homo sapiens
aggaggctgtgggaggtgttggcggcggcggcgcgggcgcctgaggaggaggaggagaagcgggtgaggggcggcgcggggcccgatctctgagccccttcacggccccagccccgcgccgccttggctccccagtcgccccctgccccgactgccccccaccccgcccggcccctcctcgtgtccaggcgcccacgtctcccggcccctcgccgggcctcgggctccgcggcactgcagcctccttcctgtgcttcctcacccgggccctgacccccttcttacgtccacggccctccctgcatcctcagggcctctccctgacctcttgtcactctccaggcctctccctgcaccccccagggcctttccctgacctcaccctccaggcctctccctgcacccccaggtctctccctgcaccctcagggcctctccctgacccttctctcacccccgggacctccctgcactcccagggccaatccccgacctcctctcaccctccaggcctccttctggaccctctaggtctttctgtgccctagaacctctccctgacccctctgtccctctcctggcactccctggaccctgaggtcggcctctgaccctccaggtcccttgccctgggctctcaccgcctacccaggcgcctccctgggtccccaggcccttccctagggtctccctttcctggatcccccaggaccccaccaagcccgtttggatccctgggcccctgtccgccctctcaggcccttcactcactggacacccaggatcttctccgccatccctggaccgccccccgacccaggtctcccgtctggctcctccctgagtccctaggccattccccgctctctgtcctccctggcacccccatcccttcctcacacccctctgagcgcccccaggcccggctgcagccttctccctcccacagccccctgccgtgcccaccgctgtgcgtttctctccttgcccccagccccctctccagcttccccgctgtccctggcgtcctcctgcagcgccccctctttctctcccgcagcctcgcagtctgtccccgacccctccacagccgtctctgcagctcccgctccttgccctgccccatctcctcctctcctgggcgcggatgagcctcgagcgccgtggtgcggggacgaggctggccctccgtccgggttaggggtttgggtggttttcttcatctctccgttctctcctggctccgctttaaaaaaatgtttttgtaaatattgacctgtgctgcctccccatagtcttcctttgctcccctccccacccccgcttttgtcctctgagcccccctcccctggaatccttggagagggagcaggtgctgggatccctcccctgccctccctcccgtcacccgcctccaggctgcctggggcttcacccggagcctcctgaccactcccgaaggctgccggggaggcagggggcggagaccgaggctgggtcgaggtgggggtggagggcgggacctcgggctggcgggaagctttgacttttcctccttgagggctagaggtgaagcggctccccacggtgctaagcctttagggtgatcccggctgccaatcagtcagccttctctgggcccaaagagatgtgtgtgtgtagggggtctctgtacatatgggcaggggcatctgcgtgtgtcagtctgagtgtgcatgggtgtgcatgtgggggttgtgtgtttaggggggatctgtgtctgcgctgcggagcaagagcaagagct

SEQ ID NO: 92354 - DNA, 1066 bp, Homo sapiens
ttggggccggggcccgggaaggccctgggacccaggcatgccctctcccccagccctgtgccccccctgcggcgacagcagcacctgcgctcagcgctggaaactttcctgaggcagcgggacctggaggctgcgtaccgggccctgacgctgggaggctggacggcccgctacttccagagccggggcccgcggcaggaggctgccctcaagacccacgtgagggcgccctcccctcccccgccctcaccgcgtgtcctccccgctcaccgggcctggtcccgcctggcagacgctctagagtccctcagcgcagcccctggggccccctgacttcctagcccttgggaccatctgaggcaaggctcagagaatcctaggagaggagagttgggggggccctctgagatgtagtccaacctcttcatttgacggatgaggaaactgaggccccgagagggaacatgaggcccccaagaccacacagtgagtcagtggcatggcaggcctagagtcctggagagagagggccaaagatgcccctgccccgcctcctcacccccaccctcaccctcaccaggtctatcgctacctccgtgccttcctgccggaaagtggctttaccatcctgccctgcacgcgctactccatggagaccaacggggccaagatcgtgtccactcgtgcttggtaagagggcaggactccctgcaggtatccttggaggagacagagctcagaggggacaagagagaccctctgttcatggactggccaaccggggaaaagcgaggggcctggtcctccgggcatcctaggaaggtggtggggctaatcccggaagacctttgtggctaccgtggtgccgctggagcaggagaccccggatgtgaccccagggttcctggggcttccaggaaagaactaggcttctggtcagggccgtgctgtccttacctccttgtgacctgagcccccaccacatgttaaacacccctgagtgcaatgaggagcccctgcccctgcccctgcggggttcacagtctggtgaggaggtggggggcag

SEQ ID NO: 92355 - DNA, 1041 bp, Homo sapiens
agtagaagggtcctgtggggctgtgggctggagcagggaagcccacccaggcaggaggggaagagggagatctggaagatggatcgccaatagccagcaccagcgcccaggagtccctccttcctgggtgcctctgtgccggaggcccgagtcccctgaacacctgcaggaggccaggcatcgcccacagccctgccccctggcctcttggcaggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatggtgagggtcaggcaggtggatgggcaggacgggatagagccaggcagggctggaggggtgtagtgggagggttctgcgactgagctgccgagctcatctacctctcttctctctcctgccccaactggctccagactgcaaacccaactgcaaggtaaggccttgggactcgggaggagagggcacgcaggaagaaagggtgcctgtggcctggggaaagggtttttggtcagtaaagagccaaacaccggccgggcgcggtggctcatgcctgtaatcccagcactttgggaggccgaggtgggcagatcacgaggtcaggagatggagaccacggtgaaaccccatctctactaaaaacacaaaaaattagtcgggcgtggtggcgggcgcctgtagtctcagctacttgggaggctgaggcaggagaatggtgtgaacccgggaggcggagcttgcggtgagccgagatcgcgccactgcactccagcctgggccacagagcgagactctgtctcaaaaaaaaaaaaaaaaaagagccaaatgctgccccatgtctccatggcttcccacgggtcctggaaggggcagagtgggtatttgctcacaaggctaccagaaaggaggaaggggttccagtttggccagcgttgcccggctgtt

SEQ ID NO: 92356 - DNA, 1034 bp, Homo sapiens
agtgaggcaggcctcagagaagcgggggcggcccgcagcaggcagagctcggacctcagctgccaaggcacagtctggcggggggcaggcagctcaggaggggatgggcttgggtgtggcagaggaggtggggcttggcacggggccacagaggctggagggagtggtcaccactgctggcactgcacgctgccagaaggtcaggttagatcatcgtcctgcagggaggggtggaaaccagccagtgggtggattgtccaggggctacaggcaaaggacaggccctcggcaaggcagccgcctcggaatgccacttttaggggctcagctgttgccccattccaggagaggacgctccgggccagggtgcccggccaggtgtggggagtgggtgagccctcccctgtgccctgggccagggcgctgagtgggcttggccctcagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggtgggaccgggcgagaggcggctgggttcgggtcgtctgggcttcttgagcccagaaacgcaccctcgggacccatccctgagtgtgtccaaccccagcctctcatctcccttccacccggcctcatctccccttcacccggtctcccaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcggtgagcacccctccctgccatcccagcagcccctcccctgtctgctcctggtcatctgtctcctttcttctgagctctctgcctagcctggaaccctccctcccaccctcagtcg

SEQ ID NO: 92357 - DNA, 1338 bp, Homo sapiens
gttttaataaaataaaaagttcaagtgcttccaagcccccaacatacccctttctggtgtgggggaggggagggagctccccaccccaatagcaccaggatagcaccatgagaaagatgaggtcacacccggcctccctgagacccacggggggtggtgaggggaacatgcctccagacaccccccaaccttccccccaccgcagacagctgcagagctgagagcgaacccagtcccctcgtgagggcagtctctggggagtgccaccccctacatcagttccacctcctcctgaggcctgtacttctggggagatgccgtggggtggcccctgccccttatggctttgctccctggggaggaaggggctgaggggggcggatggctcctgcagtcctgaggctggggcaggggtggggagggcagcaaatggccggggctccctgtgggagtgggggtggctcaggggtcagcagtcacaaagggtcagggctcagatccctgggggtgtccaaaccaaccccattccagggtcagagctatgctggagtcaagggtcagctccctcccagaggtccaagggctccttctggaggtcctgggtagcagctaggagagagaccctctctccctgctgggcctccccgtccggcctgtcacagctcttcaccgccgacatccaggtcgatggagccgtggctgaccaccagccgtaggcgcttgggtggggagaagggggcgaaggcgagggcctgcttcgggatcaggatggggcctggggtcccagcaggggctggggtagctggtggggctggggccaggcgacgaaggtccacacgcaccacgtaaggcagcccatagcgccgggcccagtgccagtcctgctgaggggcccagcgggcgtgggggggctggcccagggccaccagggcctctcctcgcaggcggcagtgggggccacagcctccccatcggtgcagggagacgcgggcagcgtggtgggtggagagcactggggccctccggggccgggggcgtcggcgcttccggggccgcactcggggctggggctgaggcagccactggagccagaggggtgaggtgtctgggcgggcgctgcaggctggcaggcgcaggggctggcaggcggctgtgaaggcccaggtggcagggagaggaggaacaaaggagaggtgaagtcagtgcaagctgggccggtcctcctctggacaaggaggcagccctgccctgcgctccccagaggaatgatgcggccgaactgctcaacagcgaggcctgccagcgactgagggtgggagggagggttccaggctaggc

SEQ ID NO: 92358 - DNA, 1029 bp, Homo sapiens
ggagtcagccccctgagctcacccagccctacctcctctgataatggggccctgagccatcttggtttgccttggggaacctcgggctcacacaggtcaagaagcttgtctagggtcaccctgcaagttgtcatgattagttgtagtcacctttgaaccctggggttgaacagggcctcataggaccgcttcagtcagaggatggggcttccccctcctaggagcccctctggaaggctgatagctcagggagtacccgttgggaaaaccagcaccccaggctgactggtctcacggctccctcagcaggaccaggctggaaccctagggctttgtcaagcggcactccttggcctggggagaggcaagacttcaaagggcgtctggaaccggaatgcggttccgtgttactgccgggatggggaaggagtaaagaatgattccgagggagctctgagcgtcctctgggtgctggcagtctggcgggggtcacaggagaaattgcggcgatgtgtgcggtgggagagactgacagcggcctctgcggggtgggggtgcggggtgagcctgatgcattggagaactgagcaggctgctacgcctggctgtgggtgcgggtgccgaaagcgtggacaccaggggattctgttggaaataagctggctcacatgatggggatctcgatgttctgggaggggaaatgagccaggtgggagcggggtcgtgatggagagtggtggagagcccagagagtgggggaggaagggatggagtcagcgctgggtggtacaaagaagacccctcaggacccgagatgggatggatcaggggtgggatggggaaggagcctggggagatggtccaggcaggaggggagtagggaaaggactgaggtgagaggtaggtgtggtgattggaggcaggagcaccttggagccatctgggtgggacagtgttgagaactggggaccctgggctggctcgtagctgtcaacgcgaggcatctacctgctggaatggagagggaga

SEQ ID NO: 92359 - DNA, 1494 bp, Homo sapiens
attaaagcttgagcctgagactcagcgagtcgcacctcggtgcctgtgtgcacgcgcaggcccccgagggggcgtcgggggagcaaggggtggggtgggggcgcccctaccagccccgcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggtgagggcacgacgggtggggttcaggggcgggggtcaggatggggagacgggtcggagcgagggcgccccctcggccccacggagtccccgtcccgtcccgtctcgcaggagttgcctccttcgtggatgttggatgtggaagcccaggagccccccaaggggaaatggtcgacgccgcccttcgacccgcgcttccccagccagaaccagatccgtaactgctaccagaacttcctgggtgagacctgctcagccaggttatgggaggagcagggtgtgacaagggacggcagggaggggcactcccaccctaagtcccgcggagaccgttagggtgggaggccgggcggggccgggttggtgggggcggggcctggtcgagaaaaggcggggctgagcctggaggggcggggcgaggttggtaggggcgaggcctgatctggaaggtgcggggccgagtcgtgaaggtgcggggcgaggtaggtaggggcagggtctgggtaggaggagcagtgtgagggaggtaggggtcggggcctggctgggaggggcgggacggaggcctccaggggagagggaggcgggacgaagcagcgaagaactgggagggcccgagcagtggaggggcgggtcctgtcctggaatgggcgtggcttgccgcgtgacccccgcccgccacagactaccaccgctgcctcaagaccaggacccgccgcgggaagagcacgcagccctgcgagtactatttccgcgtgtaccactcgctgtgccccatcagctgggtgagtcggcagagggggcgccgggccaggcgtgtgcagggctcggccgaggctgagccggcgtcccgctccctgcctttctgcttcccaggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatggtatgctgttgctgatgtttcttcttaatgcccagccagcgatgcgtcgtggtggtggtggggatcctccgtgtgcctgtgtccgggctaacgctgctttttccgataaggggcaggtgggggactgctgctccatcaggtagcagcaggcagtcaaggccctaagaca

SEQ ID NO: 92360 - DNA, 1048 bp, Homo sapiens
tcccaggctgccttcctggtgcttactctgtgcagggccccaggggtccagactccaccccctcctccctcagacccaggagtccaggccccagccccctccttcagacccaggagtccaggcccagcccctcctccctcagacccaggagtccaggccccagccccctccttcagacccaggagtccaggcccagcccctcctccctcagacccaggagtccaggccccagcccctcctccctcacacccaggagtccaggtccagccctcctccctcagaccaaggaatccaggaccccagcccctcctccctcagatccagggatccaggcccccagcccctcctccctcagacccaggagtccagacccccccgtcctccctcagatccaggagtccaggccccagctcctcctccctcagattcaggggtctgatctgggctcccctccctgggtgacccagtatttcagcggctgctcactccatgggtagaagaatccctggattccatttccgtctgcgagagaaagggcagtgttagggctgtgtggagccgggcgtccctcctcagctcccccgcctcaccagcccctcacctgccgagccctgcagcagcaggagcaggcccagcgctgggatcccacagcccaacatgtcacctccccagacccctggggccactgtgggaagaggccttacaggacatcaccccagcaaccggccccgcccgcctgcccgccaggccccaggattgtgagttctgttgctagggagtcaggggtgtgctacggacgtggaagggcttcacaccagcctggccatgcctggtctagggtgttgattctttagggacctggtggaagagtgggggcgtctcaggtttagaagagcctctttggccacttatggtgggaaagagaagtctggaagggcgtgggagtctggggcgtgtctccatatcacccggggcgccctgaggggtggggaactgggaggctttgctagggagtttctttcctaaggaaactgatacctgagaaggt

SEQ ID NO: 92361 - DNA, 1073 bp, Homo sapiens
tcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgtaagtggggcccggatgcgtggctcctgcgggaggagggtcctgagtctcttgactctgggtcagagggcgggaccttcgcatgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggg

SEQ ID NO: 92362 - DNA, 1014 bp, Homo sapiens
tgtcccctcctaagtgtggtagcgagggcccctcccctgttgtgcctcaatcttcccacctgtgggatgaaaccatccatccccaccctgacttgctttgagaatttcatctgaaaacatcaaccccgtgccttaactctcaacaaccaccgaggaagttcaggtcctttttcatttctccactttacaggtgaggacacgggctcagacgcgcgcggctcacagagctgacaagtcggccgagagggaagccggtacccagaccaacaccctggcgccagggatgcccgccgcgatggcagttaccgctcttcctgcctgacagtaaaaaatcacagctcccagacccgggaaaggggccgctctctggcccaaaccagacaaaactcaccggatctccgcttaatgaccaccacgacacctttgccgtcggctgccggctccacgcccacagtcttgcggtgaatcagtccgttgtagcggaaggaattgcgggccttcaagttattgggctcctgggaaggaggcggcacaaggcatcgtgaataagggacccggagacatgcgaaggtcccgccctctgacccagagtcaagagactcaggaccctcctcccgcaggagccacgcatccgggccccacttacagtgctgtaggtctgcttattcctcttgatcaggaaactggagcagttccgcacgaccatccattgcagatgcgcagacatggcggcggctgcggggaaacgggcacagggaaagcgtcagacacagagaactaaagcagcgttaggccacgggccacgctcggacagcagaggaagagagcgactgggaacttgggtgaatgggagacccctgagggcagacagcgacctagaactcttgtcaggcgggactgagtgacctaaggcggcgggaccgaattcaggcagccgagactagctgcggcgaatgagagtgaggggaaaataacttgaaaattcacaacgacttcacggggaggggttggggt

SEQ ID NO: 92363 - DNA, 1024 bp, Homo sapiens
tggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctc

SEQ ID NO: 92364 - DNA, 1078 bp, Homo sapiens
aggctgaggtgaacaaattgcttgagcctaggagtgcaagaccagcttgggcaacatagtgagaccctatctcttaaaataaaaaagtagccagacctggtggcatgcccgtaatcccagctacttggcaggctgagatgggatcacctgagcccaggaattgcaggcggcagtgaactgagattgtgccactgcactccagcctgggtgacacaagagaccttatttcaaaaaaagaaaaaaagaatcctccagtctgttggcagagttggcggggcacccacctgcatcacaatcagaccgtggagactggactttggggtgttgaggtgccttgggactcctgagtgccctgaccctgtacccctccctccactccagaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctggtgagttctgggctggggctgggcctcctgcctcctgcctctggaggtctgctggtgtctgagccatagcgctttgtttagtttttctgaatcaactctgaagtggttgaaggtttccacataaaaatccatgttgctagctttcctggaaagacaaacagtgccagacccaggacacccaagtactgttgagaagtgcccaggagcaccttactatgcaacgagtggtgagtttgtattgtaggatggtttttctcttctcccttttttttaaaaaacaaggatagggtaggccaggtgtggtggatcacttgagctcaggagttcgagaccagcctggccaacatggtgaaaccctgtctctactaaaaatgcaaaaattagccgggcatggtggcacatgcctgtaatcccagctacttgggaggctgaggcaggagaatcgcttgagcctgggaggcagaggttgcagtgagccgagatcgcgccactgcactccagcctgg

SEQ ID NO: 92365 - DNA, 1595 bp, Homo sapiens
gtctcgtgacccaccagtcactaaagcgcatccctattggcccgagcgccttccatcacgcgtttaaaaccccgagtcccgcctcccctcgccacgctccggcccccaggaagaccgttagtcgcgtgcgcgacttcctcagcgtcagggcgcgcccgcgcgtatgccgggccgtggcggcgtctcattcaaacggtccaatcagcggccgcgtcgccttccccgtcccccttcctctcttcttccccttttcagcccctccgttctttgagaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatggtgagcacgggcgatgaggcccatgaaggtggtcgggggtgtccctgagggaggaggtggagtctcaggggcctccgacgggcggccttgaggggtttgagggccagcctgggggtccctgacccgggatgggcccgagggccttcccgcaggcggagcaggagctcgggcggcccgcagtctccctggcggcgagggctccgggcgctttgcggcccgcccatgggtgttaccaggagcaaggacgccccgccgccatctccagacctgagccggggtttcaaggatgctctaaccaaaaattagtggagaagggggagagagtagatctctggcctacgtggaaccactggggaccaagcagggttaggagcgggctttggggggggggttctggggtgggtggagttatctgcaagcccccccgtgaacccgcccccatttctgttggaaactctgcctgggctgatggcctgaagcatcctgggtgagggtctgggagttcaagggtgattgacagcctggggccactgagtcaagacttgggcagtctcagcatctttaggccctgcgggaagcccagctcttaacactcgctcaccctgctctcccatccgtgcccagaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctggtgagtttggaaggaaaaagagaaggggctgctgcttagatcctccatcaccctgctctagatcaccctagcgggaagtacccattacaggctggcctcgtgtcaggtgttgggatgcattggtggacaggg

SEQ ID NO: 92366 - DNA, 1016 bp, Homo sapiens
agtgagcctgtttcctcgtgtggatgccaaaagtggtcatctctctcccacattgttgatggagcctggggccaggcactcagtgggtgctgacaaatgcccagtacccccctcttggggccctcttccccagcatcaagcccgtctcctgagcagaggggctggggtgagaagagggagcctgaactgctggaactgatgggctacaatctcagatttctaactccccaaagaactgctgggtctgagggaggaggggctgggggcctggacgcctgggtctgagggaggagggctgagcctggatcctgggtctgagggaggaggggctgggggcctggacgcctgggtctgagggaggaggggctgggggcctggacgcctgggtctgagggaggaggggctgcaggcctggacgcctgggtctgagggaggaggggctgggggcctggactcctgggtctgagggaggcggggctgaggcctgaattcctgggtctgaggtggaggggctgggggcctgcactcctgggtctgaaggaagaggggctgggtttctggactcctgggtctgatggagcaggggctgggggcctggactcctgggtctgagggaggaagctgactgaccctggccctgccccctctaacccagactggcgagccttgccgccgcccagcccctccttgcactactccacgctgtcctgctctcggtccttccacaacctctcgcatctgcccccgtcctacgaggctgccgtgaaatccgagctgaaccgctactcttccctcaagaggctgggtgagtcctggcaagggcagcgcggcggtgaaggggagggggcggggccagagcctgggttcaggaccgtggacagtggcccaagagccttccaatggtttagcttctctcccaggttttactccaagttcgttctggaattacctgtggtacttttgtatcagaatcacttctgatttttttttaatgcaaccttctggtctcccctccc

SEQ ID NO: 92367 - DNA, 1136 bp, Homo sapiens
gggcgctgggggtgcgggcggggggccagggcccggccaggccgggtggttggaagggggccggactgggggtgccgggggccgcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccaggtgcgtgtgctctcgggcgggaggactgcgagcctggggcggggcccagcaagggaggtggagccatccgaggaggaggggctgcagggatagggcgtggtggtcagagacccaggtggcggccgccggcgtagctgaaggtgggcaggggctgagaaagtcgcgccagagccggcccggctgttgcggagtgatgcagggagagggagaagcccagactctcattcattcgacacatatttcttgagcaccttctgtgggccaggagctggggatacaccagtgaacaaaacaaggtctctgccctggtggaaaagcctgacttccaaatccaagttcacagcctacaggctatgtgacagtggatgagttgcttaacgtctctgttcctcagtttcctgtccgcacaatgagactaatcatcgtccccacctattcggattgtaattaactgagttgattcgtgcagggtcctggcacacggtaagggctcattaactatcagtggcccagtccgtaagcatgtgcagtgtaattttagatgactgctgtgaagaaaatcagcggaaagtgttgagagagagggcgctggattagaggaagtgatccgaaaaggcctctgaacggagacccgaagggagggagcgaaccacgcagagatctgtgggcgagaggttttgggcaggggaaccgcgtgcaaaggccctcggtggcctgcagggcagggaagcgcccgtgcagctggcggcggtgggcagcaggaggtgaggagaagtaggcgggcccgggtttatcctaagtgtgatggggccactgcagggtcctgagctcgggcgtgatgccatctgtccattttttaaattatgcgggctgcgcgtgagactggagtgtacggggctagggtggga

SEQ ID NO: 92368 - DNA, 1025 bp, Homo sapiens
ccggatgcgggacccttggggagccgggggtggcggcgtggggggcggccggaggcggcggcggagcgcgtgtctgccggcagctgggctgggcgtgcgcgcgccggctgggggcgaccccggccgcagttctcctccgagcagatgcgccgcgtccgtgcagatgtgtcagccgccagccctcgcctttgcctcgcgccgagaagaggcacctccccccccccacctgctggggaccccgctttctccctcctgcagcccccagtcgcccccgggatcccccccaacccaagaatggtttggtccacagccacatatatgtttattctgcgagtccgtgtcccacagtctgagactcttcttcccctccccttcccgccccgtgaagtggcccggggccgagccccgcctccatcttggctcagccaattcccacccagtttccaggagtctcatttgcatttccgggagcagctgtccaatgggaaggcagcaccctgccccccccacaagggggcggcactcctggtggatcgcaccactcttgggatccagggatggggggaacgggcttccactgaggtccgggtgacaggagggtggtcttccctcaaggcagggttggagttcagtggaggagggagttctggccttggaagaggcccagcagtccgctgtctggggcgggctccttgatgagtttctggatctgtaagggcagggggcgatgggtcaggaagcgtctagggtcccgatctccatggatgacaaatctgagggacacctctccgtcttcatctctcggaccttctggctagcagctgcccaagacaacactccctcttctcaagacttttcctggggcctccctttcattacacgtgactggttgagctcctcactgcctgccatcttggtgtgctttgcgggcttggaccactaagggtggacagctctgtgctggggcttcctgtctacaccttcctcttcttaagtaacctcatttctcccatccctcttctggg

SEQ ID NO: 92369 - DNA, 1110 bp, Homo sapiens
gcgtgagtggcggccgacggggcggagtcgcgcggtggtctccgaaggctcagactctggctggagagagggcgtctcggccggccccattgcacagagcagaccgccgaggccgggagagagagagaggggtcttacctagagtagaggcatgtctgcggttcgaaacctggccctctctcaagaaacggaggcttacaaagatacccaagcactttccaggaaggggctggctgagggagcgatcaagtgaggaatttgacgcccccctgtcctttgcgctctgtgctgcctcagtttccccatctgtacagcacctgcctcctcgggtggtgtttagaataatttagactctgtgcttggaaatggaggttgagagaaagagagaatttcctatctgtcttggaataaatccaaactcctcccaattcatggtcggccttcctggtccgtgcagacctcgcctctcaccactccccctgctcactccgctccagccacaggggtctcctcttgctcttccctcaatgtcccaccgcagggcctttgcacgtgtgctgcctcagcctggaatcctaggactccccatggcccaaccttccaggctttcaaagcctttcctgaccacctggtgtcaggtagcccttccatcaggtcgctgtttttaatttttttgaaacatcaaaaaaaagaaaaaaattgctctatcacccaggctggagtaccatggtacgatcacagcttgctgcagcctcaacctcccgggctcaagcgatcctcccacctcagcctcctgagtagctgggaccacaggtatgcgccaccacacctgactaattttttaatttttttgtaaagatggaggtctcactctgttgcccaggctggttttgaactcctgggctcaagtgatccgcctgccttggcctcccagagtgctgcgattacaggtgtgagccgccgcacccggccttgtgttttattttcttttcagcactaactccaatctgaattggaaatgaatcttgctttttgaaaaatgcatggatatactcttttattgtctgttccccgccaaaacacacacatgcacacagaacagggagctcc

SEQ ID NO: 92370 - DNA, 1013 bp, Homo sapiens
cttgggcccgggcagtcaaggctgcagtgagctgagatcacaccactgcactccatcctgggcaatacagagatagagatgatgagggtgagaaatggataatgaaaaaaagagaccaacagcaagtgagaaacaggagcagagatggattcgcagggatcctgagagatggggatacaaggaagacaggcaaagaaaaaggcagaagaatgtggtgacagtgatgtgggggccaaagcggggcgtggtcccaggtgtggaaggagctgcagcagcaagacagaggccatagagcagagggggatggagctgtggccctggaggctgattctgctggccagagggaggggatggccagggtaaggagagaagctgcactccaggagtccccacctctgagccataccaggcccggaccagagcgtgagcttcaagaatgggtgaggtttcgcttgctctgggggagctggggtggggacgatgatgtgatgacagaatggcccttggttgtgggtttgactgagggccccaggcttgcatattgtgtggcttacaggagggccatgggctcaggattgctgagcttagcctgatctcttagatggtgtccttggctctgaagaagtgtcaccattgagcccaaggaggtaatgcgtttagggtctcaggagccaaggaaaacctttccagggtgccccgaggcctcagccagctcattgagaagggtctttctggaaaccctgcagggaagcgaatggaggtttatggaggccctccatggccaccccaatcaggcctctcacctgtgtccggcaggcgccttattgctggggaggagctacccgggcgccgggtggtcctccaggggagagtgtgtccaggtacccccgctgtggtagtccccttggccaggtcctctcttgaggtggggtcccaggtccaggggggataatcgtcatagtctgtgtagcctttggagaaattggggtaatggttgaccccatcctctttct

SEQ ID NO: 92371 - DNA, 1129 bp, Homo sapiens
tgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctgatgcctcattttctgatccttggctccaggcgggggggatggggaatctcttaggacagactccctaaatagagacgggtcctcgttttctcctgagaagtttcaaagctttgaatagtacatgcccttttaaattagagtcggtttaggctgggcttggtggctcacgcttgtaatcccagcacttggggaggccgaggcagataacctgaggtcaggagttcaagaccgtgcctggccaacatggggaaaccctgtttctactaaaaatacaaaaattagccgggtgtgatggcacatgcctgtaatcccagctactcggga

SEQ ID NO: 92372 - DNA, 1025 bp, Homo sapiens
gcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacgcacgacctgcagggcccgggcgcgcccccagcgcaggcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcgaccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaa

SEQ ID NO: 92373 - DNA, 1054 bp, Homo sapiens
gatgaggaaggggagccaagagggcgggagaaagggggagtacggcgggggaagggagctgaggcggaagtcgaggggccccccgggtggaagtgacgctgcccccgctgcccaaaatgtcggcgcccagagggaggtgtaagtaattaaagaggaaagccgacggacttccccggcctcccggggccgccccgggtctccaggaccaacgctccgtacgagcgaggtggactcgcctggccccggggcctgcccgacctgccccccaaccgggcgcccagggctgcaccttttaggggcagggggaggggcacaaaaggccggctctcggggcctggggcctggagcagactgggcaagtgggggggcccgctcctcaggctgcggggtggaggaggaggcggggcctagtggctgctggggcggagcaagggctgggaggagcctgagttgggcggagcttagagtggaagtgggaggggcgtggaggagggagagtctggatagaaaatgggagggtcttaggcaaagaggtggggtttgataaaggggcgtggctcagaaggaatggtgggtaggccctggattgaggggtggaaggaaactcattgaggctggttgggtaaagggagcccaggaagcaggagggaggagtttagagtagaagggatggagtttgtctggggtgtggcttagagaagtaggtaggcctagtgaggggggtggagtttaagggtgtaatttggaggggtttaatgcaactatcaggtctttataatgaatgtggaaaggacttgcaggggatgggaatagacttcgtagagaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccag

SEQ ID NO: 92374 - DNA, 1001 bp, Homo sapiens
ggggcggcacttccggtcgggccctcgggtctccccggagcggcggcgcctcctccgcctcctcggcctcctcccggcggagaccccggcgccggtgagtgacggggtgcgtggcccgggggcccgggtgcagcgggggcggggggccccgccctggcccgctgtggtccccagaacgtcccccaacccctagcaagtcagtgcagctcccgccgggcccttgccaagggacccccaatcactgctccccggtaggatcactgcagatagctcccccatgaacgcccccagctaggatggctgccaaagcgctttcattcgtggcgatcccctaaacggctgccagggcccccaaatgatacctcctcgtaggatcccctccacatagcgctccccgtcattgcttcctccaggtcagcctccagatgccatcagcattgcccctccccatgtagggcagctgctcgtgaaccctcttattagtatcctctatataattctccccagagtgtttccttagtgccttgcagcagaactgtcccccgttatctctgtccatacagcaacagcccccaatggccctgaccacctccctccccagcagaacgccccttcgtgggtgtgaaaatactttctattctggtcagcaccaagaatgcctttttcccttctgcaggtcctccagtgattccccttaagaatgcccctttcaaagccacccccccatcgcagcggcacagctccctctagagttccttcacactcacatcctctcccgcctcaggtagaaatatccgcctgcttagctccaggctcccatgacatactcccgtacctcctctcaccccaccctcatcgcggtcagcccgtcttcattacttctgccacagaacagtgtcccgcagtgaggcggtgaagccttccttcccagaatgtgcctcatcctcttcctatggcgtgaacaactgttgccctgacctgcagcttctcacccagctctc

SEQ ID NO: 92375 - DNA, 2029 bp, Homo sapiens
tgctagttgagggggcagatgattaaaagacaaaatacaggccaggcgaggtggctcatgcctgtaatcccagcagttgggaaggccaaagtgggaggatcgctggaggccaggagttcaagaccaacctcggcaacatagtgagaccctgtctttacaggaaaaaaaaaaaaaaaaaaaaaaagctgggtgtggttggtgggcacctgtagtccccagctattcaggaggctgaggtgggagggctgcttgagcccaggagttcgaggctgcagtgaaaaaaaataaaaacaaaaaccaagagtatatgtgcgtgttcagaatatcacgggataaagagatagacctggggggctgtggttcaggatggcctcccccaggattttcctatgtcttgtcatcttgtccctcccaaaagccacacaccaaaaagttatacaagagtaaaaattccccttctcctggacaactgtggcccacttgggggctgctcttaacagcgccctaaccccaggagcgaagtgattgggaggatgagccctggattccactagggttcacagctttgagcaaatcactccctcctttcctagcctcattcattcacttcttcaaacaaaaatgtatcaagccaggaactgttgtaggtcctggggatggaacagtgagcaagagataaaaatccttgccttcaggaagccgatcatctggatggggagaccaacaaaatcaaggcaaagaagtagattatgtgaggttataaatgatgctgagcagtaaggagagaaatgaagcagggttagggagatgaggatgtgggcctgggtgacaggtcattggttactgagaggctcattgagaagacagttgaccaaagatggggaggaggtgaaggggtgagcgagatggttgcctgagagtcagaatattacaggcaacagcaacagccagcgcaaaggccctgcagcaggaatagagtgggcacatgggaagagcagccaggagactgtggaggtcattgtaaggactgtggctttttttttttttttttttgaaaaggagtttcgctcttgttgcccaggctggagtgcagtggtgtgatcttagctcgctgcaacctccgcctcccgggttcaagtgattctcctgcctcagcctcccgagtagctgggattacaggcatgtgccaccacgcccagctaattttgtatttttagtagagatggggtttctccatgttggtcaggctggtctcaaactcccgacctcaggtgatccgcctgccttggcctccaaaaatgctgggattacaggcgtgagccaccgtgcccagtcaggactgtggcttttgaatgagatggggttactgtttggtttgggaccgaggatagacatgctttggttatagtcctcctgtcagtaaaatgggaataataataacacatttgttgtgaagtttgaatgaaacaagccacataaggcacctaagtacaatgcttgttagaggtcaacaaatgttggtgacttgttctggtcttgggtcaagccaagagacttgggatttgttggcagggagatgggtggagcaatgcatgtttccagtatgaagtgggattgggggcgggggtcctccttcattttggagggagaaataccgaaagacagcatgtgatgggactctggagccttgctgcctttcttcaaccactggccctgccactagttaacaatgtgactttagaagtttgtttgtttgtttttgagaaacagagtctcactctgtcacccaggctggagtgcagtggcgtgagctcactgcaacctctgtgtcctgggttcaagcaattatcctgcctcagcttccccactagctggaactacaggtgtgcaccaccacacccggctaatttttttatttttagtagagacggggtttcactatatattggccaggctagtctcgaactcctgactatagttgatccacccacctcggcctcccaaagtgctggcattacaggcatgagcc

SEQ ID NO: 92376 - DNA, 1041 bp, Homo sapiens
atcctctatccatcgggctgctctctcctcccacaggtgaggggtgagtgtctcttccacccccaccccaaacgccatcctggagtgagatatttttagtctccagctccgggtgtccttgtccttggacaagactcaacatcccatgcccttcacaccccctccgtttaatctgatctccggaaagaggacaggcttggctggggtggtaattggaaggctgtaggtggaacctaagttggggagacagctctggagggggctgactggccagggaggcaaacacaggccataaggatgcagggaatagggggtgatttagggcgctatggggagggagggcaagagtgtttggggaaagaagcccctgactagcttgtctccactagagcacaggttaatcgtagctgtcactgactggacatctcctagaggcccgccacggttctaagcacgttacacatattaattcactgactccccacaactctaaataggggcagctgttcccgccgttggataaattagaaaactaaggcatggagaggcaaagtgagttgccatggtcacggagtaggagtctggatcaatgggcttgaaccccattcccacccttgcccccacagcagtgtttcactgggctgttccccgagtgaacaaaggtgaggggagaactatcaggataagagctttatttagggatgtcttctgggttatgaggggtgtctatacaaggggcctggtgggagagggtggtggttactttctcttctgcctacagtgttcttcgccagatttcaacaagactccctctggagcctccttgggtctctactcagcactccccaccccatcactctccagtccctcatccagccgcaggtgtttcattatagttattgccaccaactcatgtcattccttttctgtgtgtttactgtttggcccctctctaggaaagcaaggacttggcctgtcttgctcgcccctgtgaccccagcacttagcgtagcactggcccagtgtgggtgcttgacaaat

SEQ ID NO: 92377 - DNA, 3606 bp, Homo sapiens
cgcccgaagccgcgcccgcagatgccgcagcagaacgtctttcctgggacgctggcgcccgagcctcccgccccgctggtccccgcgccgccgagcagcagcgggtgggcgcccaggagcgggacgggcacagcgccgtacaccaccgccgccgcggccgccgccgccttctcgctgtctgtggtgggagggtcggggggcaggaggtacgggcccggggggaaggtgggcgggggctgcggggccgaggccgccccgtccttgggcgcctccgcagcggcagcgggcggggcgtgggcggccttgtggcggagcaggctctgcggagccgagtaggacttgccgcacaggtcgcaggggtacacgggccgaggccccccggcgcccgcccccgcgtgggccgcctggtgcttgaggaggtaggaggcgtcgcggaaggccttcccgcagatgccgcagggcaggcgcaggaggtcggccgagtgcgtcttcacgtggcgcttcagactctccctgcggttgaagcttttgctgcacacggagcaggagaagggcttctcgcccgtgtggatgatctggtgctggtggaggtgactgggcttcttgaaaaccttccagcagagtgggcaggcgaacgggccatcgccacccccggtggcaggagggggcaccccaacaccagcaggggcggcgctcccgtctgcggagggggcaggcgccacgggcgtggctggagggcccgaggacaccgtggagggggcggcggcggtggcggcgctggcagcgggtgctgggaggcccagcggcgggaggtgggggccgggctggggcgggccccccgcggccggtggcacgtccttgtggcagcggcggtggcggatgaggctggacacgtggttgtaggtgcggccgcagacgccgcattcgtagggcctctcccccgagtgcaccagcatgtgctggaccaggtgcgaggactgcttgaaggacttctggcacacgccgcaggggaagcgccgctccatcaggtacttcagtctccggaagtagcccttgtcgtccttggtggggtcgcaggccgccgccgcggggggtcctggcggggtctgcgagggggcaggaagcggccctggggcccccgcgggagcgcccagcccaggcgtcacccccggcccggacgcgggccctcctcgcttcaggttcccaaacaagtgctggtgccccgagaggtccacgatgccccactgcggagtggggaaagcagcgtcaaagaggggaggagggggcgccccgaaggcgggcggcaggggcggatcgggcttcttggcttgggaagaggaagaggacgaagatgacgacgaggaggacgaagaggaggaggaggaggacgaggacgaggacgaggagggcacctccgccttgggcttgaaggtggactggggcgggtagtcatactgcgggggagggggctgcggcgggggctgcggcggggggccgggggcgcagggcagggccgccaccgccttggcgtgttccccatacagttccatgggctcgaagcgctggtggttgaggaattccaggaagtcgaaggggtagctctggaagtgcaccccgtcctcgcccccgatgccgctgctcccgccacccccggcgccgctgcccgctgggttcgcctccatctccggcgggtgggagacgggagaccctgtgaagaggaggacggggctgaggacacggccgcggcgctgggtctccccgcaggtgaatggagctgtgcgcccactcatccatccttgtgcggatcaccccctagccttccagatttaggcttccagtccctctgcctgtccaccccaaagggcagcccttcctcttggctccctggccccaggactctcctactcaccttcaccttccctctctgtgttctcaactcccacccactccccacctcttttccttctctaattccttccatctctccccatcttttctggggtcctgacacagctttgtagaggggaccctctcctccacaccacctgcaggccctctattatttgtagaaacggggttttgctttgttgcccaggctggtctgaaactcctggactcacgccatcctccagcctccacctcccaaagtgctgggtgattacagatgtgagccagcgcgctggcctgggccgtctctactttctctccttttcagactccaattgtccaagcatcctgggggcctctggactcagttttctttccaaaccctctcagaccctctgctgtctctccatactcctgcaccctaccccacccacagccctccgtcctcatcccttcaggttttatcctaaaatgagcataatgataaggggaatcacagtttctatcagcgtaattaggagggaggactctggggccagaatcaaatgtaagccctgccacttctagctgtgtggccacgggcaagtgactgaacctctctgtgcctccatttcctcatctacacctggggaccacaaagcacatgcctacctcacaggactgtgaggattcaacacacacatatgtgcaaggctcttagggggcggttcctggcactctgtaagcactccgtacatagaaggtatggactgggcacagtggctgacagctgtcatcccagcactttgggaggctgaggcaggagagctgcttgagcccgggaggtgaaggctacaatgagctgtgatcacatcactgtactccagcctgggtgacagagcaagaccttggctctaaaaactaaaattaaaaaattgaagatacgatactgttatcactgttactactagtagtagaaatggggaagtcaggacaagcctagagaactgaaaaaagtcagtatggggagtgcactcttttaatattaatagacagtagaaaggagaatttgcttgcctgggagaaacaaattccagcaagggggctggcatatagtcagaaggtggtctgatacaatcaaaacacagaccctgggcttggacagacctgggttcaaatcccatctccactgggatccacactttctccatgtttaaaatgggggaacccctataccgcagggagattcaacagggttggaacagaacataatgaaacacatgcatcagcagaatgcattcaaccccctgagctatttgtaccatccatgacatcacacacctgggctaagcctagcaacagaagcagggagcttgagttccatccttgcccttagtggggcttctcctgacccccccatgtccttgcccttagtggggcttctcctgaccctccacccccggcatcattctctggcacctcctttacacgacttttcattccagatggcaggtatccatgtgtgtaccccacaccacaccagaccctcagcacccgtaactgatctccgagttcttggtctacttgctggcctggggaagcacctccaccaagtgggcggagggtgagtcggtgaagggcccatgaggtctgacccgcttcctgtccatcatccctacccgatgggggccaggctctaagcccagcccgctatgggggtcaagggggttcctaccaagg

SEQ ID NO: 92378 - DNA, 1046 bp, Homo sapiens
tccccaggccagcaagtagaccaagaactcggagatcagttacgggtgctgagggtctggtgtggtgtggggtacacacatggatacctgccatctggaatgaaaagtcgtgtaaaggaggtgccagagaatgatgccgggggtggagggtcaggagaagccccactaagggcaaggacatgggggggtcaggagaagccccactaagggcaaggatggaactcaagctccctgcttctgttgctaggcttagcccaggtgtgtgatgtcatggatggtacaaatagctcagggggttgaatgcattctgctgatgcatgtgtttcattatgttctgttccaaccctgttgaatctccctgcggtataggggttcccccattttaaacatggagaaagtgtggatcccagtggagatgggatttgaacccaggtctgtccaagcccagggtctgtgttttgattgtatcagaccaccttctgactatatgccagcccccttgctggaatttgtttctcccaggcaagcaaattctcctttctactgtctattaatattaaaagagtgcactccccatactgacttttttcagttctctaggcttgtcctgacttccccatttctactactagtagtaacagtgataacagtatcgtatcttcaattttttaattttagtttttagagccaaggtcttgctctgtcacccaggctggagtacagtgatgtgatcacagctcattgtagccttcacctcccgggctcaagcagctctcctgcctcagcctcccaaagtgctgggatgacagctgtcagccactgtgcccagtccataccttctatgtacggagtgcttacagagtgccaggaaccgccccctaagagccttgcacatatgtgtgtgttgaatcctcacagtcctgtgaggtaggcatgtgctttgtggtccccaggtgtagatgaggaaatggaggcacagagaggttcagtcacttgcccgtggccacacagctagaagtggcagggcttacatttgattctggccc

SEQ ID NO: 92379 - DNA, 1053 bp, Homo sapiens
tcaccctcgtctccctgcctcaggtgaattcacttattcaagtctcaccctccccgtgaggtaggtcctactgcgcacctcctccttactgatgaaagttaaggaggtgcccaaggtggccctgccctcgacggtggaccaaaacttaaaagtaaacccaggacaggccatgcgcggtggctcacgcctgtaatcccagcactttgggaggccgaggcaggtggatcacgagggcaggagatccagaccatcctggcaaacacggtgaaaccctggcctctactaaaaatacaaaaaattagccaggcgtggtggcgggtgcctgtagtcccagctactcgggaggctgaggcaggagaatggcgtggacccgggaggcggagattccagtgaggtgagaatgcgccactgcaccactccagcctgggcgacggggcaagacgtcccccccgccaaaaaaaaaaaagaaagtaaacccaggaccacacgtggaggagggagagacagaacccggtgggtctttctccagcaaggctggaggggcttggagagaaagggggacctctgggaaggacacacagcaattcagcagcccgggcccctcagcgcccgccccatgcaccccactcacctcgctgcctctcccgggccttgggcttcccaaagcgcctccgactagcacctcccttctgcttctgccgcctcctctcactggcgctgccttcttcggacgctccgctgagggaggaggctgctgactcagggtccgaggcctcgcccccagccccaccacggctgtccccctccatccgcctgggcccaggcttcatccggcagtggtcctctggggagatggagacacacacatgaaccaagggaccagacatcccatcacaggtcccgggactgagagaggctgcagtccccgaactggatcccccaacctgggctggtcccctaaagagacagagagacaaggagtacggtagagacgctggtggctgagtagagccagttggggtctgtgggaggtggtaatgggtggagcatttt

SEQ ID NO: 92380 - DNA, 5465 bp, Homo sapiens
aggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaaggtgagggcaccggggtcgcggggcggaggtgtgggcggctcctcgcgtcgctctttgcccccccgccattttctccctcgcttccccccacttcacggccgcgcggcgccccccaaccctggttccgtggcgcgcgcctcgttcacgtgacgtccccagcgttccgccgcgcgctaggcgaggggaagggggcggcggggcgcgggcccgtgacgcatgcgcacggcggctgtccctgcgccccacgtggtcctggcggaggtggcgcgggggacgcggcacgagcgcgccagatgcctcgacgtgaacttttgttttttaaaatctttttggtttctctgaaaaggagattatgttagtccccgtaatctcttttctcccgctgccttggcacttccgcttccggtcgggcccacggcagcgtctccacgccccctttgtttccaaaatggcggttgtgagaacttggtgggggggcccctttccttccttcacgtggatgagggcagagccgtttcggcggatgcttggaggccacgggcccctcgcgtaccccttttcctttttgctgatttgctctgatctctcccgccaggtggtttctgccccgtctgttggtagtggggcgcctcatattaacgtgtttggcacatgttgcctaaaagcatctgcattctttgagtgtccgcacgcacacatcctgcatatgcggggcttttggcggtcccgagaatcgcgatatggagtgtttgagacaaacctcaaatcatttacaatcccaatctcagggcacctgataatactcagtctcagatctcaatatagagataagaaaacaggttctgagggaggaagagggatctggcccactgcgctaaactcttcacttacggggaaggtgggaggcaggttcccttcagggtatcgaaaattgtgatgggttagaacaaaaagcctggggccctgatcttagggattccaataatattagaagtgggagagttgttaagacgctttaaaaatcctccgtgtttcagtttgtgaagaaatacaggaccagggaagattggagacttgtttcttttcaggcttcagctgcccatgttcctagctcgttcggaggacgaaatgagggctgaggaattttcctttgaacccgggctagagttgggtaggggctgtattaggaaacagtgtcctggggaagcaataacgtttactgagggtctgactctgtcttagttgatggactgctcaagagcataggctttggagttgagcacatcaggaagtttagatacctgctttgtcgtttagtaactgcttttaatacgtttatatatttttttccatttgtagactgattattattttcttgttaccggattttgagaagattaaaaaggatgatagtaacgatagatgtagttaaactctgagcgcttaccgtgtgccaggctcttcgctaaactcttagcatgttttactaagtggatccttttaacagccttgtgaggccaaaatgatttccacctctactggggaggaaactgagggctcagaaaagttaaaaactttctcagggctcagctagtcagaggcagagctgagattaaatggggtaacatgtaaagtgtgtggcatgtggctttgcgtacactgggtgtgcagtaagcgatatttgcaattgtaaaattccatgcttagagaggagggtcttccgctcacagagattgtgtcagagttgggaaagggcaggaaaaggtgctttccaaatgtcattctgccacacaacacctggatggagtagatacgaccctcgtttaaagagaaaaccaagtcttaaaggctaagttgcttttgcatggtttttgttgttcataagcagaaaagcaggtactgattctgagctctggctgcaaggccaagttccactctgctggaccaagtggagctgattgggcggttctttgaggctctcagatggtgcttcaccggttctcccggggtttcccttttggtgctggtagggcagtccctgagacctggcacggctcctgggttggcggagctgctcccataagatgaccacaatacagtgttttgagcaaacgaagctctcattgtttttacctgtccagcatcagtgtgtgggagagggttcttgccataggggaagctctgcccgcgtgtcactgcctgtagtctttgtctctgcggaggacgggccagcttctgtacgtgtcgccttctgcttcagtcctttcctctgctacctgtatctacagggaatttccttgtctatatcccaggcacccagcgggcatcattgctttctctgcgtgggttcctgtctgcctgcttgcctgtttcagagccttagcagcagaaagggctcttggggctcacagcctgtccatcttataagcgaggagctgtgcccagtgccgtgcctgtgtgcccgctgctctacactgctggcctgtcctgccgattgttcctcccaatttcagtttttgattttggggtttttggccttcaaggggacaattatattgtcattaatggttctagccagacctgagtgttctgcctgatccacattcgagagtatggcctcgtgcttaactcactgatgtcagagtgtttaaattctggtgtcaccatttcctagctgtttgaccttggtaattgtgatctctctataccttagtttccttacccattatgtcagcccccagcagtgtttttccgaagcagtagtgaggattaagaacaaacaaaacaatttagtacagattccggttgtaggaagcatctcaatatttgttgctgtttttttccctgctgggtgcatatttttctgagtgttggtggttttggaattgtgatgcttttccagacattcacattgcatcgcaaaaacgtgagacaaaacactgtgggtgaggctgaagtttaacatcctccctcagtgccctttcctcctcttgtccccagggatgatcactccaggagatgcgtgttaacatatataagcaccttaacgtgtgcatctgttttgtgtgtgtgcttcatggctagctgagaaatctgggtgtctttgaattaaggaaatggtgtggcggtgctcatgaacccccccgcccccccatgctcatggtttatcctccatcttgaagggccggtctctcttcaggggttgaagggtctggtgagagcagaggtttctgtggttttgccagtgaggctccgttcctagtggctacctcaggcaaatagagggttgagggagcctgctggaggctggcagagatacccgcccctactcacgcctttacagtctcttcagtacttggctttgaagggagtgaggctgagagattcaagtggtttgggattcaagtctggatggggcaagctcctcccctgacctgctgaaggagaggagggcctctttccccttcagtctgcagattctccgaggcccttctcttcccctgggaagggtgcttgcttctgcattattcaccggcttgggaagggatgggttgagtttccctgcttcctggggatatcagatcctgcctggcacctgacccctagtcctgatggtggggctgtgggtgccagctagttgcagaggtctttcctgaggggtcgctgggtcccttcaggaaaacatcattgggtctcttgattccccagcctctagccctgcccctctcagggacgaccctggggtcaggcccctcagccctcgagggggaccaggagccagcctcctctgtcttctctggctccccagctcctcctgagcatcctcaggtatcttacaccccgggggcatttccaggccccgtccccctggtcccctcatggtccctggactcgcttgtggacccaggaggcctgttaattcccttcctccattgaatcccttccctttgggggtggcctccctggggcttgggacatagccaccagcgcgcagggtgggctgggcccgcatccttactccgcttatcccgtgcccctcctctcacccttgcccagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcaggtactagggctcagggatcccctgggccagcctgggagtcggggggtcggtgttggccggcctgtgggtggcctgtgtgtgtctgtgtctgggtccgggccctgtgtggctcgttcgttctttgtgtggatctgggggagggatctactgcttggtctgtcttggattccgattttttcccccgtttctggggtttctttcattttctgtcttggtggttgctggtgggttgctgggggcaataggctctttatctggagcctgggaattgattctgtgttttccttcacaaggggttgttctctgtctctgactctgagggcctgttccttcttttcgactctctgtggctctctgtgggactctcttcgagggggttggtctctgcctccagtttctttcttccctgcctcccaggagaagggagctcttgggaccgaggcagtatccacagcctgggctgactttttggcccaggggtgtcggtttccaccgcctcttcccttctaggctcccctttctgttctctgcctccttaggtgaggaagggcaggataggcggaagtcctcctgcctcctcccggctcagtttctccagctagagactggtccttcctggcccctggcccctttctcctttcctcacttcctctttcctgggggtgggagtgtttggggggaaatggcagggccga

SEQ ID NO: 92381 - DNA, 2588 bp, Homo sapiens
ggtaggcccctggccaggctgctcccagagcgggagggtacaggggttgggattctccgtcagtcattcccctgcgtgtgtgcttggagggggtcaaagacacaggtagagggttgcacacccctgggggttctggtctctgcgcttttgaagcctccctagaggaggaaatgaccagagacacccgtggttgacaggggaatgaggcctccatctggacgccattaggaagtgaggcttctgaggagcagcagttactgggtgggggccccgagggtggaaagagggttctggaaggtgctaagaccgagagcctgtaggagctttctgctgaggaggggaactcccagtgtgtggtgaggggtggtcactgagcattcccctgatggggttttatccggcttttattccctttgaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggtactgccctcccctgccccctaccctctcccttgtccctctaccccgttcctccccttccctccattccctttccccaacctgcacgggtcagactctgctcctgcaagaccccccggccccctcccagacggaccgatggagttgagccagccaggggccgggctgggggtggccctccctccctcctcttcccctctcccgtctcccctccccccaacctcctccagcaacccagggatcaagcacacacataatgtacccacgtgttgtacctacgtgtcggagagagacagagagggagacttggacacacacacacacacacacacacacacacacacacacacacagacgcacgctgcccctcagtttttttctgacacgcctctcgttctctgccgcctgtcccctatcctctcccccacgtccctcccatggtcgctgttcttttatttttgatcgcccctgacctcccccttccccaccactccttttccctctcccctctccccaaccccttcctgtggcaccccctgagaatcccgagatcaaagagttgtttccatttctctttaaagtgaaatattgtggggctgagatccctcgtagcaacaaaaagtttgctaccatcgtcgaaggcaagtaaggtccattctgactttctcaacctgcactttgctacatttgataaaccagcccccggactccagggccagattcctccacatcactcttttctcctcccctcccgtccctgcccctcctccctacactcctcctctcctgcccctgcactcttgacttcctcctcctcgctcgtctctgtcctgctctccctttctgtcctttgctcgtctctgcccctgcctgccacttcctttctactttcctgccacttttctgtctgtctccactgggtggcccttcctgtgtgctctgtctcttcatctcttgtgtttcgtgtttttcttcattttgtgttgtcatcatgccctctgccttttcttgaacaatcttctcctttcccctgattttttggggcccctgtggctgtcccccaacgcctgtccatcgcctgcccttggccgtctcttgctactgcttcctccccattttctctcttgcttctgttcttactattgacttctacacccccacccatattccactgttccttccccccctcctccctcccctcatccctctccccttacccccaaacccctctgtgtctccctctctcacccttcccctcctctctccacctcccttcccccgcccccccccttgtctcctattccctctgcaggaggccatgatggatttcttcaacgcccagatgcgcctgggggggctgacccaggcccctggcaacccagtgttggctgtgcagattaaccaggacaagaattttgcctttttggaggtgagctgggggagtgagtgaggtccaggaaacgtgtgtgatgtgagggcccagcccttaggctgatgttgtgtggagctgccttgtgctgtttccaccaggccctctgcagcctcttctccacccggtcgctgaagtgagccctgttatagcattacagatctgatcctactttctgccttccatttgctttctgtgtgacctgagaggcctgtttggcctctgtagacctctttggccttttccagaccattccggcccagtcctctctgcactctggccacactgaccttcccagaacctaccatgctcctgcctgcttggctagagttctttacaccagctaactgatgttcctaactagtcttctgttaccccagctaactgatgttcctaactagtcttctgtgtctgtgtttctcaactgtcgggaaaaggccttggtttttgattttcgactcttggtggactgataactctcatgaagtattgtgaaggtgtgggcagtgttagcttactgcagagatttctgagcactccctctcactgtctgagcactccctctcactctgtccctctcactctgtc

SEQ ID NO: 92382 - DNA, 3244 bp, Homo sapiens
gcctttttcctgcctgtgtgtctttgctctgtgcctcagtttttgccttctgtgctgtatgtatagcattgcagtaggaggttgaaagtcttacaggatgcctggcccatggggtgagtgcccggtgtgtgttcctgctcccgggctgctgctacttgtccctgtagcataggagctgggtctcctggggtctgtgtggccccagtctggtggttggagctggctgggttggtgcttccagttctgtgggggcagcgtcatcatgggctggaagggcttgagtgagtaggtgggagagggtgtgtgggggcatctcccctccttccatgggcacagcggctcatgcttctgaggctctttcccatttcctgtcttacctattccttcccagcatcaggatggaggtgggatggggccactcacacttggtgtggaggctgcagaggaaggggaggccatatggcctaggttttgaacttgggagtcaggctggttggttaccggggcctggcatagctgatatctgacaggacggcgtcaagttacattggcagagcctgtggggtctcaggttgaatcatcccaccagcaggcacttgtctgtgagtccagagttcagtggatagggcaggatcgagggccagtaaattcagctgataagcccccactctggtatgtcagccctcgaagacactggatcctgcatcccacagtcagcccacagttcccagtgagatcagagcagctaatgctgcggatgctgttctgagacttcccgggcagccgcggctgctcatcgtgtcgtgccacccctgtgagggcagttgcacccctgcagtggcacctgcagttctgacagggcgtgaagggaagggactgagcttttttttttttttcctttgagatggagtctcactctgttgctcaggctggagtgcagtggagtgatctcggctcactgcaacctccgcctcctgggttcacgccattcttctgcctcagcctcctgagtagctgggactacaggtgcacgctaccacagcccgctaatttttgtgtttttagagagacggggtttcaccatgttggacaggatggtcttatctcttgaccttgtgatctgcccgccttggcctcccaaagtgctgagattacaggcgtgagcccccgcgcccggccgggactgagctttaatgggagccttgcctgggtggctgtcagagaaggggtggggtgtgttgtgactcaccagtaggtcccgagcccaggtgacctgccagcattccacagcagcaggtagcagatgtgggtgtgaactttgtgcctttggagcgttctggaggatgttctagtttgaggttcccctgaggctgggcagatttgggagacatggtgcgttctccccgaggagcctctgtgtgccactgcccaggaccctcactggtcagataaggctggggtggggtgggcacgtggcgacccctccctcgtcagatcaggcaggaagtgttctctttggcaattgaggagctcgccgtagactgtccaggttttgggagataacctggtactggaattgaagtcctcctcttctctacccataggggttgtgtccactgtggtccccgactctgcccacaagctgttcatcgggggcttacccaactacctgaacgatgaccaggtaacttccctgcctccctccagacccgtccccccaccccgccccacctcatcccagccctgatggactctcggctactgcaggtcaaagagctgctgacatcctttgggcccctcaaggccttcaacctggtcaaggacagtgccacggggctctccaagggctacgccttctgtgagtacgtggacatcaacgtcacggatcaggtgagtccccggtcgctggccgctgccgcgtctgtccttccctgccctgcgctgttgccaagccatggtctcccctcctcaggggacggggcgggaggcggccaacctgaggcagtgccctgtgtgtgggctcgtccctgtcccatggcgttggctttttccaggctcttaatcccctttgccttcccctcttcccccaccaatgccccggcttgggggtaggtgtcgggctcctggtccctgaccccacctctccccgcaccccccgacccctcatcctccaaacacaggccattgcggggctgaacggcatgcagctgggggataagaagctgctggtccagagggcgagtgtgggagccaagaatgccacgctggtgagccccccggcacgtcatcttccattggcttgagggaccctgggggtgggaggggctggctagtaggggacaagtgttcctgatctttctcccagctttcatgggaaggcatttggggggcattcagtgcagtgttggggagtcgggctttaggtgttggaagtggagagatggcctttcccctgggggggcatgtgaggggcctaggcttgagcagagggagactgggtctgggccccctgtgacgccgctgcctcccctggccccacagagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaaggtcaggaggcctcgggctcagtgctctctcaccctctgcccctcctcttctccgcgccctctttcttcctctcttgctccctcaccctctccccctcctcttctccgcgcgctctttcttcctctctctctcctctcgcagcgcgtgcgtataggtgtatgccatcactgagtgccgccctcaggccgggccatgggagatgttggtgaccctgaggggtttgtggccctgtgggggcccaagacctgcaggcgagacagtagttggggaatgtagctctgtatcgctgtagaacttggccctgctcccccttatatggcctggcttgtgcaaatggttttgcctggtctgtggagtggggaagagtgccgggaacagtcccgagacacctgctggtgtctcctgtgtgccaggcaccctgccgaagctgtgtctgtgctcaccctgagccctc

SEQ ID NO: 92383 - DNA, 2464 bp, Homo sapiens
cccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttatggagcggctgtgtgtccagtatgtccgaccctcttcctcggttctgggctcgggtgggggttcccttggcaaactgcgggcccctggctgggacgcccctgctgccggcgccggcagcctcgaggccttccctgcttgcgcggtgcccttctcggggtcggcacaggcacagccccgggggacgtgaggttcccgagtgctctcccaccccgccgacaggagggatggtggccgagcgggccggggcgggcgtggcgtgggtgtgccaggagctccgcggttgccgccaagcgagctggagctgactctcggcgttccgtgagcaccgcgcggatcccccgctgcagcgggcggaagtgacgtagaggcgcctagcaacggggcccagcgcgccggaagtgatgccttccaggttggcttggctgcggaagcgactcctgccagggcggggtgcggcacgggagggcggggagcgcggcaatttccgcttccggtccgtcgcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgaggtgagcgcggggcggagcgcgggggacgctggcccgcctgctccgggtgttcgggcctgggccgcggcgcgcgcgggctcgcgtctggccagttctgggtgtctctggcggcctttgtgtctctgctcctgtgtcggccttgactgcccccgtgtcggttgtctgtgtctgtctctctcgtgtctgtgtgtctgtcagcgtctgtttcctgtgggcctctgcctgtgcctgtttcagtgaacttagaaaagggtttggagataggagtgtgtttgtgtgtctgtcccgggtctctctctcctctgtctgtcgtgtctgtgtctgtcaggatttgttcgtgtctcgttgagtttccgagtcttcttttccctaggtgtctctagcccttccctgcgggcttttctgcctatggtgcaaatcttacccccgccccgtcttcgcatctgagttttgcccccatacctatcacctccaatcctgaagtttctttccaggagtctgttaacttgatctagaatctgccccttttccccagttttctgagtctctggtgtgatggtgaagagccccagccttggattcagaagcccggctgcctgctaagctgtgtaattgccaggtgatagtctctgtgtcaaaacctcagtttcctagtcgtaggaaatccatagttcgtaggcattcgtagttcctacatcatagggtccttgtgcatgtaagttgaggtgatgcttgtaaagtgcctgacggtatctgacacatagcaagtgtgtaattactgggagctctggtttttattattacagtgcttagagatttttacacagtaagtgttagatatcggtcggttattggagtactccttggagaactttgccatatcctttgtattctttttaatgtaagaattctctttgaatcaatttaatttgaaatacagtctcattctaagcagtatctgagaaatctcagctttgatgtgctagttgggtaattttttctaatgcacgccaaataagtacagagtattaagatagtgccttttctgccgccacccttttgga

SEQ ID NO: 92384 - DNA, 1264 bp, Homo sapiens
accaggtaggaattctttcatttcagagttgagcaaactgtgtctcaaggaggtgtgcgctgcaggtagctgatgtggccaggatttgaacccacattttatattctttgccattagattccatttttcttatctcttatttctcagcgccaggtctctttttgtttctgggcctctttcttccttggcctcctgcctccctgtcttcccatgttcttgtatctgctgctgcctgtgtttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggtgtgtgtccctgggcaaggggctgaacctctgtgtctcagtttccaccctgtgaggtggctatgaatcatggggttgtttcaaggattaactgagttaatacatgtaaagcacttaaaacagtgcctggcatgggataagagcagtgcgagtgtctgctggtgtcatcatcatttgcttgactctcttgtttctcgtcaccagtctcgggatgggttaatttaatttaggttaatttaaaagtatgagttttggagttcaggtgggcctcgggttgagtctgccctgccattcctggtgtgtgaccttggttgaattatttaacttccaggagcccagtctttgcatgcagtgttgaaaaaggtaatgtccctcttgtgctgagcgagcacctggcacacagcagggacccaggcagtggggctgttaggttccttatctctcctgagccttgggcttccgctatccttgggacgtctggtcttctggcttccccggttcttcctgccgccctgggttggttccctgctcctgcctctgtctttaatcccttcatcagccttctttcccatgtgtccttgtttctgctgtggattcctgccccctctgcccttgttccagaggtctttcctgccctccctctccacttcctccttgcat

SEQ ID NO: 92385 - DNA, 1342 bp, Homo sapiens
gaagtttggagccttgtggttaaaatctgtttttgagtgagtggtgcgtacgtaagattcatgtgctgaggaggcctgagagggcccacggtgcccatctcttctgtgtgcccagacacccagttcctttcctcacagcagccaagtttccgctctgggccccatctatgaatgcctctcaggcaggtgtgtgctccccgtggcacaggcgatgccacgctggggatgaacgctgtcgtgcctgtgagcaggactcagcgactgggttttcagtttgctgctcttggggtccaggggccttggcatccccacctttggtctttggttactgtgttcctcgtgttacggcaaagtggccaaggacatgggctggggccgggttatactcccagtggcgggatctcaggctcgtccctgaatctccctctgtgagggcccatggagccgattcacgtctgacttggggcaggggctggtgagtgttagactcctgctgttgcggtcccgtcggcaagcatctgcagaaggcccgctctgggtgtcttggtgcaccagaccaacaaggccccaccctcatgcgcttagacctgggcctgctctggcggaggtccctgtccttgctgatctttgagacttctgcctaggtgagggtggttccctccactcacagatgaggaggctgaggcctggagcgttgcagcacttacacatgggagcaggggttgaggctcgtttcctgtgactcgttttcatacccatcccgacacaccaggattgggttgagtcatagattgaatcagttattggtcatttattgtgaagggctgggtggcgtttgtttagttgagaatcttggaaaaccctggaggtgcaggtgagcctctctggaggcaacgaggagggatggggctggaggggtgggtgtgcagaggggatgaatccagaggggccccagacgcacatccttcctggtcagtggctggggtgatgctgctgggggcagacacagagtggcctgtgggcagggctggcaggtgccaaggcctgagagtctgctggggagcatgtggtgctggcagccagggtggacggcaggacagggcagtgcaggagaggggacgtggcctccagtgccaggcggggcttgggctgctttactgaggtgtaatttgcacacagtgaaacccagcctttcgagatagagttctctggattctgacagatgcacatatttcataactgtcatcacagtcaaggcatagaaggtttttgtcacccccaagacctcccctatggtttttgcagcccctctgggactctccccaggcctggctgttcctgc

SEQ ID NO: 92386 - DNA, 1115 bp, Homo sapiens
gttttaaactttatttctgcattgcaggatgtccttgataaagctgtctttaacattaagaaggactatcattttatgcagttgcccactgctttttggttgttttcagaaaagcaaaggagaaataatgacttattttgcaaactttttttttttttaacttttttagagacaaagtgttgctctgtagcccaggctggaatccagcagtacagtcatagctcactgagccttgacctcctgggctccaagcatggttgaggaatagctgggaccacaggcacacaccaccatgcccggctaattttaagatattttaaatttttttgtagagatggcagtctcactgtgttgcccaggctggtcttgaactcctgggctcaagcgatcctcttgccttggcttcccaaagggctgggattatagtcatgagccactacacctggcccacttgctcacttctaaaataaggttttaaatttttcattaagaagttgtatactaagcacatcatgaatgtataacacagctgttacgcatgtggacacctgtgtagccttcacctagagggaggtagaggatgcattcagccttccaggtttcctcaggagacctgtctcccacagcaccgtgtctgatttctgtctgccaagactgttcttgagctttatatatgtggagtcacacgcgtggtcttttgtgtctggcttcttttgctcaccatcaccatcaggtcagcaaggttgaccgtgctgttgcataaagcagttgttcatttattttgagaaagtctcactgttgcccaggctggagtgcgttgacatgttctcggctcactgtagcctctgcctcccgggcttaagcaatcctcctgccacagcctcccaagtagcagggatgacacgcatgtgccaccacgcctagctaattttttgttattttatttatttatttttttagagctggggttttgccatgtcacccacgatggtcttgaactcctggactcaagcgatccaccgactttagcctctcaaagcactggggttacaggattttgccactgcacccgattttatatatttatttaattattgtttcttatttatttattt

SEQ ID NO: 92387 - DNA, 1528 bp, Homo sapiens
ttgagatggagctcctacactgtgcagcccccttcatatcgcacagttcagtggccttcggcccattcacagtgctgggcgaccacctctgtccagctccagaacgtcttcattgccccagaaggaaaacccatagccttcaggtggtccctctccatccctccctccacccctggcaacccacaatccactccgtctctctggatttgcccattctggatgattcacgtcgatggaaccgtaggctgtgtggcgttctgtgctggcgtctgtcgctgagcgcagtacctccgcggctggtccccgtcacagcgtgggtctgtgttcattcctttgcatggccgtgtcgtattctgtggggacagatgtgtgtccacccactggcgacaggtgggttgtgggccttgcgcccagtcggccgccccagagcccgcgtcgcaggcagtctctggcccgccttgtgcccggcgtgctgaccgggcatccccgtgcccgctcgcaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacgggtgagtccctccctgcggcccctgacggcctagagtctgtcctccgcctactgcggctcccggcacccggccgcccactgctttctctcccagccaggagggaccgcggcatccccctttgcttctcctcacctgggccccttgctctggtctcacttgggccctttttttcccttagcacctcccatgcagcagctctgggacccttcctgcctcttgcctcgtgccccagggcaggcctagaattgggaacttttattccgctcccccataggctcagggcctgagggtgatcagtgctggggacagggctctgaggggacacgcacagtgacccccgagggtgctgtccttctctctgcgctgagatgaggggaacatcggagaggcagaggggggcctggaagaggcacagaaggaaggccagagccagggcctgcaggttgcaccaggcatctgggcctgtgttaggagccttgacagtgccttctggaggtggaggactcagtctggtgggtggtgaccagcaccgaaaacaaaacttgaaatagtgcatcccacatcgtcaagccaagatctgtcccacgaaacatttccagttatgtgatgggtgtgtgggtctcggactgttccaggaagtgtggtctgtgttggtcgggggctcacagccgtgaagaggctagtccggctgctcaggactgggagggaggctggagaatgtctgccaggctcttctgctctccaggaagagtggaggtgcctcagttagtggggat

SEQ ID NO: 92388 - DNA, 1240 bp, Homo sapiens
gggttccccacctgcttatcagactgacttttgctctggtccttccctgatgcctggcccctcccgtgggtggggctgcctgcatccccacccttcctcctctgagcacctggcgtctggtctccgcctctcagtcctagtcttggcctgcagaggttgtagggtgggggacttggggggtggggttggacacagaagcccccgtctgtctaggctatggggtttcctgtctctcgttccctggtctgggtctcacgcgtttctcacccgccctccagcctcatcagcagctgtgggctcaggcccccctcccgaggcggagcaggcgtggccgcagagcagcggggaggaggagctgcagctccagctggccctggccatgagcaaggaggaggccgaccaggtactgggcgtgcagctggggctgtctgtccgccacccgcctccacgcctcacttcaggctccctcccagccaggcgtgggcctggccctcactgtcgctgctccacatgctgtcactcgtctcctccccagtcctgcctcatcctcaccccgccgtccctctgcgtgtcactctctgcctgtccctcactggttcagggacccccagccctctctttcttcggctctatctgaccctggctctgcctctgactctgcctctggcccctcccgtcatgcccctcacactctctctcccccagcccccgtcctgcggccccgaggacgacgcccagctccagctggcccttagtttgagccgagaagagcatgataaggtcagagcagcctccctgtccctgcccctgccaggggctcccctcagaccagccccgtcgccccttcctaagtcaccccccaccatcctgctgggcccgaagcccacaggctcacgcgtgttgaaacctcagtaccttcagccgtaggatgtaggaccacaagtcagacagagcctgggtggtggccagcacagctgtgccaaggttgctcgggtgaccagggtcccttcctccccccaacgcaggagataccaccgaggcgggtgcccgtcctccccgggtgcgccagcacagcaccccactccccttatcccctgtcccgcctgacctttgacccaggtgccccatccccatttcatacattgtccgcatcccatcgaatccttcagccgctttcgttggggtgggaggggttgctggggcttccaggctgaggtggcatctgcccgtggctcacgtt

SEQ ID NO: 92389 - DNA, 1796 bp, Homo sapiens
tgtgtgcattttttcaacattaggtagaattcttaaatctatttaaaaggaaaatcaggccaggcgcaatggctcacgcctgtaatcccagcactttggaagctcgaggtgggtggatcacctgaggtcgggagttcaagaccagcctgaccaccatggccaaaactccgtctctactaaaaacacaaaattattacccaggcatggtggcgcacgcctgtaatcccagctacttgggaggctgaggcaggagaatcgcttgaacccaggaggtggaggttgcagtgagctgaggttgcgccattgcgctccaactggggaaacgagcgacactccgtctcagaaaaaaaaaaaaaaaaaaaaaaaacagaaaatcagacctctagccaacagatgtcttcacgctggcccggaacacgtgtctgtgctgtctgtccacttggaagctccctctggggctgtgtactcaaggagcgtctgagggcaggctcctctgagcctggaggcacctgtgaacacgcccccgctgccttcccccgcgggcctatagaccctggacggccccaccctgaagcagttgctgccctctggttgtcagagggtgacacctgcttctgtcatccctcttgtgtttgctcactggaatcagacccaccttatgggaatctgggctgacgtgaggttttggcctgggcaagcgatgcttccgctctgcacctcagttcctccttcccgaggcctctgggcaccgggctctttgaagcgccccctatgatggcctatactgctcccgggttggagcctcactgctgtctgccctgtctgagcccctctcccggatccttccaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggtgagtgtgggcccatcacctgctcaagtccttcctgtgggttccaccagaggaggtgcctcacggggcagggacacttcgccctttgcctgcacatgctggatggacacaggtgggctgcgccactgactccactccgtgtctctggtttactcttcctgcaggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctc

SEQ ID NO: 92390 - DNA, 1021 bp, Homo sapiens
atctagcggaaaagttcttagctatggctatgggggcactgaaacttcctaaagatgattatgttcaaatgtttatttactttccctcagaagaaactggggcactggcagtggatggattgatcacagaacagatactcaggatgctctgatcatcttgacttccacgtttatgagcaaaaaatggacgccagggctcgcaaacaggaatctcgatgaatgtgttgatatggcacccatcactaacattgtaaaaggcaatggacctcatacctacatccaggaaaatccccactctgtgcaactggggactcacccagagaggagtcataggcacagtgctggcagcaaagacctttccttctctgcaacccacagtcaagaagccgtgttctgaagaaagctcaatcttcccctgtcggttgacagattccttgcacacgcccacatcccacacttggctggtgcccacgtccacctcccagtaatggcggccggaagtgaagcgaggggtgcccaggacgcacagggcagtgtcgaacctctcagcttgctccttcctattctggctcaaatccccacttcggaaactcctcaggtcttcagaaatgatgagatagttgttggctgtgtccacatcgaaggtcatatccactgtgcaaagaagaaccaggagttcagcaaagacacacactacagactccctctgccctttgactgcaaacacttaaacacattattcacttttacttttattctactttctttcccaaatcaaaatttcctggggaaacttgtttggccacctgatgaggttaaattgtatctataggttgcatgaatatgatcattgtaacaagtccaccttattcatattagaaatgcctttcgaaataagttagtggataatttgatgaaaattagttttccatttagcacatatgatacatgaaagaagacagtagcttgctctccaaagtattctacaaacttgcacagattccatgaaaatctctacgca

SEQ ID NO: 92391 - DNA, 1084 bp, Homo sapiens
gggaggtggaggttgcagtgagccgagatcacaccattgcactccagcatgggcaacaagagcaaaactccatctcaaaaaaaattaattaaaaaataaagataccttcaatcacaccagacactttccccgcctccgctatcattcctctctcaagccaacagataccacgtggtctaagctgttcacaggagtggacaaaacagtggcccgtcaggaaggaataaaggaaactccagttaatgctgctgaaccttctcccgctgttccactttcctcgagagaggcagactctctctattccccgcctcttgcaggttggtaaagtgtcatctcaccgccgcgtgctgtgagagtctgtcctgtgtgatctcgaggagcagacacctgaagagcctggatctcacggacaatgccctgggtgacggtggggttgctgcgctgtgcgagggactgaagcaaaagaacagtgttctggcgagactcgggtaacttcctggggcgcctctttgcgggccgggctgggaggaggtgggggaccccagcatgaggttgcttgaacagggatgatgatgatctggtttccatgagtccctcaagttagatggagtgcaaccttcgcagcaccacagatctgggtataagttccagctcggctcctatggatgagacggatgaagtggcaaatgcttgggaacaaggtctggaggtagaaaaccctcaactgccgattgaacgacccctgcgtgctagtcctggtgctaaatggcggaagtatggaagtgaaaagacctttgtgttgtagtgtgaacagtctagagacaaagacgggcagaaagcaagtgattacctgagtggtccttaaaacttcagtgagcatcagagccagccaggggcttaagacagagctccaatatagtggactatggttcagccatgaaaagaaaagtgctgaggctgggcacaggggctcacgcctgtaacaccagcactttgggaggccaaggtgggcagatcacttgaggtcaggagttcaagaccagctgggccaacactgggaaaccctgtctctactaaaaataca

SEQ ID NO: 92392 - DNA, 1016 bp, Homo sapiens
gcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgacgaggccgcgggcgggcggtgccccgagtgccgcggtggggagggccggtaggggaggggcccgggggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgctcttcctcagttgtccggggcgggggtggggggtgctgcgaggaatggagaaaccaggccctttagaggatcccagagagg

SEQ ID NO: 92393 - DNA, 1004 bp, Homo sapiens
ggcctgtctgttcctgcaagggacctggcaacttgaggctgtttttcgtgacgttttcctggttccgtctctgccgtggcctgagccttctccctttgggctcacagagtgtggacgtctctcttgtgctaaatgggggtcccatctggcccccctgtttcgaggccttgcagtggatagtgttgggacccagagatgcatcagaagtggtccttgcctcagcccagggtccagccagtcagagccatggattcctgaggctgctgtgtgcagggtctttgctggaaatagccccgccctcaagtgcacagtctgctggatgcactgtgggactgatggggacctatagtaggtgtcgcagaggtgaataagacacggagtaagacacagatccccctgcgggacacaggaccatcctcaatggtggacgttaaaggggacaaatgccgttgtccaagagttagaaggaagcaagctgtctttggcagctggccgactcaggtgtggctccagcctcctacgttgtggctctgtgacattgctccagccactccgctagtggaagcctcgctgtggctgtgtgagattgtactagccactccgcttgtggaagcctcgctgtggctgtgtgagattgtactagccactccgcttgtggaagcctcgctgtggctctgtgaggttgtactagccactccgcttgtggaagcctcgctgtggctctgtgaggttgtactagccactctgcttgtggaagcctcgctgtggctctgtgagattgtactagccactccgcttttgaaagcctcgctgtggctctgtgatactgtactagccactctgcttgtggaagcctcagtttccttgtctatacaacaaggaccacagtgataggctgtgtttactgggcatctccacggcttttgggtgagcacttgacacacatctcatttaatcaggagggacgggtagcccaagcaccttgcccaggtcatgtggctggt

SEQ ID NO: 92394 - DNA, 1239 bp, Homo sapiens
gcgtctcaggtcggaattgaaggggaggccctggggctccagaggcagctgggagcacaggaaaatagcacagggtagctgttcaatgtagaagccaaactcagaagattagcagaggacaggttgataatcaaggtccaaactcaatatttgaaaagaatagtagaatagtgcaaaccttcagcaagttgactaggaggaaaacaagaaacagcacaaacactgatggtggaagcaagcaaagccggggatggagcggatttgacaaccgttgagaacaccgtgttcaacgtacacaatgcattcgaagtcctagatgaaatggacagttttctaggaaaatataaatcaccaacatatgctcatgatgtagtggcagatgtgagagtctggaaaccagaggggggagatcaaaaggtgatgaaagaccttcgcgtatagaaggcactggattccagcactttatgtgtaagttctaccaggcctccaaggaactgatcattctcatctgttcttttttttgaggcggagtctcactctgtcgcccaggctggagtgcagtggcgtggtctcggctcactgcaacctccgcctcccatgctcaagcaattctcctgcctcagcctcccaagtagctgggattacaggtgcatgtcaccatgcctggctaatttttttgtatttttaggagagacggggtttcaccatgttggccaggctggtcccttttacacaaacttccagaacacagggaaggtgttcctcagctcactggcaaggctgccacccccacccccacccccaaccacctaacaggacaaggacagcacaggaaaagaaggttgcagccagtctcatgggaccctcaacagaacatcggcagcttgattccgcagtgggtggacagacctatgtgctggggcaggtggagcttagcccagatacacgaggatgcttcatccttaggggatcctcagcagaacatcagcagcttgatcccacagtgggtggacaggcctatgcactggggcaggtggagcttagcccagatacacgaggatgctgcatccttaggaagtctctcagttagtacacagacttcaaagccgaccagagtctctcagttaaagtacacagacttcaaagctggatatgagtcctgcctccaccttttccaagctgggtgaccttggacgcatgtctgggactctcagagccttggcttcctcagctgcaatt

SEQ ID NO: 92395 - DNA, 1036 bp, Homo sapiens
tgatgaaactttgggcctgactctggcatgcacagccttgttctactctgtcctctctgttctgatccttgtggagtttgtgtggcaccaaaacactcccatagtcaaggccagcaaccagactctgagctacaccctccttgtctccctcacactctgctttctctcttcctcgctcttcatcggccgccccagccctgccacctgcctcctctcacagaccacctttgcagctgtgttcacagtggctgtgttttctgcagggccttccaggctataaggccagaaagcaggatccgaaagtggatgggtccccaaaaaacaaattctgttgtcttcctttgctcctttacccaagtgaccctctgtggaatctggctggggacagagcctcccttcgtaaacaaggaccctcagttcatgcctggctacatcattatccagtgtaatgagggctccgtcactgccttctactctgtcttgggctacttgggcttcttggttttagggtcccttgctgtagcctttctggcaaggaacctgcctgatgctttcaacgaagccaagttcctgaccttcagcatgctggtgtcctgcagtgtctgggtggccttcctcccgagttactaaagcacccagggcaaggccagagtggccgtgagatcttctccatcgtgggctccagcactgggttacttggctgcatctttgctcccaagtgctatgtgatcctccttcatctagaaaggaacactattcaatgtttaaagaagcctagtccaggcatggtggctcacacctgtaatcccagcactctggaggccaaggcggctggatcgcttgagcccaggagttcgagaccagcctgggcaatgtggcaaaaccccatctctacaaaatatacagaaattagctgcaggtggtggcatgcgcctgtagtcccagctactcaggtggcggaggtgggaggattgcttaagcccaggaggtcaaggctacagtgagccaagatcacaccactgcactctagcctgga

SEQ ID NO: 92396 - DNA, 1065 bp, Homo sapiens
gagtagctgggactacaggcgcatgccaccacctgcagctaatttctgtatattttgtagagatggggttttgccacattgcccaggctggtctcgaactcctgggctcaagcgatccagccgccttggcctccagagtgctgggattacaggtgtgagccaccatgcctggactaggcttctttaaacattgaatagtgttcctttctagatgaaggaggatcacatagcacttgggagcaaagatgcagccaagtaacccagtgctggagcccacgatggagaagatctcacggccactctggccttgccctgggtgctttagtaactcgggaggaaggccacccagacactgcaggacaccagcatgctgaaggtcaggaacttggcttcgttgaaagcatcaggcaggttccttgccagaaaggctacagcaagggaccctaaaaccaagaagcccaagtagcccaagacagagtagaaggcagtgacggagccctcattacactggataatgatgtagccaggcatgaactgagggtccttgtttacgaagggaggctctgtccccagccagattccacagagggtcacttgggtaaaggagcaaaggaagacaacagaatttgttttttggggacccatccactttcggatcctgctttctggccttatagcctggaaggccctgcagaaaacacagccactgtgaacacagctgcaaaggtggtctgtgagaggaggcaggtggcagggctggggcggccgatgaagagcgaggaagagagaaagcagagtgtgagggagacaaggagggtgtagctcagagtctggttgctggccttgactatgggagtgttttggtgccacacaaactccacaaggatcagaacagagaggacagagtagaacaaggctgtgcatgccagagtcaggcccaaagtttcatcataggccaggaaggtctcctatttgagaaggtatgttcccttttcttgtttggataatgatattcaggacaaagcctgcattgttttatatctgaaataaacaaaaagggtgtca

SEQ ID NO: 92397 - DNA, 1031 bp, Homo sapiens
tattattggacatgcagctttgtgcactgctgtgtctctatggaaggacacatttatgtgctgataatggagcactgggcgtgctgtgtgtaatttgtctcttactgttccttccaactctatcccatttgttgatgcaaggcatgctccatgaagtggcatgcacaaagcctcagtttgggctgtagagctttttgtatatttggcggttgggaaaagagccaggtagactttcaaaggtgttatatttgctgcaggagagagttaaatggcctagtcctggaaaggctttattctaggctggggctatgcaaatgatgcaggccttctatgctccctggcttgagggaagccctccttgtccttgaggtaacatgtgggtctcagtcactagaacagccctcagcatccctgtcttagacttgcatttgcagcaaaacagaaccactggatgtttaggggaaatgggagggaaaggaccactggttcccctttgccttgcagcagctaaagctggtttcctggggttgggtgaggatccctttgcctccccctccttctcattttcttggtgggcagagggcaagcaggtggggacttgtaacttggcattctaggaactgtgaggcaagcctagcctctcatgtttgctctttcctcccccagctctaccgtcgcaggactctgcccttccccaagagaggaaccagaaggaggacctatcagcccttgaaattctaaaagtcatgtcccttgtgagtttttaaatcccataaatatttgctttccttatcttgaaactttccacctgggttccatccagaaatttggttctcagactttcccattttagggaataaaaggaccaggcaggagtctcctctcccattgtcctctcccctctgacaaatgcccacagatttattctctatagcattctgcatctcctgatggttttcgtctgctaggaggagaaactcatttccctgtatgaaatgagagcatcctttgtaagaactgaagtttgaaga

SEQ ID NO: 92398 - DNA, 1047 bp, Homo sapiens
cagtgatacctctaatttactcctgaggttggggaaagaaggagaaagagaaggaaaggtttctaggctgatgatactgagagctgcagggcaggcctggcattttatggtttcttttccttctccagctcgactttctcaggatactgtccctctcccacagaggagctgaaggagtaggacagaagaactgtcaaattctggaatccttaaagccatgtccaaggtaaggaagcatttcttctctcttccctaaaatgccatcttattttttaggttatacgaacattttgtttttcttccaaaattctgcaacctaataaggttccattcatccagtgactcgttcctcatatcttgctttccagtaaaagtctccaaaagcctagttatctttttttccacagccagcatttttatcttcactcaagaaatagttcagcaccttctctgggtttagtgtctgttagaagctttcaagatgcaaaaatacactcattggcatatgtaaaccttcattgtagtaagttgattgagactgaggtgtatgttcagatgtaaccactagcataaataaagcttttccatagacctaggtttgaaaagaaggcaagacaggagggttatcaggtggtcttagtcacagaacagggcaaagtctcttgctcaaagtgatcttgaggagtgagatgtgttgagtcttgaatattaaagtgtgggtcagctagggcagggatttttccaggcactccgtgggctttgaagaacagtattccagggaataatgaggtaccattttagggacattctgagtgtccacagctatgttattctaggtcatccagttaagattagtggaattaatatgtaaaaaatagcagaactttgttttggaaaagactaatgggagagcacttgaatctgcattaaaataaaagctgtatatgtctataataatgaaaacagttgatagtgtggaatggagccagaagaaacatacaatgttaagaaacaaatccaagtataagaattccataagaatggaaa

SEQ ID NO: 92399 - DNA, 1030 bp, Homo sapiens
cctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaa

SEQ ID NO: 92400 - DNA, 1039 bp, Homo sapiens
ctaaaacttcatcctcttttgtccctttcgagttaacattacagccacagtgacctttcaaaaatgcaaattaagttactcttaaaactctagttaaaatacttgatgtacataaagtgcttagcaaaatgaccaactcatactaagtgcttagtaaatgttagataagtattctccagaattgatgtaaattatttttaaacagtgcattcttgaaagcagtatggcagtcataaaaattttggaaccaaaacagtatctttttttaagctaaaaaaaaagttttaaatggtgtctttctatgttgcccagggtggtctcaaactcctgtgctcaagtgaccctcccacctcattctcaagtggctgcaattacaggcaaccagcctgacttaaaacagtatcttaaggtagatggtgattagcacatgtagtatgcttaacatttaatattataataagacatcacagcggctgtctcatgattaaggctgtgttcccttgttggtgaggaaattaattatgacttgataaatagaacatgttttaagaagtggctatatagctctggataaaacgaacaaaagaattagaattcctgcggggaatatatacaagactttatttagtcaagtaaaaaaaaatcactaatgtttaactgaagaaagagaaattgaataatatagttctatttcaacatgtgggttcacagatttattctaaccttccaagtaaagttgttccactagtaaagttgttctggagtatattttttttaaaaaaaacacttaaaatgttccacttctttcatgaggctaagtcaactctgatatcaaaccaaggggaaagaaatgaaattataggtgagtttacttagttatatacaaaaggaaattattagcctctgctgatggagaacagaggctgtgaataaatggagatccataacatgatcctacatgaatgtttcaatattgtaatcctgtaagttacttttacattgacagttctgaaattcatgttgagtgttaattaggcag

SEQ ID NO: 92401 - DNA, 8184 bp, Homo sapiens
tgctgaagacgatggccactcccacatgacgcagggccactcatcaagatccaagagaagtgcctacccaagcaccagtcgaggtaagcaggaggcacatcccacagaggagccacacaaccagtgagatgctatcaaggaacttctacactttgcattcctaaacatcacagaagggtgcacccctccaagtcccactgtccttcttatggggactagggagtatttacatttggggtttctttccaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatatatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatttctcagtctcttttgtctgttttgtttttggggctttaaatatgttattttgttagagttataaatccaaaagcttagttcctcctttagcctaaaaagtttggtttgcaaatcttactctatttttaagtattatctatttcaacaattacttctaagggatttttaaatactgtttgatttcacatttgtaactgcccttatgaaactaaaacatatgttccaacaatttttttaaagttgataatgaccgcaagtacatcttagttacttgagtgggcatttttaattggaaatgtgagattgtctcaaacataaaaaatcacagacaataataaacccttaacataaaagtgttgatactatgttatagaatctcaagtgtttattcctgactcttgcctgaggttaaaaggtaattatcctgagtggg

SEQ ID NO: 92402 - DNA, 1050 bp, Homo sapiens
ttcttgttgatgccttttttcttcccagggatgcctccgcgggatctttcccttcctgtggtggcgaaaacaagctttgaaatggacagagaggacgacagggactccagggcttatgagtcccgatctcaggtatgctcaggtttcctctctttctagaaaggccatcttcatttcatggcagagacgcctttctttccccagatggtgtgtttatctgccccctagagtccagctggggtgagagtcccagcgctccaggaggagcccgggcccatcccttaggtgacaagtagcccaggttgctgctggctgtttctttgtcgttcatgtggtcagaggagctcctgccccctcagcatgtgtgtcacttggtaggttggtcacattggccgttccctacagggccagggaagcagagtgactctggagatgtttctggtcctcaggagggagccaggaaagctgtgggtctgcagagtagactggccagggagcacaaaggctctggagctgacaggagctgggtttaaagcctggctctgccacttgctagctgtgtggccttgggccatttactcataagctgaatttaagtttcctcatctgtaaaatgaatatggtgattgctcccagggctgctgtgaaaagtcactcacacacatacataaagtacctggcacatggtaggcacaccgttaaatgttaacaattatggcagttgtggtttaagaggcagcatgtgccggggagattcatgaagggaaaaaaaatgtggaacttgagcttgttttttaggaaggaggagaggggtcacttatacatggtggagtgtggaggaggaccccagcactgactggactcaaagaagggagaagccattgggctgagccttcctttccttcacatatcagtacccatcccatgtcagaaagcaggcctaggccctggggggcacagcagtgagcaacacagagaggggccctgccctgagaagcttttgacagttgcacaaataagtattgacacaaatgttgtatataactgctc

SEQ ID NO: 92403 - DNA, 2662 bp, Homo sapiens
atggttttttttcttctctggaagtaaagccagtaggtagtttatgctcccagacctagatttctttcccatattgccttacttagttgcaccagatgtgctgaccagtcattaaaatacgcaataaaatgcaaataatagcaaaaatgctttaaggaaatgtatagctttacttggttacataaaaaaaaggagagattgaaaatctttacatttatgtccaatctcaaaagtttaaaaaatggaagggggcagataataaaataaagagaaggaaataaatgaactaagtaaagaaacagtaagaaaggaatgtcaaaacagaaagccggttcttttagacagattagacctttgtcaagattgatgaaggcaaaagaacgtgcagtagcatcaagaggctcaatggtcacttctcactgtgtgagggaataatgtcatattacctagagttgagtacttttaatatttttgaatggtcttccattttttacatgttgtatactgtgttttaataattgtgttaagggaagaaatgttaggggaggatttgccccaactcctacttccccttttcatttttgctaataaacgtgctgacgtctgattttagtactggctagggccttgaacatttctcttgtgccttgcattgggcagttaagtctttttaggtatcttagtttatttaagcttcacaattctgaaagggatggaggtgctgttattcttatttctcagattacagagagacttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaaggtgagagtctccacggggtgttggtggtcagtgcaggcctcaggtgtcccctggggctctcagcctccacacttctgacatggtctggactggataactctctgtcctgggcagcggtggggatgtcctgtgtactgtgggatattgagctgcatcatgattttctgggtgtggccaccaaaagtgtctccacacatgcccaggtatcccctggtcgccaaaacctccctagtgcagaaccaccatcctgagtcaggagagggaaaggagacacttctgtagaagggagaaaacctcctatggctcctgcctttttggtgtggtgtgctaggaggttgccttctggctgtttgtgtctgggggtgaggtcggggtggtcacagccaccatgctccccccacccagtttttagtatgccaggagtggttggaagccgctgaagggttttgaactcagaaatgtcaggatcaggtcattccaaccatgtgtgtctgtgacagggagatgcggctcagggattggggggaactattgtgagaatgtgggccagagatagtaacttggcgaccggtgtcctcttagacgacaacaacagtgacgtgaccagcgacgacgacatgacccggaacagaagagagtcctcaccacctcactcagtccattctttcagtggtgagtacccatccccactggtcacccatgggcaggcgctgccagatgcttccagatggagacacagtgggttggggcctccatgaagatgacccgccatccccgagtggtcagcttcactcagagatctgaggagagggtaaattaattgatgtcataatgagacatttttatatctaaacagacaccttaaatacttaataccgttttattcaacgataaagtatataaagctatttggaatttgcaacaggctgcttccagctgtacccccagcctcctcaggaaggttcattaaagatgcttcagtgagcttttatagggagcactgctttcagggagggtgtgtgtgttgttttcttgggttttgttttttttgtagtagaataacgtgtactttaagatcggctgccagacagtagggggtctgcagtccattctcctgaatgtggactcagccccttaggaactgggaagccagcaaagagtctga

SEQ ID NO: 92404 - DNA, 2649 bp, Homo sapiens
gagaaagggcagggcctgatgtgctgtaacaagctgggcaggaaggaaaacaaacacgctaggaaacagtaattgcatttacttacatttttatattcagtttttttcctgattgcgaagttaaaataacattttaaatagagatggaaaaagaaacagagacttgttattattaatcatttattctgatagatttcctctattttatgaatagtcttaatacaagtttatgtgagttttcttccagtttagtttgtatgtactgccatatgtttgattattttttacatacatgagatcatgccatttattaaacagttcacactcaaggtctccatctatagctttgctttctgaaaactgcattatattccattgtgtggacattctcattctctgtgtacacgtaaatgggaatatttgcagtaagaacaacataagtatagattttaagatttattaatagcaacaaagttaaccagtgggtgtggcttgcagtttctatggtgaatgttttgcaatacctgcatgtagtgctgtgttttatttttataatcagaaaataaagctgtaacattccttgacaacacgacttaatggttatgtaacattttgctaaatactttgttttcattccttgtttaatgaaaactcaggagagatgctgatttttggatgcagtaacttacttagaacaaagtatgtttgtcactggccctagtggccttagccttccagagatgtgtagctgaaatacctaatttcttaggggaggctccatgccagcagtggttatattggcctttcctaacgtcaaaggccaaccctaattctagaaatgcatgcttgagtaaccaaacactgaggtattagcggtcctgtcatggcctttttgttaaagttatcctttgccatttagctgtaagaaagttcctagtttatatttaaataaggaatccatttccagtcctttattataaattaagtccccatgtgtctatagacttttacacagttgaattctggactctgttatgtcccagtggtatatttgtcctagtgcttatatccttatattggaaaaaacactttatttttgtgtgttggagtcattttacagacaaaccacctcccactccaaatagaccttatgcagggttgtcttgatattcttgtacatttattcttccagaagaactggattatcagtttgtcaaaactccccacctcaaaataaaaaggagctttttaaatgtgatacacgtgtctttatgtatttatttcagacttattgcccttctgtcatttattttattttattttattttttattgttttttatttttttggtgattcagtctagttctgtcacccaggctggaatgcaggggcatgatcttagcccactgccccctccacctcccagggcccccctgcatcagcctcttgagtagtttggattacaggctcatgccaccacacccggctaatttttgtgttccttctgtaaatttttgaaattttgtttgaagttgcaggtaactttgttaaatttatttatggagatttatttatttgttttgctattaatgggaattatttctcttgctgtatttactcataaggttttgtagttcaaaataatgcttgccccatatttatacttttctttttcttcagttgcactagctaggacttccagggtcatgttaaattgtagttgtggtatagctgtcccttccttgtccccacttccagaggaacatctttaatgtttaataacatgcttgtttgcatgtatttgagataagtctttataatgcttagatggtctcctgcttttactctgctaagaatttatgaggaaaggctgttgaagtttgcaaatgttttttaacttgaaatactgcttgtgggctccccttcccctttcatcctttatgtaacagtttaccctgatgggacatcctccttgtattcctggaatagcctttcaagatcatgggctattatttggactttgttagtttgggtttattaaatgtttttgcatctatatgcaaataatgtttattgaacacctataaaaatatagagatgaaaaaggtaacagagtctttgcccatggagccttgcggtagggtataaatacaggtgctctgttgttctgttggattcatacatcttcaagcacagctctgattaataagctacgtttttattgatggcccgtttaggccatcctcaggcagattaactcctcagctttaatatttcatttgatagcatcaggcaagcctttagacctttcttcctctcagcacctgcaaacacgtatcttctgttttcttcagtggtaggcgtggctgttgccatggagaagctggcctggggaagtgggggccaagtgggcagagcagttatgcttttgattggccagactcgctgtcacagaaggtcacgtgggatctggtcttccccagtcagggtgaggtaagtatgtggccctggcaggtgcaaatttcagcatctggccccactgctagttgccctttgggcagcaagtagaggacgggttgaatccaaggctaagggttgggccactcggccaggaaggcagctaacctcattgcatatggcccaccttgt

SEQ ID NO: 92405 - DNA, 2649 bp, Homo sapiens; identical to SEQ ID NO: 92404

SEQ ID NO: 92406 - DNA, 3952 bp, Homo sapiens
ggacggccagcgccaaaaatggggttcttgaattgattccttaatctagagccccagagaaggttgtaagacaccccagaaattgacttgaatgcctttgatgtaaccttgttggagaaagtctatgagtacatcccagggtgtgaggtggtctaagggagctatacccgtggccattcatcctggatgggatgcttttcatggtctcatttgacctgtgccatcatagaagataaatgtggaactgttgtggtattgttcccccctgaggaacccagtaactgcaaaataaacttggcgtctcacattttcttttcctctacagctttgccttcttgatcttccgtccttcttggagacgactggcgagaggaagagggactaggtccaaacgctaggtggctgggtccaggtgagttgaatttcctcctcacagtgccacattcatctttggagtgaccaccgcacttccttactctgacactttcctactgcatatgtgttccacatagccaccccagcaccatttgtgccctctgagaacacccagactcttctggtggattgtgtattctctaaaaattctccttggcctcacaccatccatttcagtatcctccctctttttctcatactcagctactccttcagggctactctttttctcttgcctggtgattaaagaagcatgagagattcatccactcatttgtgaatattgatcaagtgtgtactttgtgccaggtactgggacatagccccaatgggggaaaggaagtgttttcaaagagtttttagtctatttgggaattaaagctgtggaaaacataattgtttgatttatacttttgcaagagaacatctgctagcaacagctgacttaatcttagagaggccacataggggcctccctgagatggtaaagaacattaaagctgagccctgaaggagtgtgaatggtgtgtgtcatggggagagtagtctcagcagaggggatagggttgttgttgagagatgcagagagaggagctgaaaatccaggattcctagagcaagggaatcgttgagtggcatctgattgaggtaggaagaaggtaagttgtggtttcattgtgaaaagacttgtaatctgtggtgagtaactgggcttgaccttaagtgcagcgggaagtgcttttaaccatgggagtatcatgataatcagatttgtggttttaaaaagatcatctggtttcagggtgcagaaggggagggtggacgcagtgggtgtggggagaccaacttgggcctgggtgagagatggtggcttggtttgtggtcatatcacagggaggagtgaagtgggtagattatttgagaggtgttgaggagggagactcctcactttctctgttcatggcctgctgactgattcagaggaggcacagtgagtcacatgatgtggggaagcaagcacatagctagaggttgtctgtttgttcatttgttagcaagcattgatactgggcctgatccaggacaggatcatgccaggcttagagtctccagaagtgaatgacataatccctggcctcagtgtctactgaatggaaactcccatcacaagaagagtaagaatgtgtttaccaagataggtggctatggtggtggtggaatactgcttagggagaagctgacatgaccaggtgagcccttgggatgggttggtgtattcctggcctcagtgctcaagatatgcattatggtgcttaaccctgtggagacttggaaacctcctttgcccgagggctcatgttggtagatccacatttaactaagctcaggagacttaaaaccgtactgacatgtgacttgaaataggatgttcctgttcccacaattctggtttattaattcatggtaggagtacaatagcagggacccaagtactcagcagtgtgtatgatcagcaaattctctccctgtaggcagacctacatgggaaacacaaccataatgagaaggttgcttggtgagtacggaatcagaaccaagaggatgtgggtgagctttaatagcgctggtttgtcacatagcctggtacagccatgttgtcacagtgaaacccttgcttagggttaccaagatatcggaagccccttatctaacacccttgtcctccccaaactccattcaagttaggtctgatgagagttgttcactatcctgtagatggttggatggaccaagctttgtggcctactttttagtactccctccccttaaaaaaatcagatgagccaattattgttattagaatatagtcaaataactcatactgttctggaagacattttgtctctttaaagtagctttatttgtcttgaaccattttgtgctggtcataagactgaactcttagatattatttcctctctttctaaacttttggggaaatctctcaaggatggacaacaacaaggagattttgctgcagtgtggtaagtgctaagcttaatgtggtagaaataagcccaggatgttgagattatctgagagaagccagccaacagaccagagggtggaggttgtggcctgtgagatggagttggtggtcatttactccttgctcctatataaaattttccctctaaagtccctatgtcccatatgtaccttattcataggtgattggaccagactggataccttagagcagtggttctcaaagaacagctcctggagtgattgtaggaatgcttctttcctggggaaccacagacctcctgagtcatcccacctggaaaggtagctccgtatttcataagcaccctaggcaactcttctgcacatctgagtttgagaaccactgccctagaaggaatcaggctgtagcatgcactttaatactgagaatttggatgaagggacactgagtgtcgggcatttaaactgggaggtgacgtaggcctgggctgggacagcatcttactccatgtgcgtgctgaagtagagaatgtcggtctgcagagagaggcaggagaatggagcaaacaagaagagagacgagaccacacaccacgctgtccctgggagacgaagagagtaacctcctcggttcctgactttaaagttctcaattccagcccccttttaatgaggtaggtagaacgagttagggggctgaatctaggtgcaccatggtgagggaccaaagtaagtaaatagaaatgggactgaaggagactcggtggattttctcctgcatcagatgggatgtgggagcctgaggccaaaccggagtcacaggatttcttctcacacatggtcccagacgctttctagtgcatgatgtgttctttcattaagttcttccctgctcagttgaacactgacccatcatttctctgattaaagccatggatcttccctgacttctggcaaggatgcctgatgagtttcatctttattatgtgttatattaattgtaagagccatgcttttatttcctactcattttaatggaatagaagtaaagtgtcataaaatatccaaagaatggcatcagtaccaccatccagacttcaatggcaatgctgtcatgcagcaggcagcgccaggcttgttctgtatacagagaggtttcatgtttagacatctagtgtaaagaaaacatcctttggagatcaaagaacgccagactcccagaagcacccttcctgcctggctgtgtagagggatcctttattagtggccccatcacttggcgcctctcctccctccccttgaagttggtgacctttctttgtcccctggcccagagtcagctagcccttgtgtgcccctaactgctgttggctactacttaacactgagtcctgctctgaagagagagcagagggagatatggaagctttagtaatgaggggtgtgtgggagcccaccttcaagccaggaaggatatgggtttgcc

SEQ ID NO: 92407 - DNA, 1056 bp, Homo sapiens
gagacaagtatctcttcaatccctaccatccctccacctacccacccatccatccacccatccatgtatccacacttccatctaatgcacacaactatccaactgtccatccattcagccacccatgcaacaacccacctaatgcattaattctgtcattcttccaattatcaccacccacccatcacttcatacacccatccacccaccacccatccatccacatacccccatccatccatgcttccatccaatcatgcaccctacacctgtccccccacccatcacttcatacacccatccacccaccacccatccatccacatatccccatccatccacccaccacccatccatccacatacccccatccattcacccttccatccaatcatccaccctacacctatccatccacccaccacccatccatccacatacccccatccattcacccttccatccaatcatccaccctacacctatccatccacccatcattccatacatccatctacctacccatcaatctgtatacacatctatccattcacccttccatccaatcatccaccctatacctatccacccacccatcattccatacagccatccacccaccacccatcaatctgtatacacatctatccattcactcttccatacaatcatccaccttactattaatccatctactctactatccatacttccacccaccatccttccatccattaacctatctactcatccatctgtggtgagctgaatgatgaccccccacgtcttagtttccagaatctgtgagtgtcacctgatgtggcaaaagggattccccgcagtctaggttacagcaactcaactctgcctttatagcacaaaagtggtcctagacaaaacacaaatgatggatgtgtctatgttccagcacaactgtattgtacaaaagcaggcaggccatagtttggcaatcagccatcttgttctgaatgatcaggcccctacttcactttccgacaaatctctatccactttttcccttgctctctccaccgt

SEQ ID NO: 92408 - DNA, 1044 bp, Homo sapiens
ttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgt

SEQ ID NO: 92409 - DNA, 1404 bp, Homo sapiens
cctcctcctctctttcagtggctacagcaaaccaaacagcccagcagcccagcagcccagccatgtgagtcccttgggattggtatctggaaaaggaaggaaggtgggacgtggggatgaagaacagactgggtgtgtggggtgctggctcctgggaacgagaactactgatagggctgggtctgtgtgagaagggaaagcggcagaggaaggatacaatgaaagaggaaggggagcattggcatccctgactttccctccgcctaccctacctcccaagctgaggcttttttcttcctctcctgtcaggcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacagtaaggacagtctctgcttcctctttcatctttgacgtctgagcccagcattttccccaaatactaaccccaagtaaaccctgcacttgtaccttgaagacttctctgcagttcattccatttacactacctcctaccctgggtcagacactcgaatcctggttcctgttctccgttctcccctcacttgctcccagatagggctgttgttattctggtcccagcataatttgccacttgtgtgaccaggcagtgacggtggcatcatatgataggcctcagggagaaatctgactcttccaacattaatccttcagacaccccaatatcctgcgcctgtataactatttccatgatgcacgccgggtgtacctgattctggaatatgctccaaggggtgagctctacaaggagctgcagaaaagcgagaaattagatgaacagcgcacagccacggtgaggtgcgggtctggaggctctggggtctctgagtttactgtgggctggtgggagctctgtttgtggctgtcaggagggtccgcattgccttctgagaagtttacttctgaatgttattgtgtaaatttaatataatggcacgtatgttctacagctttatccttggataccctaattaacctcattgtatctccagaatattaataagtactgcgtataggtttggattctttggttataagcaacagaatctaactccactgccttatgtaaagaaacatattgaaaggctctgaaggagttcactgaataaatagctagaactggcttagagataggtacaaagagatttctagagggttccggaaagggaaccatggcaatgattttcccaggagcaatggtccaatcagcttgctgtgtcaggatgagtggtcttccatc

SEQ ID NO: 92410 - DNA, 1043 bp, Homo sapiens
cccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttttgtgtattctcagcttatctaaacttaatgaaatttcttttatatttaaaaatagtacattctgtctcatgtcacatatcagtagatcaattagtatttccttgtgaacaatgttatttataaagaactcattatcaataataattaatttctttcttttttttttttttttgagacggagttttgctcttgttgcccaggctggagtgcagtggcacagtctcgtctcactgcaccctccgcctcccaggttcaagcaattctgcctcagcctcccgagtagctgggattacaggctcccaccaccatgcctgcctaattttttttgtatttttagtagagacggagtttcgccatgttggtcaggctggtcttgaactcctgacctcgtgatctgcctgcctcggcctcccaaagtgctgggattacaggcatgagccaccactcccggccatgaaatatttttacttaaaaattgggaataagctttcttt

SEQ ID NO: 92411 - DNA, 1104 bp, Homo sapiens
actacaatgaaatactacttcacacttagtaacatggctaaaatgaatggcctatgacttctacacatataaactgtcagtaatgtgaagaaatggaaaatctaatatattccaggaggaaatatgaaatgctaaccatttagaacacaatttggcaagttcttaaaatttgaaacatttggatcaacttacagaataactgaatgaggagctttgcagacctgttacacagccaaaagggtgaaaattataaaaacacaattcagtctctggaaatggtcataagggtgtatgggaaataaatatttattaaagaagatctaacattcacaagaacagcaaaagtgagtcacatttgaaccaagaccactcctttcctcccccaactccaaactcagcgagatcaaaactccattcgacgggtacagccaagaatacagggctccctctctctggagctccaaggcagagggctgtcttctcaggaaggacaatctgtcaggaattctcatcttgcctccagtgtgcatatttagatgaatgatgttcaattgccagctccctcataaaggccatcctcagagtttctgttttaagtgaggtcatattgattcagagacagtacataacctgtcaccctaaggcctttctccagtgtaaactttctggtgttgaatagggttaggcctttggctgaaacctttttccatattcactacattgtccacattgtaaactgtccagtgttgaatgagactggaggtgtggctaacggatttccatctgttaccttcaagattttttccactgtgaactttctggtgttgaatgaggttgaaacgctggctaaaggatttcacacaatcactgcatttctccagtgtgaatccttcgatgtttaaaaagactggagttgtggcgaaaaaacttcccacattccctgcactcataaggctttgctccagtgtgaaccctctgatgtttaacaaggctggaattctctctaaacaatctcccacattcattgcacttaaaaggcttttctccaatgtgaacttttcgatgttgcatgagggttgagctttggctaaaaaatttcccaca

SEQ ID NO: 92412 - DNA, 1057 bp, Homo sapiens
cgagatcctcatgtccagtacagtgggggctcgtgggtggggtccctatttccagaacttgggtgatggggcacggaagagggttacaggcaaagggaccagcgtttctaaactcttggagacacagtgaagaaggttcatacctggagtgccaaggtgaggagttttccctcaattcttaggatgctaggagccgtggagggttgtgtacagaagcggcatatggtctgagttaggtctttcgaagttttccaaaaacctcatggagttagactagaatagaatggaataacacagaggcacagggaggttgagttcttgtgcaaggtcccacagttgctaagagttggcactgaggactggaacgctgaggctcagaaataatgcaggcatcctcagtccacctggctctggcctggacaggaatccagggaagcctgaatccgtagagccctgtatggtcacctgcctttcatgatctttggctttccacaggttactgtgtctccagaaacacatatggacctcacaaaggtgagtggagggtgtcccaggccctcactggtcctggccccatcctggggttttttcatggatctttttgccaccatccagttctttgacctaaggactcttcacaaactggaagcttgacatcctgattctagactggtggttatttgtagacgttcttattgctggcagacaatggaatgaggtgtgaaaggttgccccgcctacgtacaataatgtgtaaggttggcagtgaagctgagctgattcagggaaacacaactctcctttctttctcatgggaactcagagcagcagggcaggactcaggcctggaatggctctgagaaattgggtgttttttctggaggtgatgagaacaatgggaggtttagagaagagaacggaggttatctgacactggtctcatcaggttcactgttaatgcagcatagagaatactctgtgggtgtgatggaggcgatagaaagaccagggaggaggctactgcagtggccaaggtgagttttgatagtggcttcac

SEQ ID NO: 92413 - DNA, 1632 bp, Homo sapiens
tcatgacagggctgtgtgacctttgaggacatcgccatttacttctcacaggacgagtggggacttcttgatgaggctcagagactcctgtaccttgaagtgatgctggagaactttgcccttgtagcctcactgggtaaggccctaataccaactccagtgtcctggtctgtctatggtcttttgctgacttctccactttcttgggatatgtgctatgggatccagcactgtgcactgcctgagtagccctaacacctgctgcccagtggtctgggaacacctgctgcccagtggtctgggaacacctgccactgggcagcaggtgttcttcagtcagccaaatggatctctgttccttgctctcttcttggctgggtgtctgtgttcagatccatgacaccttgtgtcccaagttccctgcacccccatctgctagctgacattttcttgtggctacctgtgtcatgattgtagtcattgtcattgtctatacttatggggacaatgggctcttcttactcactccttctagtttgtttgtttgtttgtttgtttaatgatattaactttcttgcccatgggctgttgtgtgctgagtcgttctgcatcagtgctgatcactcacatgttctgtctttctggtaggacttggcttcatgaaggtcccacatagctagacaactgagggtgtgcagagaaacctggttgctttatagggtgaacatggtctcagagaaggcctgggcttgttgagtggcaactggttgggggcatgatatccgggctgttttccgatcacataaggagcctgtcctgtcttcaccactgtttgggtgcacatgccactggccaaatctcatttctatattttcttctcagtacttgacacttctctctcttattatttttatctatgacttctagcacctggctacctccacctttctgatcttcatgcatcatctgcttctctgcactgctccctctgcaatgttttccaacattgacacacacataatgtctcatgaagtatgtatatatgaccacatgaagatatgtgatcatatcacttgctactcagtttcaattgtattttcctgggcttgggcacagtcaaccttctgcacagcatgcaggtgtcaccagcagacaaggtcctcctgaagactatgtggtgagttttaggaattggaaggctactcaaggataatttttgaggctgttggtagaggaatggtttgaaggcaatgccattccctgtccttcatcccatccttgtgtcctttatttggtgaggcctccctcattctgtgatctttagagatccagtattgcaaagcaaccccttcctcaacttgcccccagctccattatcctcaaaacaaacctggtgaatcattcgtttggtatgtgtgtaatggggcttcttgctctcagcatagtcaatgtatatttcatcagcggttctctgctttcaggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctga

SEQ ID NO: 92414 - DNA, 1050 bp, Homo sapiens
agagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttc

SEQ ID NO: 92415 - DNA, 1038 bp, Homo sapiens
aaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttacaatctctgcgtgtactttccaggccttcaggagtcctgtcatttactttccctacaggagaatagtttgtgttttctaggattttatgtgaattgaaacgtaaaatacttactccatttttcctgatgatgcacaattttttttttttttttgagatggagtctcagtctgtcaccaggctggagtgcagtggcatgatcttggctcactccaacctcctcctgggttccagcgattctcctgcctcagcctcctgagaagctaggactacaggcatgcactaccacgcccaactaatttttgtatttttagtagagatgtggttttaccatgtttgccaggatggtcttgatctcttgacctcgtgatccgcccgcctcagcctcccgaagtgctgggattacaggcgtaagccaccacaccagctgatgcacaattacttttaagatttatcaatattgcttatgtgaatagttcatttgtattgctgagaaatagtctgtggatatgtcacaatttggataaacagttggatgctttccagttttgggctgttgcaaataatgctac

SEQ ID NO: 92416 - DNA, 1033 bp, Homo sapiens
agcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctc

SEQ ID NO: 92417 - DNA, 2022 bp, Homo sapiens
gcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgacaacacattgaggaaaaccctataaacataatcaagaggggacatttttcattaagagttcagtaagacttctcccacattatttactagaaaatatcatcttagaagaaaccccatgaaggaaaagaatagggaaaagctttcagcagttatttagcccttactcaaaatcagataattaacaatgaaggaaactctaaactccccttatggtctaccagtaattcatacttgaggaccatgactgtggggaatgaggcatcttttagcaagagctctcaccaattgtagattggtgtgaattgctaagggaaaaaccttatgcagagaaaagtttttgactggaaatacactgttttgcatcaagctggagtactggatggaaaactctacaataacattttgtgcataattgtagaaatacagattttgttgttataaggggagggtctgggtgcccaggagtagaatatgaagtgctaaatctgaatgtaagaaaaataatagtattgaatggggtatttactgttgattaacctccttagagaaaattaatgaatgagatgactaacggtagaaaagttattgcctaggagtgtgagactgatgttgctggacagaaagtgatccttagcccagtgtgtcagcgtccattgttactcatcactgcattgttgggcaattagtttgtaatttgttttaggcaatcactataaattataattatggacactgcatcagtatacataacatgaaggaataaaaaggatacagaattgtatatacatacttactgtaacacatctaaaaaaatgtatatgggtaaggacctgaaagatccatggaaaagttaacccagttgagatttttaaaaagttttacaaatacatataacacttatgtgctgggctttcttttaaatgctttccaagtgttaacttgtttagtcccctttactctgagataggtactgttaccccagttttacaaatggctaagctgaagcagagatgttgaaggatcctacctaaggggcacaactagtaagggagtagagctgagattggctccagagttcttgttttcagccaccattttatgctgcctctccagtgattttttttcccattttcttcagtgtttctatagcagagatttgataataaaaagaaaatcctaaacaatgagaaataaagttacctggtttctctgtctcgaaggatttatagtaacatgagaactagtatccctttggaatatgaagtctgtgttggacattcagaatcactgcattttctgggacctgagttccctagaactttgctgcctgcaaccccaaggataacagggcagcagggcct

SEQ ID NO: 92418 - DNA, 1110 bp, Homo sapiens
ttcccactttattctaatgtctttctctatgctctcatagctttttttctgtctgtttcagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaacct

SEQ ID NO: 92419 - DNA, 1020 bp, Homo sapiens
taactccctgctatgaaagatgaagaaaaagagtttcattacttatttttaggtcttttatttttaagttaagataatgaatcaagcagatgtgagatacttggatataaaacaagatttaaaaatgatgtctctactttgtgcctccccctcaaattaaaaaatattattgaaaccgcccacagtttcaaatctggtgggtgaagtccatcataagtatgctgttcccacttggcagtgttgctatccctggtccaggtgagatgggaagcagaagggcctgaaccatatgatgcaaggtgattgttgcctggcatcagaacttgggcaactatgaggtttgctgctcttacaatgtacagtcattattaaatcctaagacagaataatcagtagtgaagctagactagcctgaaagatggcccctgaatcagactctgaggagtagaagttagctgtaataaaacactgcgaagaagccctgttaaccaccatgctacactctgctgttaatttatgctaggctttctgagaattatctaagttaatgctgagaaaataaaacagaattaaaaataacaacaccctccaatgtctgaagagttgtgatttctgataacatgctcctggctggcccccctccccacactctggattttttcctgtgggaaactcggatttgactgctgtgtgtttttaactaagtgagatcttcaggaatgcaaaagaaccctgtgtccctttattgttccctccaagttaagtatttattgaaataaagcatttatctggtgaaaacatcaaatgctgtcatccctcattatctgaatagtccattcatggaagtatgttgaatagtgaggttttaactacagaagcccagatcccgttatttctaggaataggggaaaataataattgtaatgataatatctcatttcatctaaaaaaccccaaccagcctttccaaatacggaagcattcaaacccctctgttaacagtccacctaggatatctgc

SEQ ID NO: 92420 - DNA, 1005 bp, Homo sapiens
tcaccctgaggagctcccagacccttttccagggttattcactcagctaaggagatctcacggcctacctggagccacacgtgcagtgtgggacaggagaaacctgagacgggtagggtaggcctgcaggagcacagtcacctgatgagtcgggagatgggacagagtctgtgtggagctcagcttttactgtggaggggaaggctgcttcgtagacctgggccaagaggtgaaaagaatgcatcagccagttgggcacagcctggtgagtgggggtctggcctcctgcagcaccacaggggtcaggggtggcaggcagcacactgtgtgaccagtgtttgagtgagactgactccagttagattttaggctggagaggccaggccctgaatgcttgctgcagaacctcagaagtcttgggatcaggcggcaccagggtccaaaatgtggtgatgggtgtggaaagaagagggctgtgggaagcaggctggtgtttcaggcttcagtctgaccagggccttggagctatggaggagaggtataaggaaatcaaagcaggggcctttgtgattatggggacagggtggctcctgagagaaataggacaatggagttacttaggaaaggtgtcatctctctgccgtcctcctgcccagcctcctcaccagatgcagccacttaaaaaaatttttataatagctttattgagatggtactgacatattataaagtttatccttttaaagtgtgtaattcagtggtttctcgtatagtcacagaattgtgcaacaatcaccagtatctaattctagaacattttcatcaccctaaaaagaaatcctgtacccattagtagtcactccctgtttcccctactccctcccaaccactagtgtactttctgtctctatgaatttgcctagtctggacatttcataaaaatggaatcataatatggcacagccttttttgtctggcttttttcacttagcataatgtttgcct

SEQ ID NO: 92421 - DNA, 1329 bp, Homo sapiens
gatacagcccagcactatgtggtgttgctttttaggatttccacgaaggccaggcacagtgcctcatgcctgtaatcgcagcactttgggaagccaaggcgggcagatcacttgagcccgggcattcgagaccagcctgggcaacatagggagaccccatctctacaaaaaatacaaaaattagccgggtccgcacttttagtcccagctacttgggaggctgaggtgggaggattgcttgagtccaggaggtggaggttgcagtgagccaagatcatgccactgcactccagcctaggtgacagagcaagaccctgtctttaaaaaacaaacaaaccaaaaaaaaaaaagatttccatgaatccagtggacttgaatgggcatctctggggccacccaagccctgtggccaccgcgctgctttgtaaatcagggaaaggtgtagtgtccgttgagccttgggtgctgctgtcacagaagcacactggggcctgtgtgggaggcagcgggggctccttgacccttgagggcacctggccacagggagctcattgcctcagctctgcctctccttctccccagcctggctttctccggaccccctgtttctggaacagaggagggtcagagaagcaaagaccgaagaggacggccctgccaacaccgagcaggtgggtgggcacgagcaggtgggtgaggggccttggcctcagcttagaggcatccccctccccatcaccagtgctcagcagagggctgtggccccaaacgtccacagcgctgaggcccagaacccaccctggtgggagcgtgagggcggaatctttgtggtgcgaagggggctgcctcctgcagtgcacctgggttagagtccctggccagggctggctcctagcctgctcctgtggctgtggggctgcggcgggtcctcccttctctagggcaggtgggaggtctcagccacgactaatgtttcagaagctgaagtcctttccagaggaccctcagcacctgggggagtggggccacctggaccctgccgaggagaacctgaagagctaccggaagctgctcctgtggggtgagagtcgcctgcctcggggtcacgccccactccccatccccttccgcaggggttggtgcaggagactgtgaccccagggactttggctgggacactgtgatgtcttacaggatttgaacttgcacgtgttggagcttgaatttattcgctgaagcccccaccctttctgatctaaacatctgagttctgcccaggccctgcctgtaggactgaagcctcggaatttggaaaggcctcctggcccc

SEQ ID NO: 92422 - DNA, 1001 bp, Homo sapiens
acctcgtgatccgcccgcctcggcctcccaaagtgctgggattacaggcgtgagccaccgcgcccggcccccagcctcttaacagtaaatattctgggtactttgcaggctggaggtctcctggtccaagatgaggtgcaggatgggtagtgatgtggccctggagcctgcaggtccctgtggtttaactgtgtgattgttgttggcacgtgtcctgacctcttggggtcacaggtccctccactgttgacagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacacgtgagtgcccagctagcctggcagcctctgctgggccttaggtggggtgttgggcagaggcctgtggttgggagagggcagaagggcagccagggagtcaggggctccatggtccatgctatcattgggacttcctcctgtagtttctctgaatgttagacattgtttattaaattagtcttcagagattatgcagatcatccatacttaccacaaatagtgaagaaacatcaatacataaagaaaagaatctcccaacccccgaccatgaaccctctgaaaataaagggtctcaagtgtcctgatgcacgtcccctcatgtctccctgcacatcacacatgcataatcagggcctggggtcgggctctgtgtgtgtggtgtgctgtgtctgagtgcttgctgttcgaggggtgggtcccccaggctgtggttgggtctggttctttagttgcccagcatcgcgtgctcagcccatccccatcctagaggtgggctctctgccccttggagtgaagctgccctgacacctcctgacttgtgtgcccatatgtgaggctctgggcactgtgggtggactcctcaggaccactgggcaag

SEQ ID NO: 92423 - DNA, 1051 bp, Homo sapiens
actggggctgctaggctaaggactgtttgctgctgggttgcaggtgatgatgatggagcttgcatcaggtgaaattccgtgccctagcttcttccttcggcagttcattctctgaggttgcttggcttttgagttgtgggcagtggatagagattgggacggtttgggaaaggagctgtaactcagaaactggattgcaggtatgtgcttcctcagtttgcagagcgtttgatagtgacagattctgcagttctttgcctattcccataccagaatgcctactctgtgaggtggaggtcttcatctgtctgatccactgctgaattattgatacctagaacaggtcctggcatacagtacgtgttcagtaaatgtttgcagaatgaaagaaaaagagccatccttgtgaccacaggaagctggcccttttcccacagacttaagatcacagagggggtgtgtgatgaattcactgcacatttatctagtgtgcccaggccgttttttgggggttttttttagagttttttcctttgtgatatccagtgcctcgggcaatatggagtatggggtgtttgtgtgtgcatgcgtgcgtgtgtttgaaattggcatgctttatgtgctacaagactttgcaaccttcttctctccccaaccttgtactaggtgaagctttcagtacaccggccttcactgctctatactattctaccttgtgaaaatgccacagttttttttgtcttgcctttcctgttgatgaacatcttggaagtttccaggttttcagcgtttccaccagtgctttagggaggcaagttgaatgtgtatccttgtaagggtttttctagcctgtaggttttcaaaattttcacacaagcattgagagaaacatgtacatgatgacttgcatgcatactaactgtaacaaaagtttgatgaaaccacgcttgctaaatgtgagatcctctgatactacttttgaattttaatttgtcattgtaaaaaggatgccagtgtggatccaccacatctcttggcatttagaattttt

SEQ ID NO: 92424 - DNA, 1001 bp, Homo sapiens
tgatggttaatttaataaccaaggtggcttctaaaagtaactaatagggggtatacagtgtggacacactagacaaatgcctggttcccatcctgggcgggatggtgtggtacagcatgggatttaatcatgctactcagagcagtgtgcaatgtgaaacttatgaattgtttatttctggattttccatttaatattttcagaccacagttgacctcgggtaacaaaggtggagaagtgaaactgccaatcaggagaggctactgtaattcaatcacagaggatagaaactcctgaccaaagagaatatgagatgtggactaggtgagttccagatggattctggggtagcctgggccattgcaagtttggctgaaatgagtgggacatgagatagagaagaaggtatcctggattatctggatgggcccaatctagcacacatgcccttaaaagcagagattgtgggctggagtcagatgctgaggaaggagcgagtagagagctgaagtgtgaggaatctactccctgttcctggctttaaaactggaaaggggctgggcacagtgcctcacacctgtaatcccagcactttgggaggccgaggtggatggatcatttgaggtcaggagtttgagaccagcctgaccaacatggcaaaacccatctctactaaaaatataaaaattaaccgggcatgatgtcatgcacctgtaatcccaattgcttgggggtctgaggcaggagaactgcttgaacctggaaggcagaggttgcagtgagccaagatcgtaccactgcactccagcctgggcaacagaacaagactccatctcaaaaaaaaaaaaaaaaaaaccaaaaaaccaacttatgttcatcagaaagcaatattatgcaagtgaaagggcaagtgacagagtgggagaagaccattgtagagccaacaaaagattggcctccaaatatataaagaactcagcatctcaataagaatgcaactt

SEQ ID NO: 92425 - DNA, 2137 bp, Homo sapiens
tccaccttgtacgtaagcaaacactgaatcaacttttttttttttttcggacagagtctcactgtgcagtggcatgatctccactcacagcaacctctgcctcccaggttcaagcagttctcctgcctcagcctccaaagtagctaggattacaggtgcctgccaccatgcctggctaattttttctatttttagtagagacagggtttcactgtgttggccaggctggtcttgaactcctgacctcatgatccgcccacctcagcctcccaaagtgttgggattacaggcatgagacactgcctggcctgaatcaaccttttttaagtgtaatcagaaagagaggctttggcaggggctcttactgtgttttctgtaacaacaaaggtgtacaatgagagagtccacacagtgctgtactgcacacaccacagaatgtgtgagattttcctgtttgaatgtatgtctgcattatactcctgcaataatgctgaggactcgttgcaggagggcaaactaggtgaataaattacctgtgaatgaacaatgaagtcgttcctcttaagactgaaacaagcaggccagatgtggtggctcacgcctgtaatcctagcactttgggaggccgaggcggccagatcacaaggttaggagttcaagaccagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaattttgtatcatatttttttctctgttacagatacttgttggcataataatttggtaataaattaaaaagtgaagccaaaaggaggttaatttggggtttctttggacctttagtagtagggactggatcagggcaacagggaagctgtaagtgtggatggaggggcattgggcagtagcgtctctggaatcagcatcccaaagcccagggcatgagaataacttccttctttgggacttgggttataaggggttgtcagtgtagaagagagagtgagtcccagagaatggagaacaggaagcctgtagaaaatttgggatgactttggagtggcccttccgaggcagtgcagtactggccgagtgaaagccagtcaaggtggatgacacagccttgaagccccatgagtggatccccttgggattttgcctctagacaatttcctctcctgggagaagggacaggtgtgacgatagtgaagattagtgatgagtcagtccaggactggggtcagccaggcccattgtattagctggatcaaggttcatgtgtgtgtgacctggtgtctccatggtgctggtattctgaggtccggaccctcaggccagctcgtggggagcttcaagcagccatgcctccttctctgtgtgtgttctcttttgtctggcatcagctgtggcctccatggcacttgctgtctcccatgaggcagccaaccttggtatgcctctgatagctgtgtcatgggaagggtgggcagccagtcctgagagaggaatgagtagataggtaatggaggcacggagtgaagaagggaagagtggccctgaaagagcatttagagaagtaaagctcccccacacacattgggatatggtgatctcatggtgagaggtgcaggggcatggaggactagcggggacccttgttgaa

SEQ ID NO: 92426 - DNA, 1400 bp, Homo sapiens
aggagactgaagcaggaggattgcttgagcccaggagtttgagaccagcatgggcaacatagaccgtgtctctattaaaaaaaaaaaaaaaaagaaactccacagaaattccagacaatgcgatgccagtgtcccaacagcttaggagtagcatcaaagagcctgtccctgccaggcacggtagcttacgcctgtaatcctggcactttgggaggctgaggcaggcagatcagttgaggtcaggagttctagaccaacctgaccaacatgatgaaaccctgtctttactaaaaatacaaaaattagccgagcaccccagctactcaggaggctgagccaggagaactgcttgaacatgggaggtggaggagattgcagtgagctgagatcagatcacagcactccagcttgggcaactgagcaagactccgtctcaaaaaaaaaaaaaaaaagcctgtcccttcaaactctggttattgtgaacctttccatgttccccctagtcattgcacagctgtggctccaagcattgcatctgtgttcaaggcagaaacaaggagaaggggtagccctttcacagctgtcatgtttaaccagaaagcaaaagctttcccagctgaccgatctccctttgtgtctggctgaccagaactggaccccttagctgcttggcaaaggagtctaggaaagccaacaacagggatggatggagttgtgttcactgctctaggccagaagtcatgtgccttagcaggggagaagctggagacggcttgtgctgcagtaggatagcattttctcctgaacacagacccccacaagccctgtctcttttcctttgagcagaacatcagctttccaaaccagatgtggtatctcagttagaggaggcagaagatttctggccagtggagagaggaattcctcaagacaccattccaggtgagaaccagacatgggaagcccccacagggaaggggccaactgatgagtcagggaccagtatcttggaaaagcagtagacattgggataccccaggtgggatgctgtgatgagcagttgcagaaccaaactcgaagtttttctctggctccacagtcagcagtgtcctacttggttgaaagtgaacctgttgctggtggcaggtgatacttgtgttgacagtaggggctcccttagtctgttacacgcattgtctactgccctcccctcataatcactggtaaccctggtgtgtatttccagccagactttcttatataggcttacgtgaatgtatgtgaatatatatacacattttgggggtgttataatacagacaagtcagcttctttttgttttggagacagggtctctgtcaccgaggctggagtgcagtggcatgatctcagctcactgc

SEQ ID NO: 92427 - DNA, 1049 bp, Homo sapiens
ataggccaggcaccaggggctcatgcctataatcccagcaatttgggagtccaaggcagtaggattgcttgaggctaggagtttgaggttatagtaagctgtgatcatgccactgcactctaacctggttgacagtgagaccctgtctcaaaaaaaaaaaattaaaaatccttcagcctacgtagagttggctgaagtaaatgacaactctttttcttctttatcaacagcaatttgtaatggtctttttaaggtttgcagatctgatgggataaatacaatatgttcaatttagttcacattttccgcacaacggaccaagttggacatattttataaatctatggcctgtttgtattttttcttttgtgagttcatatattttctcatttttttcttgtttgtgggaattctctatgttctggatgttaatattgaaatatcatatcccagaccatatattgtctacctttatgtagtctctatacagaagttttataatttctttttcttttcaaatatgtctttgtttctgttttagattctgtatcatatataggtagattatccaaacactttagtgtgttgtggtatttgttatatacctcgaactgctgcgctcaagcagtcctcctgactcagactcccaaagtgctgggatcacagcacttaaatttttttctttttagttcagtttatctggaatttcgttttatatatgggtggggttcatcctctgcttattggaaatatcatatttgtcatgggctaaatagctgtctttatatactggcctctatgggctctcccttgatcttttctgtctctgagtaaatgccatgttactgtactttgatatatagtagttccccttgtcatttaaaaaaaagaaaaagtcttagctggctttagcgatctatttctccagatgaacacttattctcagcttgtcagtgttcattgagaaaatcttgttgggatgtgtattacatttaattaggttttcattattactattacctgatcaggttaatcctgcctcatggtct

SEQ ID NO: 92428 - DNA, 1023 bp, Homo sapiens
tagatgctgtccttcctcttctccttcttccacctcacagatacttatggagggccttttctgtcccatgcaatatacttactaaaaacttcggtgataaaccaaagcacttacataatctctaccatcttagacttcatagtctaaacaatgatggccttttacaaacatgttacacagatacagtgataaatgtactgagaaggaaaaaagcctgatataaagaaggggagcagtggggaattacttcagaagacctagtcaggggacactgcaggggtgagattttagccaattcctgaaggaaaataagtccgtggacatataggattggtggtgaagacagcttctaggcatggaggcaccatttgaggtgactgtcagatgggaaagaacttagcatttcgagggccacttcgagcctagtggactaggagtaggtaaaatgaagggatgtgacattgcttttcacagctcactctgggtggctgtgaagaaagaattgtggtatgtcacagattggaggcaggcagggcccgcagttatacttggtaatacctgctaacatgtggtaataagtggcctgagagtaacagcacatttggggaaaatcaggtgtgtgtgattcataggtggactcagtggacctaggtgagtgattgagagggatgaaagaacaagccatcaagaatttctcgtaggtgactgcgtctaacatatttcatacgtaaagtcggacctcctgcacataacaaaatccacagatgctcaagtgcccaatataaaatggtgtagtgtttgcatatgacttactcacatcctcccatatagctgaagtcatctctagattacttataataccgaatatgatgtaaatgctgtgtaagtagttgttacactgtttagggaatggtgacgaggaaaaaaagtttgcacatgttcagtacatttgcagccatcttttatatatttttttgagttgaggtctcactctatgtatcacccaggctgacgtgtagtggc

SEQ ID NO: 92429 - DNA, 2346 bp, Homo sapiens
aggaaaggaatgcagggaagagactattatgaaggtcatgatttaggaaaccctgcagggcattttacattttttacttgtcaagaagttaagtagaggccaggcacggcggctcatgcctgtaattgcagcactttgagaggccaaggtgggcagatcatttgagctcaggggtttgagaccaacctgggcaacatgacgaaaccctattgctacataaaatagaaaaaattagccacacatggtggcgtgtgtctatagttccagctacttgggaggctgaggtgggaggttggcttgagcctggaaggtggaggttgcagtgagctgggatcctgccactgcagaaaaaaaaacaaagttaagtaggaaatgagtcctacaaataagaacttagcagcttttttgaaacatagaccaaacatgagtctgaaaaataagtttgatgaggtgagtgttttattgggaggaagaaagccaaattcttcttgagattccatcctttgtatagcttgagagggtcacataggctatagagtgatcaacagcataccattcttttatccaagaataagatggagtaaatgtgtttagtttgaaaaaattcactttcagcctgtctttgccctctttaatgtttttgccctctttaatgtctttgccatctttcacgggacattaaccagcaaacaccccaaatgaagtaagtccttttcatgaacttttcaccatctgagaactcacacagggaagaaacctcagaaatatgatcacgtgaggaaagacttctggcctaactcagtcttatcttgagaggattcatactggaaaagttcttacattgagtattacatctaagagcttctgaaaccatgagaatataattgctgtgggaaaggttttatgcatagctcccttattcagcatcacagaagttgtactagagattacctgagaacatagggctgggaagccttcgggtgtcccagaactcactggcaaggatccctctctgaacacagcattttgggaaccccttcagtaggagtcctcattgttttcagcatcagaggactcatatgggcaaacatcctgtgaatgaaatctgtgcagacaaatgaccagccttaactctcaccttatgtgacagaacgaaaaaaatatacactgaaaagaaccccgttgaataataaaaatgaaatgtctcatcctatttttatatcatgtcgtagagaaggcaaaccctacataaaacactgataagtatataaatgtagtcttgtctcttctaatttgcttattatctgacctgaacatctagaacaaatatttaaaatatggatgagagcaggtgttcttttacttctgtatgtccccatttgctaacacaatgactgaattactaggaactcagtacataacgttgagtgaatagatgtctgaagaagttgcaggagacaagaatatgtcttcaaagagaagactgaatacaaggccaggctttgaaacaaaagggtaggtaagagagggtaaaggaaaatcttgagagagtgctacaaagaactctgcggggcccacattcttggcaactaggttgagtctggaatgttgggtggctgtcaaacatgttttggctggaattcagtgaagcagagtcatttcatgctttgtgatcttttattgaagaacactttacattctctgccacctcccacatatctgatctctaagacctgtgtaaatcgtgatcctcttatctggggatcactctccctgtgttctagggcttgtactcagggataacttcaaagtctgaaatgtcttaagtagtaattaagaaggaaaacaaacgaactaagtgtttgaagcagacatttttggggggaaagaaaaataccatcaacagtcctatagaaagaggaacaatggctttaagaaaaaaaaagaagaataaatgagtcagaaatagagaagaaaaaaatattccaagagctcattttctggataggcagaatgccaaaatgactttgagtaagtaaagaataaataaccaaccagtaaacctatacaggggaaaagaacctgtacagatattttacatgtagtttttagttacagtagtttgcacagctgttacaaagaatgagcaacctctttatgtattgatttgaaaccacatgtgtgtacttaaagtatatgacattttaatatataaatatacataaactatttcttaaaatttaagtgtgcttgctttggcttcacatatactaaaattggaacagtacagaagatgagcataaaaatttaaaaataacaaaatacatagtcaagtgcgaacacaca

SEQ ID NO: 92430 - DNA, 2825 bp, Homo sapiens
atcacaatttgcttatacatccctcagttgatagacaatgggttatttgtacttgttggctattatggataacactttggtgaacattcttatagaagtttttggggacatatgctttcaattttcttagctatatatacttggggggaatgtctgggtcatggataactatgtgtttaacttctgaggatttaccaacctgttttgcagagtggtacagcattttatgttcccaccaacagtgtgtgagcattctagtttttccacatcctctcctgttatcatctgtctttggtaacagccatgctagtgggtttgaagcatattccactgtggttttgacttgcatttccctagtgaataatggcgttgagcatcttttcatgtgcttgttctcatttgtcttgctctgcttttgacttacagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggagccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaaggtaagtagaagggtgggtagagggacagcttaatgagggtgtcttggagtaccctgtgggggagataagaactccaggcttcctaggaaggtcatgggaaggattgtgtccgctccatacagaccaaggacatccatgttgcccacgtgttcctgagtcagagccactgaaacccttgcattctttagcccttcgtgggcttctgatggaagcacacagatgaagtgcttcatttttatccctctggcatccctgctgcaccataagccctgtagcacttgataagatagatgggaatactgagctcagagagcccgcagtagcaggagagacagggatttgacaaatgagaatgcatagaaaaatgctgggactatgaggagctcgaggtgatggtgaggcttatgaaggtctgcagctgacacctggtgtggagtggaacttggccagggtaaagaaagggggcaggaaagatgtgccatgcagaggggagcactgcctgtaagggccaagatggaagggatcacagtaaatgcaaaactcagaaaaatcggttatgtttgtgatggaagggagcagaggttggagctggcactgccagtggggactttagtcctaaagcaaagcaaaatgttcttctaaaacagtagggctcgatccctgagttccagaaactggtggcaccactggatttgacctttagagatttaccaggctgcatgtgtggtggatggtggacagaggatgggggcgaggctggacacaggctacccgcagctattgccatgccctctgatggggtggtgtcttggataggagtgatggtgatgtctgactggggagagactacacgtgtggagtgtgtatttgggaataagactgcaagacttggtttcttcatcaggctgagtttcacagagcgtgcatgcttctgcattgctcacctccattttccacatttcacgggtgcccagaagatgtttctgatgtgaacgaatgattgactggttgatgtttgtgattgcaggaaaggggaaggtatcctgcagggggatggtgggattctaagaggccagggcatcctggagatcgggtatccgaggcagcagggcaggcacttgcatgagttgtgtcagatgcaccaagtctggggtgctgtacttggcagaataattgccccaaaggtgtccatgtcctgactcctggaccctgtgaataagttgcctcacatgacaaaggggactttgcagaaacaattaaggatcttgagagggagagatgcactggattatttgagtggatctaacataaccacaggggcccttaggagagggaggctggagggtcagaggagatgtaatgataggagcagctgatagaggaagaagccataagccaaatgtttggggcagcctctagaagctggaaaaggcaaggaatggattctcccttggagcctccaaaaggaacatagccatgctgacaccttcattttagcccagtgaggcacaaaccagacttctcatctccagaaccataaggtaatacatttgcattaatctgagccgctggcattgtggcaattcactataacagcaataggaaactagttagttaggtgccaaggagacagttgtggggttaatgaggtgaaagtcagtgaattcaccctgtgtttaacctcaggggtgaataaaataaattagtgccacagaagacaatgggaagaggctttccagagaaccctgagaatctcacattatgtgatcagtgtgttagttgggacgcttgagtgtgactgctgcaaagccttgcacagaatggctcaagggagaaggagaatttattggaaaagttccagggtgctcgagcatcaggcagggctggacccaggagctccaatagtgtcctccagac

SEQ ID NO: 92431 - DNA, 1030 bp, Homo sapiens
gtcatggagccacagtacgatgcaggggtgcggtggccccatgggttgcagagaggccacccttgccctgcctaagggtccccacacctgctgacctcctctggctggtgtctcctcccagtacttcctgcaggacaacctgccgagggcaccacctgctgcctcgaggtcactgcccagcaggaggagaagcaggaggatgcagccatctgcccagtgacagtgctccctgaggtaagcggggagtatcaccctgttttggtcacagcatctcctgtgaggcaggcccacccctgaggcatccactctgccctgggctttcctaagacctcccacaggctgggacattctgagattctgagctcttaggtctgtgctgaagcaatctgagtatgaagagcagccctgccctccagccactgtggcatcactggagacaacgcatggtgacccgggagctgagaaagcaggaggcaagagggaagggactaagtgtttacagagacttgagaggtggaactaccacaggcaggcacatctgtatccaggtcagaacaagagagccctcaaccttcagaaatgcatacttaggtatttatctttggtatctgggatttgcttcagaataacccagagctggggtgtgggtgaaaaagattggtcctgatgcgctgaccactggggtagtggtatgtatgtgtcattggtcagacctgtttgcactgcaaatggcttatactggctcaagcgtagaagtcaatttattggctctcatgtattctctggtaggcttcaggcaaggctgcatccaggtgctcccaggtgatgggaagaatctctggccaacctgtttcatggctctgctttctcccctttcttcttctttttttttgagatggagtttcactcttgttgcccaggctggagtgcaatggcgcgatctcagctcactgcaacctctgcctcccaggttcaagtgattctcctgtctcagcctcctgagtagctgggattacagacagctgccact

SEQ ID NO: 92432 - DNA, 1838 bp, Homo sapiens
gggttggtgtctctgagcaaatccccaaagcaggagagtccctagcaccgtgagctctgtcagaacctcccagctggcctttcttctgccctcattgacaaccctctgaccctcttgctgagcatagacacatatgtgatgttacaggagccagtgaccttccaggatgtggctgtggacttcagccgggaggagtgggggctgctgggcccgacacagaggaccgagtaccgcgatgtgatgctggagacctttgggcacctggtctctgtgggtaaggctgtgccccctcttcacccacctcagggctggtaggccacaggagccccaagtcaggggtgttcaccttctctagactccacactgggcattccctcaaggggcccttgctgcatccagggcctgtaagtggaactgtagacctagaggggtgaggtcactgggtggccagaagcagccttaggtccggtgaaggagtgatttgctatctatctcctgagggagtatgagagaacaggaactcgaagagctcggaggacactccctgcccttcctgtcccttgttcaccaaggtcagtgctcccctccctgccgcttcattgcttttcagtctctctccaggttgcatgactctatttgggagaaaaaaaaaatcctgacttttgaacttaattatgcatttcatgctctcagacccatcccagcacatctctctatgggatccacatcttttgtttatttttttcagggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagt

SEQ ID NO: 92433 - DNA, 1102 bp, Homo sapiens
tgtgctacgcccccaggggcgacttccggtcattgcagcaccgtgatgtggatccgcaagtgaaccatcagggctgagctacgactgaaggccttcccacagtcgctgcacttataaggcttctctcccgtgtggatcctctggtgctcaatgagggaggagctctgtgcaaaggccttcggacaaaccttacactgatatggcttctctccagagtggattctcagatgtcggatcagggctgagcagtcgctgaaggctcggccacacgcgtcacacttgtagggcttctccccggtgtggatgcgctggtgttgagtcaggtgcgtgctctggctgaaggctttcccacacgcgtcacactcgtagggccgctcccccgtgtgcacccgctggtgctgggtgaggtgagtgctgcggctgaaggttttaccacattccccacatttgtagggtttctctccagtatgaatcctttggtgctgagtcaggtgggtgactcggctgaaggccttcccacattccttacactcatggggcttcgcccctgtgtggacaacctggtgctgggcgaggtgagtgctccggctgaaggctttcccacactcgctgcaggcatatggggtcttccgagaatgggtcttctggtgtgcctcgagcgccgaagcactctggaacatcttcctacactcgcgacacttggaggacctcttccctgagtaggtgtatggaggctctgtcccataagcatccaccagatcaaatttgtcttctgaaggaggcttctcttgggaggtgaggtttggccacgcactagaactgttcctcgaggcaccagattcacggccacgctggtctgtggggacatccttgtaaggccctgaagttttcttgaagtggatctgttgggtgacagactttgtccagatctcccctgatagtccagacctctctgagctgccctcaggttcacatgccttgacaaaggcgggtccaagggaaacacctcccatgagggtctcagtgacatttgatggctctgactctcccaggtcactctgcttgcagcttgcctctgtgggctcggctcctggatcccatc

SEQ ID NO: 92434 - DNA, 1048 bp, Homo sapiens
cacgcctggctaatttttttgtatttttagtagagatggggtttcactgtgttagccaagatggtctcgatctcctgacctcgtgatgtgcccgcctcggcctcccaaagtgctgggattacaggcatgagccaccatgcccggccctcttctgtctcttataaggacacttgtcattggatttagggtccaccctactaatcctagatgctctcatcttgggatccttgactaaattacatctgcaaagatttttttccaataggtcacattcgctgggtctgggtattagggcatgaacttacctttttgggggccaccattcaatccattacaggtgggcatcccatagaagcagacagtggctaggccaaagtagcccatgaagtatcagccatgggcacaagatcaagtttgggatgcggcagggccaggcttggctctgccaggcaactgggtggactgaatccagcacactccaaacgagttgataatcaggctggggacttcaacagacaaccaaggtgccagtaaaggcattaaggagctatcacggccaggtgcggtggctcacacctgtaatcccagcactttgggaggccgaggcaggcggatcacgaggttaggagatcgagaccatcctggctaacagtgaaaccccatctctactaaaaatacaaaaaaaatagccgggcgtggtggcgggcgcctgtagtcccagctactcgggaggctgaggcaggagaatggcatgaacccaggaggcggagcttgcagtgagccaagattgcgccactgcactccagcctgggcaacagagtgagactccgtcacaaaaaaaaaaaaggagccatcacaaggatgtaagatcagctaacagtaagactgtggctggtagggtggacaggcaaagtgactgcctggagagtgggcaggtggcccagcagggcccagagggtgccttcccagaagtgaggagtccagtctggggccggccactcaggatggacacaatgtaccagaagtgaggtagatctctgcagagtct

SEQ ID NO: 92435 - DNA, 1942 bp, Homo sapiens
ctgcggagggcggcggtgaccactgggcctcactccgctaacccaggtccgcatcaggcgcgtgccggtgaggcggctgtggccgcggcgaggagtcagagggaactgaactggctactcccgcggcaggtgggatttaaggtcagcagctgaacaaagaagcgagcgctggccagacttttttctttattagacatggctgcgttggtctcacggaaatctctgcgcttttgcaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacggtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctg

SEQ ID NO: 92436 - DNA, 1535 bp, Homo sapiens
gcctggccaacatagtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaa

SEQ ID NO: 92437 - DNA, 2104 bp, Homo sapiens
gggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagccacctgtgctgttgtctgtcttcggtggggggatgtgggtggcatagccctggtggccttgggagctgctcaccttcctgacctgttggcctgtggggacctggaagtattgctgactcagaaccatggcaccccagggctagcaggtggggcactggatgcaggccaggctgcctggagtgtcccagcaggtactggaaatgagatggggttatccataacttctgagggcgtggcacatgagatgttgctgtggtctgggtggatgggtggcttgggtgcctgtgaggtctgggtagtcacaagaccatcctgagaggcttgtcaccttgaagtagcactggggagaggaggaaagctcagctgtttagggcacacgatttcagacccctagcttcacccccctcttggagtgtggggtggtttcacactggcgaggttgtgctcctggttacctccccggctacactggttgtggctgcaccctgggcctgcacacccagtttctgtgggctgtacgggttcccttctgccagtgtccatgcagtgtcatcaggctgctggggacaggttgggacccacccagggccacaggctggtgactctggtagaagactcatcaggttctgaagggtggggtgggcccaagcccacccaccgtgtgccatcacccttccaccgcccccaacatctggccaagacaggcttggtgttcatcctggtggggctggcccagggggcggggcaggcagtcaaacgggtccagcgggtacctgggacctggaggggtggtgccggttgagcaccctccccctgggagggtacttttgagcccagctgctggcaggccaggaacagacagggacacgccactggccagagggaggaggcttccacaggtaggaaggcgcccacaggctggctgcggtctgtcattactctgtggggggtgcctatctctgctcctctgtgggtcaggtcctttccatccctgtctggggtcctccccatctccgtgttcaactgcggtctgtctctccgtttccaattcaggaactggtaccccgtgggtccattcctatccccagtctccgcctcgggcctccccatctcccctgctcctcgacgctagctacacccttctcgggatggggtgctctgtactgggggatcctctctaaagtacagtccccagtcttccctggattccctgctggtctcagaacccgctccaggctccaccgcctccttccctgcctgacctcctctcctcccaggtccatccggatgccctgccctcggccgttctggc

SEQ ID NO: 92438 - DNA, 1038 bp, Homo sapiens
tggggcttgctcctgctccgcaacccctactccgtgggggtgcagttggaagcatccctgatcctcatcccttgtaggagtccagctgtggacgcccccgactgacatccatgcaggtgcccagccaggggcagccccacacggatccttgaacgggtcttgctgggagtgcccccagtcatcctcaccacagattcctgggggagcgtccttgccagcactggaggccaaagcactcatccttcggattggccataggttgcaggggcccgcctatctttggagggcagagctgctgctgctattcttccttggtcacctcctccccaactggctcattgcaggggacgtcccaccactccacccatctgtggagtttgttttctactgcctgcaggctgggcctgggtgggctccagctgtctacatgctggtcccgggtgtagagttgccatcctgtacacctggttggggctggggctcaggcttgaagtaacagggtgtcctggccagggctggggaggaacttgagccttaaagactggctcccgccccaatcctaagtcccaaactgctctgggagcctccacttccccctgggtcgtggcttctaggatcctcccaatatgctgtggtgcagctgtgcttatcatggctcagaggccaacatcaccccaggggtcagacagaggcagacaatggtgggggtgggagtcctggacctccttggttagccagagggatcctagtccctttccctggccaccagagtccccatcacccccgattaatatcttgatgccagttactgcacttcttcctccagggctccatctgtcctgcccagcctcctttcttgtacctcgaggtgaaccctgagccttcccaatagacagcagcctccagggaaggtggcatatgggctcctgtcctcttcctcccagaagtcttcctgggttagttatgggggtagatggcagctattctctgtgcagactgaacctggggcttctgtttcctcccaggccctgcacacca

SEQ ID NO: 92439 - DNA, 1107 bp, Homo sapiens
cagctgctgcgtgccacccacgtctccacactggctgttccaccccctccctttccatagctcactcccttctcccctggtgccccgtcttgggcacccactcccaaacctgctcttgcaatgacctccaaccaatgctcaagactgcactcctgaatcctacgtactcactgcgtctcccctagcaccatcagccccacaaaggcaggaccatgagtgtcctggtcaaggctgtgtctacaatgcccacaagccctcaggaaacatttgatgaatacaaagataaatgatgggcgaaataaatacctatcaataatggctgctagttgtggagggttcaaggccacacagcccagctgaaggtaggcccttctgtgtgaacccagctcctgtgcccttggagctctcccttcaagggcacctactaaggcagcagcctccaggagaggctgatgatggaagagaagggagtcaggtaggaggcaggagaggaggatgtgtttccagagtcagaaaagcagggacatgggcttggccacaggttggtccttagttcaccccacctgagctcccactcaccagagttgagcctcccgtaggtgttcctggccagggtcatgtcctttccactgggaacccagggctcctcgccacgctcaagttgaatgaccacacgaggtcgggaggtagagagtcctgtgaggaggagcaggtgagagcccagccccaggtcaagacaacccacctcccaacagagagcaggagtcagggcttcatggaaatagacagtaatctgtgcaactgggagaatctaaagatagcacagggcaaggggctcataggaatagctcatgtgtccccagagcagcaactgtgcccagagcaccaaagcaacgggactgagcccaggcatgagagaggccacagctggacagggcggcaaggagtggctgacccaaccaaactttgtgtctacaggaccagacccttgttccacgtggccctggccagatttgatcctgctcatcaaccaggagggaagtgaagaggcagtcctgattgtcaccaagtgcacttttcatggagcacccagggccttaccaagtg

SEQ ID NO: 92440 - DNA, 1055 bp, Homo sapiens
ggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataatatggagtttctgaataagaatcctgatttctggcttctgctggtcgggaaataggcagtttgctgtctctgcccagtagctgcagcacagggcagttgagcccagaacggccaaacctctgttgccacagaacccaggtcccaggtccccagcctcccttgctccttgccgcccacatcactcaccagcctcactggccttggaactcatcagtcccggcttgagagacacaaaggggatttcctttcgaagtacggctggacaagggggacctctgagaagaggggctgcaagcaggggttgcgccaaggccatgggtacttctaggtcaggccgcaccctccatagttagctggtcatgcagcaggaaggcaaaaggtcagctccctgggaagcaccggatctctgggcagtcactggggactcgccaatgcactgtattagttttctgttgctgctttaacaaacttggcagcttgaaacaacagattctcttatagctctgaaggtcagaactctgacatgggtcccactgggctaaaatcaaggttttgttttgttttgttttgttttgttttgtctgagatggagtctcgctcagttgcccaggctgcagtgcggtggcacaatctcggctcactgcaagctctgcctcccgggttcacgccattctcctgcctcaacctcctgagtagctgggactacagacacccgccaccacgcccggctaatttttttgcatttttagtagagacggggtttcaccgtg

SEQ ID NO: 92441 - DNA, 1021 bp, Homo sapiens
ataggcgaggggggccaggacccagtgtctccctgtgccgggtgggtaggggttgagggggagggtacctgagggtagagggagatcccagtgggcagtccagatggccaacagatgttccagacaggctgggttccttgcagacagggtgcttgctggatttaggggtgccctgtcacagtgatatcccaggataacagaaagggggtccctgccaggaagggatgggagaggggtacctcacagtgtatgaggatccctgttgggcaggaaagtcccaacgtgaagggaggtcctggagaggagggggtgtccctgctgggcaggaagatcccatagtgaggggagggttctctgataggcaagggatcccggggtggtggttcgggaggggaggggagcccctgctaggtccaggagcccaggtgggggtggggtggggtgggggcggggagctgtagagtctgacttgcgttcgcggcccgccctgtcttccgcaggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaa

SEQ ID NO: 92442 - DNA, 1052 bp, Homo sapiens
gcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggtgagccagggcgggggaggagagggagcaatctctcatcggagagttaaacctgagggggaattgagcactagttacagggcactggcactgttctgttacttttggttagcagggggcctagaaattgagccttcccccaagtgcaaggtatgtgggggaggggaaagccccactctgtggagcagcaggcactggcttctgtggagggggatcctgaggctgggtagggaagcaggagcctgtcctggcctttggaagggtggtggtggaaacttgagcagcctgggatgcacatgatgggtatggagccttggcaggaggtcctggcaggttgggaaactatgctccagggagcctcctgtgtctctctggtttccagctgtcccgttataggctggcagcaagggaggatgggtttacaggcccaggggtagaaagccctcagaggtggtgggatgaaggccccaggaactcctgagactggggcatgagtagga

SEQ ID NO: 92443 - DNA, 1044 bp, Homo sapiens
agggccagggagcggggtggtgtatccggatccgtagtctggaaaagctccctctggctgccgtgtggggaacagaaggggaggcgaggggcgcagagacaccagccaggtttcttcatccgtccaggacagcgggaacggggcagtggaggtgctcgaagtggtctgagggtcaaatgtggggcatgcaaaaaagggaggcgtctggctgagcaaagggacggcggattgggcataaggagtcggaggggttgaatcttgagaccccagtagagcccgagggtgtaggggcagcatcaagccgagcccaccctggggctttgtgactccaagggagagacaggctggtggagcctatacggatgtcagagtccagagctcctaccctcctcccttagactggaggtgtgtgcagtctgggtgcgggatgagccgagtatctcatcccttgtttgatagaaggggaaacaggccgaaggatcacggtttacctgcttgatggatggagtagcagaactcctcagattccagagtcctctgaggactaccccctcccctttctggtgcctgatgttgggccgtgtccccgattactccatgggcagctatccagtcacacacccctgctcaatccacacttcccctctctgtgccacacccacaccctgggccccacaggccccatcgagatggcaagaagctggggctgcaggagccacctccctgctcgctatgctaggggctgccagggagcatgtactggtttccctggggcatctcccaaggtactgcccaaccttttaccctcagcccttagtgactaggcacacccagaaccaccctgcccaggaagcaggtcatgccaccccactcctgcgagagcctctgtatatactagttaaggtgacctggttctgaggcagcaatcctgcctatgcacagggtctcatactggggggatgtggctaaaggaaaccaaaaggagctgtcagcaggggtggaggaggagtggaagctagctgggtagagagcaaggtctactcg

SEQ ID NO: 92444 - DNA, 1106 bp, Homo sapiens
ggaattacaggcgtgagccgccgcgcccggccacatttttctccatctgtggtctaggctggcgtgcagtggcacaatcccgcctcactgctgcctcggcctcctgggctaaacggagcttcccgactcgcctaagaaagtggtgggattacaggtatgagccacggcgcccggctgtgatctacatttgattcagtcaagtttctgtgtttctcaagtttaactatagcgtggttaaaatccaaaagtcagcacccgagctcacacaggagcttcctccctcttgggatggagactctcctcccctctccctggacacagcccttcactcggtcttggccccgcctacttctccatcggccctgccccctatcccgaactcttagtgacgcagaggctggagacgactctacggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcgg

SEQ ID NO: 92445 - DNA, 1313 bp, Homo sapiens
gcagagatgaggatgccacctgggcgagaggatgggggcccggacagggcacgggaaatactttctgggtcctgcatacgaacgtgggtttgtgctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtggactgtcccgtgtgcaagcaacagtgcttctccaaagacatcgtggagaattatttcatgcgtgatagtggcagcaaggctgccaccgacgcccaggatgcgaaccaggtgcgtcctatctcagcaaccacaaggaggtttctggggagggggcatctgcgcaggaggagcttggcaccagctccaggctgttactccactttcccaaggctctgggtgggctgcctaggttgggtcaagggaccaatcttaaatctccggttgtattttctgggatgtaaacgtggatctatcaagttgtcttgccttctctgaccctgcctttgtctggcagtgctgcactagctgtgaggataatgccccagccaccagctactgtgtggagtgctcggagcctctgtgtgagacctgtgtagaggcgcaccagcgggtgaagtacaccaaggaccatactgtgcgctctactggtacatgaggctgaggggggctgttggagttgttctcccatgtgtgccctcagttgcttttatgatgttggttgcatctggtggatgggtcctagagttctctagggggtgccgcccgaagggcccgagggcagaactccagaagcagaaaaactggggttgtggtgtgtagtctctagggcctaggtgggagagggtgggaaggggaaataagggagaccttaatgtgctgcagggaggtacaaagggtttgagaaggcttatcagggagttgtcagacctggtggtgaagggctcagcatatgcaaacagggaaaggcatggtgtgaagggctttctgggtttgtggttccctggcacacatctggtataagatgctgctagggaaagtagactgtgggtccatggattataagtgatgatgatttttggaagtgttttagcttttgagttggcagagacttacccaaagtttggtttggcatttccagcttttcacagacacagctagctttggtttggaaggagcttgagagtcttttgagtctagccaagttttggggccagaatcctccc

SEQ ID NO: 92446 - DNA, 4228 bp, Homo sapiens
catttcatctctcccagtatgagaacctctacaaggtttcctctgggcccttggattgtaagagaccctggtgttctcttgtcagggaagagggaggaagttaaccatgaaaggagaagaaaaggaatccagggtggtgtgtaggcagaattctgagtatgtccacttggagaagtgttcagtaaagggaacagtgtggggaagggtcagcgggggtggggggtggggtggggtggtcctctttttctagacgctgttatccttacccttacattgttgttatctctagaagctagaagaaagggatgtgtttctcagctatgttggggcagaggattctgggagcaaggagttgggcttgcaggcctgtgttcttccctggccacaccctctacatcttcccaataaatggcccagtgtcacagaacaggccggaaatgaggccccaactcattctgcttcctgagttgggggtggtgaagggcaaggtccagccttatgattcccactccccagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtgagtcccaaggcatagtggttgggtgggtgggtgccaccccttccgtagcttagtgctcaggaacacatctgtctgctctcaggtaccagttcttagaggatgcagtgaggaaccagcgcaagctcctggcctcactggtgaagcgccttggggacaaacatgcaacattgcagaagagcaccaaggaggttcgcagctcgtaagtgtgggttctggggctgtgggggtggcccagggcagcaagaccctacctagcctgacctgctgtgtcccctagaatccgccaggtgtctgacgtacagaagcgtgtgcaagtggatgtcaagatggccatcctgcagatcatgaaggagctgaataagcggggccgtgtgctggtcaatgatgcccaggtaagccttgtgccggtgagaagggtccctgagccccctctgctgattgatgatgctgtctggggtgaggagtgatcctagtattcttctgccttctctgcttacctcatacaccttctatctgcagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttggtgtgtactggtgggctcctggctggtgggttccaggcaggtggttcccaatacctcaaatccctatttgttgttggtgtgctcattctttcctccctttcactcccaaccagatctacttccagctgcaccgggccctcaagatgattgtggatcccgtggagccacatggcgagatgaagtttcagtgggacctcaatgcctggaccaagagtgccgaggcctttggtgggtccccagctttacctcactctgttattaccccacgtgctgcacctacttacgtttctctcttctttttgcaggcaagattgtggcagagcgtcctggcactaactcaacaggccctgcacccatggcccctccaagagccccagggcccctgagcaagcagggctctggcagcagccaggtgagcaggagagaggacccaggaaggggtgggcagggaatggggtccagtagcaggagagaggacccaggcagggggggtgggcagggaatggggtccagtagggttcctgtcccactgaggcagagggttctgctttgttcacagcccatggaggtgcaggaaggctatggctttgggtcaggtgagtgggtctgcctagtgggtggggaagggccccagtgctgtttctaccccaacctgccagtcttctttctccattttctaaggagatgatccctactcaagtgcagagccccatgtgtcaggtgtgaaacggtaagtatggcacctcccctgggggtgaggtggatggagggtgggggtgtactcatgccaggttgctgcatctacaggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggtaagcctgtcccaaggaactatagctgtaggatgaagcctgtagtccaggtctggaccctgttgaacacccctcatcaccaccttgcaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgagtgtgaggctggtgggggtcaagtctgggtgttgggctgtctggacaggatcatgtgcagacccttattttcttcaccctagggaggagtggagctgctcactctgccatgtgctccctgacctgaaggaggaggatggcagcctcagcctggatggtgcagacagcactggcgtggtggccaagctctcaccagccaaccagcgggtgagggctggggttacttaggtggggttgcccagagaggctttataggtgctgcccagagctgtgacatcccttacaatgtttgtagaaatgtgagcgtgtactgctggccctattctgtcacgaaccctgccgccccctgcatcagctggctaccgactccaccttctccctggtgagtcctaggatgggaaaggggaagggggtggtggctgctgggtctcgccctcaacctgtgcatgtatatgtgtgtctttgtgtgtgtatgtgtgatctctgcctgcaggaccagcccggtggcaccctggatctgaccctgatccgtgcccgcctccaggagaagttgtcacctccctacagctccccacaggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgtatctactagtcagccttatcaagcactggtggcacaagggaggggggtcttgtcccccacctatcgaagcccatgtgtatggatgcctagggagtggggaagactgcctccttgccctttctgggtatggggagggtcacccagggcaaaggatgtacacactagaggcttgttgggtaccctgtgggatactgggtaggtgtgacctacatccctgtgtaggcagggttagccccaggtgtagcacagccactctactgaatgcttcctaaattttggtgctgtagctgtttctcatcttcagaaggtcccacag

SEQ ID NO: 92447 - DNA, 1499 bp, Homo sapiens
tcatctctgtgttatgatttagttactctacagtcgagcctgtgtgaatcccaaggccacccccttgcctctattggttggtctggactgtccttgagtgttgtcattaaaccatcactggaccaaacagtgttggacactacagcctggcagatgaggcctggactctcaagatcctaccagggtgtttgggcagtccagtatcttgggagaggtgatggagaagggcccacagctcacctgaagctcccagctcctgaaaatcccaggtggactttgcttgttcacccctgccccaaacccccacccttagcttagtaccaagtgcctcttgccttagtgatgcccatcctcccagggaccccagtctggtcccacatcaggccaaaagtcacatgggcctggagactagtgtcaaatctcttttattacagaggggttgtggtaaaagatcctgggcatccactggttatctcggagtggcaggggcactcagtccctccgcaggttcttaagccgttcctccaggtctgcatcagcatcagctagggctgaggctgcggcctctgcttttttcccaccagcagccacactaagcgagcccccagttgaggggaggtctgcagagaaagtgggggtttgagcaggtggggtcaggcagcggaggggagtaatgcagggaaagggagggcttggagctgtggctgggccttgggtgggaaatggggtccaggatttggagcactcactcgacagctcatctgttaggctaagtcccagctcatccagaacctgggacaccacagcatcactagggaagagagagaactcagtgagggctatgcactccgtgagggccaggcaaacatctccaccctcccatccagtttccccatacctctcctcttcatcttcctcatcacccatggcatcatcaatggcatcattcatcatctcctccttcatatccatgatctctgcctgccgctcaaactccatcatgatcttctggatctggggcaacttcagctggaagtgacaggagtgtgagtgtgatccccatgggtcgtgggagtgggaagggggattgggaaaagcgcacctgtctgttcatggtgcccatggccttggtgacacccttcatggcttgtgccatcgagttgttggacttgagtgtctggatcttgagggacacagcctggatgttggcccgcatcaatacaaacttgcgcacatagcgccgggtgcgcaccaagtcttttgccatgatgcgaacagcatcctgcagagtagacaagggtatcaaggacacaggaatgagattatcctacacttcttgacaccccattagttggttgtccctccccaccagcccaatttgcaattccacttgaagtttccagagactctggctaacccaatggtcactggtccctccctccttctgacctaaccctcctctgcctcttgggccaccaactccctgggctcctttgtaa

SEQ ID NO: 92448 - DNA, 1046 bp, Homo sapiens
ctcgtacgctgccgcccgcacgcccgcccgggatccacggtccagcaggggccactcaccggagctgggacggacacccgtttccgcttccgggtcacgcttctctttctgggatccccgacttgcccaccaactaaggcccctcggtcctgtcgccgccgccgccgtttccggattaaacgacgtgacgtaacatgccccgcccgcacccggaaggttgggaaactccaggagcgcgcgtgcgcccgtgccccggaacgggccagcgtccgagcgcatgcgcaacagctcccgtttcctctgcgcgtccgagtgtttcatgttttgagtcccgcccgagtgacccaagccagtaccggggtgggcgctttccacccaacctccacttgaggacccagcttattcgtgagaccttgacttctgcctgaggcctcagatagaaggagcctcagaaggctcctcctcctcggtgggcccacccacacaagaaaggggcaaagctagagatggcttgtttcttccactttgctggcctcttggccaggaagccacaggtcactggatcctgcctacgcttctcatcctagagtaggcttcatcccaaccaaccccaggcacagtcatggtatccccaccaactttagagctgccccaggcactgggcagcctgttgtagggtgctccaatgccacctgtgaccacaccttccaccaccccagctttgcaggccctaatggacctcagctgcccctcccaccccatagaagtaagaagcagaggccatgcagtaacattcccctttaatagcctggtgggacctccagaggtggaggggtgggttgcctgggcccagctacccaggcccgttgcccacccactccacagcccagagtgggggctgaacaagcacccagcaggggggctagacaagccaattcatttcccatcgctgagtgggtcgggggaggcagcgccgaccttaatcacatggtgttaaaaaaaaaaaaataactaggggcacgtggcaggaaggggaggcaaggcca

SEQ ID NO: 92449 - DNA, 1025 bp, Homo sapiens
cgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaagggtagggggtcaggggatggggttggagccggaggtcggaggtcagggcctgaggcagggtgatgtgggagtcaggaaggggtaatgcggttgctgagggtcagaggtgaagggccccgagcgtggggggggtcggaggtcaagtcttgagggttgggatcatgcagtcacggggagggggtcagagataggggcccggtatgtggtggtttaggatattaggaaggcctggtgtctgctactagggactcggaatctcagagtcaggcagtggagtggaggaactgacgactcgagagtctgggggttagacgggaacttgggtttggggtgacaggcggagaagagagggatagtagaggccaggggttggggatatgagtggaagaggatttagtttattatgctggggtctctgggaatctctgagtcaaacgggtgaagtaggttggaggaccagggactcatgggcctgcctgagtcacagcaatttggggtttggggtgacaggtggaggagggaaggttaatgagtaccagggattggagacaggggtgaggggaaatttaggctattgtgctgtgaacctcagagtcagagggggtggggtagggtggcgggggttggggacttgagagtgtgggggtcacatggaaagctgggtctgagagacagagaagaggaaggacagtgaggactgagggttggtgggggtgggcaggatctttgagtttgggtgaacaggtagatactgtagagtggaggtcatggatggggagcctggggtttagggcggtcagaggatgtttgggagtgggggcattt

SEQ ID NO: 92450 - DNA, 1762 bp, Homo sapiens
gtgaagctgagttttcagcttgggcagaggcttaaggaataaaagatggaagagtaattaaggagtgggtcgtgctgtgggaagtgctgtgtcaagacacctgaggatggaattggtagccctctgttttgggactggttcagatggtgttttgggttcctttctatgacctttatctctgaaacttgattgtcttaaaatgtattttgtgggagaaaatataattattgtatattttgtgtaacagaatcagtgagaataagctgctgtcgcaaactgtcttgcctagagagagggcagtggcatacagctgcagaaggggccacacgggcctgctgagtgttccgtttcatttcaaattaggtcattctgtcttgattttgatatggatgtttcagaacaccctagcagatgtccctgtttaacttgaaaccatagatcagaaaactaagttcatatttcaattttacagagatttgaatagaaaaagtaatcaagttaaaacctgcaaagctaaaattgaactacttgggagctatgatccacaaaaacaacttattattgaagatccctattatgtaagtacagttcacgttttagggctaatatgaagacccaacacatttgtatcctgccatattaaataacagatgagattgtgttaaggatgtttttgttatgcaggttttgccattttcttctttttcctgtccatttaggggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaataca

SEQ ID NO: 92451 - DNA, 1061 bp, Homo sapiens
ttataaacataggcagtctcagagtgcatctgtatttctctgtgatccaaaaagtgtagtctattgtatttttaaaaataccttctttctgcagttgttacatggctgcaatgctaaagcaatgaaaatcatcacagatacatgtggatgctttattacagcttgaagagtgcttagtcttacatgtgctatcagaatcctcagtagtctaggccacagggattaacctggcagttctgcaacctcagtgttcacagggttggtaaagctaataatcgagattagacatttgtttctagcattctttgttggaatatctaaaccattggtattctatttatttttaaagaatgataaacttcaaggttactaagattaggctgcatttgggagagtacaccatgtactcactactcaaaactccatttctttgacaatattccagagctcaggcttctgattaactgacctgtaagtccggacaatgaagtgtatctgtgactgttagggagggttggtggggacattgttctctttggcctgaggaggtctattaatgagcttcagaacgcggcaaatggatttgctctgaggtgaggagggcagagcccttcctgctaaaggcctgcttttctcaggctctgggcctttctttacaaagacaaggtcatggtttacggtcttgccctgccatccttgtgtgtcaggacagaagtgcatgtggcaggttaaccagcagaactgggactgcagggcctgcctgatgccacaccgtcacacgagtgtgggcaccctgggacacctgccctgccctctggtgtctcactgaggtctgcaaagcacagagaaagcccggactgtatctacactgtggtgaccagccacagtaagagtttgctgttgctgtttaacaatttgttaacaccagtaacaatttgctgttgctgtttaaaacttttggaatttgaagaaattatctttaaaaaataggagttatgaaattatagttaacagggtatcaatattttaaactttacctatctcttggccaaaatgaaccc

SEQ ID NO: 92452 - DNA, 1122 bp, Homo sapiens
atctgcatctctgggtcctgttgtatgtggggttgattatctgagtgaatggggcatctgcatctctgggttctagtttatgtggggttgattctctatctgagtgagtggtgcatctgcatctctgggttctattttatgtggggttgattctctatctgagtgagtggggtgtctgcatctctggatcctgttgtatatggggttgattctctatcggagtgagtggggcatctgcatctctgggttctgttgtatgtgggagtgatgctccatctgagctgggcgtctgcatctctgggtttatggatccctaagcccaactcactcacagcttggccctccatgtgctggtctttcctctgccttacccatgtttggttatttcttatataacattggatatctttggaacaggagaaaattgttaagtgtcaatttgctgccccttttttctgtaagtctatcttctataaagtaatgtagtccctattatcatgatgctatttcactatataacattattttcaatgcctgcatagtaaacacattgtaggggtataggctgaatttacgtaaccagttactgatattagagatgcagagtttttctaattgttttactgacaacagcaacacagaaatctccaacctcacatgcctacatttccactattgacttggaataaattcttacaagtgaaatttagtcaacatatataacttttatgtgacagttggtaaatgttgctaaatcaattttcagaaagcatatgccaatattggttgtacatatttcctgaaatccttgtctgcactaagtagcaacgtaaaaaaagaaacttttctgagtaataggtgaaagttttatctcactgttttaacttgtacttctgtggttacctgtgaggtttaacgcttttcaaatgattgttggtgttttgcatttttttagtgaataatctgttcgtattcttctttgttttgcaatatgggctttaaaaaacctatttctaattttatgtgttaaaattggtaacacatatagggcagaaatatgtgttactagtctgtagtttggctttggcttgtgttgaaaaggttttagaaagtcaaacagtt

SEQ ID NO: 92453 - DNA, 1293 bp, Homo sapiens
gctgctgatgacccagagggcttgcagggtgacgtctctctgctgggggaggcctcggggtctttcctgtgctgctgggtggtgtctccctgtcctgtgacccagtgtgttttcttcataatgagcattcattgcatttgggacagtacagtggagattaccgctgctcccaagggtgggcccagtgagggtgttgctcccacctcagtccacatcagctctctccaaagtcttatctaaatagacggtgtcactagaactttttggttgtattgcctagtaattttttgtttttgttttttaaacagattattttcgaaataccagtatttcgactccagggggatgttcatttctatagtattttcagccccactgctggtgaatgccatgatcattgtggtacgtagatgacactttcagttgtctttcttcatgtgtatgtttttcaaatctaaacatgtctcaaacaattgtgtttaggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgcttta

SEQ ID NO: 92454 - DNA, 1059 bp, Homo sapiens
tgatgccctcccacggttagggattgtgcatttttctccagacattcgagcaaagcaattcttgcttttaatcattgtaattatagcggaagcgttgaagtggattcatcatacttcatgattgacccacttgatgagttattggcaataacgtcaacaaataaagcaactgcgcgtattctagtaaatgctctcctttgcgctcagtattaattaaggtgctaaatttgatgttttccagtcaagagtggcctctgctcacctgtttgctacaagatgtgattggcgctttctttctaataaggaccttgattatttgaaacagcctgtctgaattgtattgaaagaaactttttttttagcgttggaggccaagtattacaataagatggagcattttaagagcaagactcctaactttgcagtcataagtaattaggtatgtgctaagcctaccttagacaccagtgcatggtcatgttagctcagattcttatgtatttaaaacgaatctgttaagtattggtgttggcaggtttgtcttgaaaacatgaatgttcttagtatacaatgtcatccttacttaatggcagaattattttcttaccataactgcacaatattattcaacttgtgtaattatttaatcatttcagttaagagaacttggtgcttttaactagaaaaagatgaaagtcttttctaaatcttatatttctagttatattttttctatctgaagtcaaaactatacacattctttatcatgactgcttgtttgaatcatggaatttggccacgtttgaaggtctcctgttcggtaacagacctgttttgtttcccctttcaagtgcctgttcccgatgtttttttctaagttaagtgagttcatggagctctgtctctgaccatacctggatttgaggggtaaaatcccactggcagacaacctcagtacaatgtgcgaagtgtgtcttgcttgtagcttcaaagactactattggttgatgtttacagcacatttgctgcttttaaatgacaacacttcttcagtctggg

SEQ ID NO: 92455 - DNA, 1039 bp, Homo sapiens
gctgtttgctgtggcacacagaggagcagctggcaggtggacggacgcctttctccccactccctcagttggccatgaacactacagaatttagcgtctgctgagggagggaatgaacccccccttggttctgcagtccacattcattgtgagatgcattctggcctgcaaagtcaaccgtccatgtgttgaggaggaaaacggtatgcctcccacatgcaggagtaactccctctccctcctctatagaggatatccttggaaaccctctgtccacataatgggatttatttattcagctttattgagctacaactaataaaaattgtacatgcttaaggtgtacagggtatgttctcatatgcatatacattgtgaaatgcacactacaaacaagctaatacatacatcacctcttacagttacctttgttttttgtggtgaggacatgtaaggtttattctcttagcaaattttaaggaaatatggtattattaaccatagtcaccatgctttccattagagccacagaacttgtttaccttacagctgaaatgttgcaccctttggcctgcacctccgccccccaaccctgaacgcccctggtaaacacggttctaccctctgcttctgcgttcaacatccttagattccacatgcaggagaccgtgtggtatttgtctttctgcgcctggcttattcgactcggcacagtgtcctccaggctcatccatgttgccacagatggcaggatttccttctttatggctgaaggatgttccattcggtgtatctactgcatcttctttattctcgcatctactggtggacacttgggttgtatccatatcttggctgttgtcagtaatgctttgatgagcaggtttaagagcctgttactctgtccattggtgcagtgtcactgggaagcatctgtggcatttcaggtaaatactgagaatgtggatgcaatgagagcccgtggtatggatgtcccaggagtggctctgactttgctgttcacagtatctggaataca

SEQ ID NO: 92456 - DNA, 1069 bp, Homo sapiens
tgagggtgctctgcagaaaggatcactcacatgaagtcacctgagctgcgtgtcagcagggggaagccgatggcagggcctctgggacttggaagaggggagggagacctgccacggctgtcaggaaaagcctcagggctgggtctgagctgagtccttaagccatgcggttcaggtaagcagggaaagaacaatgatgagaaagacccacttcttcttttttttttttaattaatacacttgttttttggacgattttagatttacagaaaacagtggaaggtgaagagtagcctgtgcccctcactgcccccacctcccctgttcctaacacttgcatcctctggtacattgtcacagccaggagctagtgtggatactgccacacccataacatccatgtggctcaaggggacttcccacagctctcagggtggcagcattttcttcaagtccacaatagaaatggttccatccgaagcccgaccaccttcttacctgtgtctgcgatcgaggcacattctcttccctgaatcaatcatgttggcgaagatgatgagaattctggcctgaattgtgtgtggactgcgccttgcctccctgggctgtgggcaaggtcatagctctgggagcggagaagggatccccagggggagacacggccactggcaggaggaataaacgagtaggaggaaggcaggactacggcaaaaccagcagacgccacagggacgaacagaaaggggcttaataaacagatgatggatgcagcggaaggagggagagactagacctgcttctgcgaacaacaaagagcacagccccctccaagctttgtcttagaacatgactcaaatccctgctgttttgtcacatattgatatcagactagtatggaaaatgcattcaatgtgacataatctaatacagtgaccagatatattaatcacagcacgatgacagcggtgaaaacctaaaagcaatctacaatgtccatcacaaagataaagcttacaaaaaccgtaactccacacggaaattctaagctgtagttacagttgtatttctg

SEQ ID NO: 92457 - DNA, 1044 bp, Homo sapiens
gggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggagaatggctttatttttttttacctgaaaccagtacatgaggctaaaactt

SEQ ID NO: 92458 - DNA, 1047 bp, Homo sapiens
cagctggtggtcttggcccctcagggtgagaggaccgtgggcatggacggaagggtgggacgggagcctcagggagacttgttatgggggctcccattaactcatacctgtctgcaactatgaaatcctaagagaaccacaaaatccatgcccacagggcaagtacagcgggcaaggcaggggcctcagggcaaggcctgactcatggccgtggctgacacctgtcccggagctgacaggctttgctcacctgaaggccatcccagagctgacaggctgtgctccgtctctcttctccaggacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgg

SEQ ID NO: 92459 - DNA, 1112 bp, Homo sapiens
cattttagactgtaggaccagggggcagttcaatgccttttcctatcatttccgaggcagacggtctcttgagttcagctaccaggaggacaagccgaccaagaaaacaagaccacggaaaatacccaggtatggtggtctctgaggtcaaatgatgtgcagaggggccctcgcaccgcgggcgtcgggcagtaggaccggcatcctgctgtgggcctgtggcgaggatggttcctggcagggacgtcccagggcactgggggccaggccgcagcctgcgtcctgctgtgctgcccactcagagcatcaggggcggtgcacacccaggaaaccttgaaatgagacccagctcagagcatcaggggcggtgcacacccaggaaaccttgaaatgagacccggcgtgacctgccaaggttatatttccctcctcctcctttcccctcaccacagtgttgggagacagggggaacatctcagcaacagcacctcagccttcagcacacgctcagatgcatctgggacaaatgacttcagagagtttgttctggaaatgcagaagaccatcacagacctcagaacacaggtgaggtgcctggcggcctgtgtccccccactccaagattccacagcagcacagccctgcccgaaccttctgggtatagcattttattcccaggcaactgttcaactgcccacacaggacccagaccctggagccttgggggtgtcatttctgcacgctgggtcaggccgggccatgtgccactggtgtccctgggtttcccagcagatgggggtcaccaggcaggggcaatctgtgtcacggccgtgtgactgccagccaggtgaccttgctggagggaacacaggattaggatgctgtaggagagttcagacatgaagtcctgttcttaagcctcttattcaggaataactctgaatcatctctcccagggcgtggtaaggaggcacttccaggtcagccctccacaactgatccagcctctccgggtgtgaggaaagtcctggtgtctgtggtacgaccacagggattttcagacggggctcttctctggcgctctgtggaaatgagttctgtcctctccttcc

SEQ ID NO: 92460 - DNA, 1030 bp, Homo sapiens
ttagcagatattttctttatggcaaatatattttcaatatatagtagaatcaaatgttattctttaaaaatgtatatacttttaaaaatacacatgaacaataaactatatacatttagctatatatagtttattgttcatatgtttattttaaaaagattggaagggtatacattatgatgttacgtgtggttatccctgaatagttggaaaaggtgtggcttaaattttcttccttatcttttcttggcttttctaaatttgttataataaatgcgtttgtgtgtgtgtgtgtctcacatatataatagaaagtagggaaaatcctttaaagcattgtggagagatgcagcaaagaagtaaatattttctttgttaagtaaaattctaaataatgtaaaatagtgatagaaagaaagaactgtttttatatttgctgtattttttaccacgtgcagctttgttaggtagatttcagttttctctttattttttaggttgtatggctcgacactcaacatcgacctgtttccggcgctcgtggtggaggacctggtgcctggcagccggctgggccccaccctgatgtgtcttctcagcacacagttcaagcgcctgcgagatggggacaggtgagcacgtgcaccagaaaggggagcacgctcctaagccaccttcttagggactccagaggagaagagctgtcctggttgagactgagggaggcacgaggccctagtgtcttctgtgtgtccccggttgagaatgaggaaggcactgaggccctggtatcttctgtgcaccgccttgggcttacatgtccttgcagcctcaaaactcaaccacaccaggttcaatgatgcttttcccaccccttcatttataggaatatttctgttcctgtaaacctgttggacagtccatacagctaaaccactgtgggactttagaggagtttgggcttcgggcaagatctttgttttatctctagtctactgttattactttactttaatgtagtggaaaggca

SEQ ID NO: 92461 - DNA, 1066 bp, Homo sapiens
aggagttcaagaccagcctggccaagatggtgaaactccacctctactaaaaactacaaaaattagctgggcgtggtggcaggcgcctgtaatcccagctactcgggaggctgagcaggagaattgcttgaacctgggtggcagatattgcagtgagccgagatcacgctactgcactccagcctgagtgacagagaccccatctcaatcaaataataataaataaaaataaaataattgctcatcagtgttttcccattgtgattcttctcagtccttggattatgaatcagattcacaggtcactgtgtattaggagatgttattcccattcaaaaacattgttttaaaaagaagaaaaaccctttcttcttaagactgtcttcctgtatttgatggactctgcagttgactcctaagttacttaacgctgaagttaggacataccctgttaggatctgacctgtgccttctaggggaaagtgattttttacttgtaatttattgtaagttatgactaaatgaacatgatgtcctattaaatttaatatgttccagtattcatttaaataatgcgcttaaattactggcatttggaagtgtgtgcgcactccgttaatccagtgtaatttttttatcatggttttgctgaattaggactgatgtgaactgtctgtgttttttatgtgcttaaatatcctcctttgttcttgtccaaactgacacagattactctcccagatgattctctcttttgccaaacttatttcaaaacatttcaaaagagctagatgtggagcccagcgccaggtggaccgcggctgtgttgcatgctaggtccctggtaaagaagttaaggatgttacccacacactgagcccctcgtctctttatttatgttttcctgtctcagcccattgctgactaaggggaaatgaaacataaacatgagaaaagatgcatgaccatcagagaccatggggccaggaggacttcacagggcagaggggttgccttcggcagactgtagagattgtgtagttctcatctactttgtgtttcacgg

SEQ ID NO: 92462 - DNA, 1019 bp, Homo sapiens
ctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggtgagctgaagaggctgtgtgggatggctcgtgtacctaggcacctggaacacctgaactgtggtgtgtgtgttatttgtctctgtgtgtgagttttgttcgtgtcgtgcagaggtgagatgaaggtcaagtccatgaaggtcaagatgggaacctgcagcctcccgtggctgcgtggttgtggggagggggcagagccaggggtggatggacggtggagggcccttccaccggcctgttttgttccaagagaggagctttgctgagctgtggcacattttcagcttagagatgagctatacttttctggcagaggggttgactgcagggaaaaatacactgttcgcaccagaaaacaccaaaactgacactgtggctgttgggcagcttcgggttcctgctgttgtatcaggggcagagagagaggcagagcttggtgtctgcagatccgggcccttggggccaccagcccctaaggcttggcctgtagcatcttccat

SEQ ID NO: 92463 - DNA, 1120 bp, Homo sapiens
aaaggggctgtctcttgttttctttaaaggtgtccatagtgatacctgtgatcttgacaagcagaaatgggctggagaaactttagaaaaaagaagcagtgatggcttggaactctgtgagtatgtgcacacgtgaaagtgtgagtgtggctctgtaagcatgtttgcatgtgagtgtgtgcatgtgtgaatggaaaacatttaagcgtgcatgtgtgtgtgcgtgtgtgtagcttttcggcaggcatgacatgtgcctggaaaggaggagtgttgaggaaggtgaaggcctaggatgtatgaatatgtggaggaagcactttggcgaacacagagatctgagtgtgtctgaccccaggacgtggagtagctgttgcttggagcaggtgtcttgaaggcgaagactaggatctgaacttaggaagatctctttcatctgtggagtgatggcccaggctaccatgtttggaatttcttctgtagctagtgggcaaagacagaaggtctctgagcaagaaggtgacctagtcggagcctgtgccaggctcatgggagcgtgcgcttgctgtggggagggcgtgtggatgacctccaccaggcaggaggcccttctggaattgaaggccagtgccatggaaatcagtcccaggattctgccagagaaatggagaggagggcgcggcggctaggaacattttgaggtagcgtgaaaggaagtggcactcttttggacgttgagggaacagcatgaagcctcagtggaccgagatgtgcagtgacaggtgtcaggaaatgccctgctcggcagcctgtggagaccgatggtgtgcactcgtgtggaggtgtggtgactgtctcttacacggggcgtttaaagtgaggttggaacagtgtcagcctggactggtcaacgtgggtcgggctccatcggttaggggtctcccagaggagagctgctggttgaaaccatgagactgctaagtggggaggggagacagggcccagaaactggggctgtggagagaatacctgtgtttggggctggaggaggggaggagcagttttaccaaacaggaggtgagcaggtttccagcaggaagcgcttgttgcatggcgcaca

SEQ ID NO: 92464 - DNA, 1034 bp, Homo sapiens
agcgattgcgactgttgacagagctataaactcaacccgaacacatttgtttgacaggtatcgtggggctgtaaacacgctgaccctcaaatcactgagctttagggtgaaggtgggagtgattaaagaatgcatgcagttctaatatatgaattttgatttgattatctgatgatcaaaatgtttaatttaaaaatcatgaacaacatgggcatctgagttttctgggggttgaaataacagaaggatgtgtgcttttcaaatagaatttggctatgatccacaaccaaaacattctttgaaaatttcaactcattcctttggcttatgactaaatgatttggcaaaaacaaatagtttaaaagtcattagtgtatttgttcacgttgctgattccaaagcagtttttctgcatcttatgtgaaatgcaatatctgtgattttctctattgacttaattaattatttgtttttagtgtcttccggtttttgtctgtttgttttgtttttgttttgttgcctcccacttcggatgaggaaggtatagtacattatgttgtagaaagtagccgtagaaatattaatagcaatgattatattttggggtactatgaattttatcttcagtaatttgtttcattcttcctttcttccccctaaactctggttagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctagggaagagttccagcattttctttcccactgtgcttatgaactgtgaaattatttccttaaactgtgattcctcttgagccctacagccctgtcgctctcactttggtttaataggaatctctggg

SEQ ID NO: 92465 - DNA, 1087 bp, Homo sapiens
agaatgcgggggtgggattcctgaacggctccccagatcccagcactcagccacgctcctgctctttcagaggaggaagctcccctctgtttccttctccgagagtcgggctctccccagagcttgttatcctctgtgggccctgcggcacagcatatgcctgagactgccccaccatcggtgagggactgggggctggaggacatggcagccagcccatcctggaccctgcggctgtctgtctctgagcagggaagacactggctatgctttgctctccttgccctgagaggcggggaggcgggcggatcttccctgggatctttcaggctcccctgccctgtgcagaggctgctgggaggcagagaaagggcccattctgaaactgactgtgagctcccagcatccctgagtgggcctgatggagggcaggggattttgttcttctgaagttttttgatgtaattgactcgttctcctggattctctacatctgccttccagtcaccccagtgtttgccagcattcccagcgacacaacagtggaggtgggcgccaatgtgcagctcccgtgcagctcccagggcgagcccgagccagccatcacctggaacaaggtaggcggtctggtgcccgagccagccaccacccagatacaaggtagacgggctggcacccacaccacccactacctggagcaaggtaggcggaccagtgcccacgccccagcctcccctctgctgtggggtatgatgggctggacagctgctgcctgcccacttcctctatagactttctgtagcagaaagaaaaacattcagatcttaagccttgaggtaaaaatactcagggcatccttactaataagaacaaaacaaacttggagcattccatttttttgatcttttcaataacaaaagcaaagaaaaaccctcttatagaactatggtctcatcatcaataaggaagggttttcatcgttatttcatttctttgctgtttttattaagctcagtaggaaaatgtgggtagcactcacacaccatgacccgtgtttctgtgaattccctcccgggagcacagggct

SEQ ID NO: 92466 - DNA, 1073 bp, Homo sapiens
aaaatggaatcataccagacaatactattctgtaagttatgtttttcatccagtgataataaccactatcatcatacacagctataccagatggcattttttaagcatttgcaaatattagtttagggtgaggattgagaggaatcgttgtaagtcggcctggtgtccacgagctgcagtgtgtcctcatccgtgccccgtgtgcattgcagctggcggtgtggttgaacggtctttgtgtgctttccagggtgatgctgagaacacacccatccttcatcttctttccgttctgctcccatcttctcctgtgccctctgcctctttctgactcttcgttgtagacattgctcctaatggtcagacgtctgccaagactgtggtcattttcttggtcgcgtttttaccccaggctgttttttacatgtcctgttttgaatgctttctctccggaagctcttcctcagttcactgtgacgcctcaggacagagtcgttattgagggccagaccgtggatttccagtgtgaagccaagggcaacccgccgcccgtcatcgcctggaccaagggaggtaagacccaggccggccctttgcctgctccctccgcggccacagacgcaggaagcacacatttccactgtgcccaggcaaccccagcgtgttctggacagggctgagctgggactggattccacaggaccaaggcactgggaagcgcagaggtgtctgcacatcccccgcggcttcctgtccatgcatggccgtccctcatggacatcatggcaggaaactctgagaagctctgtcattgcggaagagacttggggttcctgcctttgactccctcacacctgccttgtttcagatagtctctaggatgtgcttttaagtagcctcttgaaggaatctatttgcatggaggatagaattttctggaaacagtcgaggaatatattgaaacagacgaatagcttttgctctgactttgcttcccagagccctcactgtcacctccccattcggcatcatgacctttcatcacattctttgcctacagtcctagccctctt

SEQ ID NO: 92467 - DNA, 1044 bp, Homo sapiens
tgcccgtgatgatgggcgttgagtgacagtggtggttttgtggctgtggttttcatgttactgatttctgtgagtggctcccacctggtctccttcacaaacttccctgacctgtgccgctggcacactccctcgccttgagctcgacacccgatgcctgggtgtgcacaagccctatgctactcacgcctctacggttagtgccttgaggggcactgtgcacccctgggctcttcctggtgatgtgtgtgtctcgacatcactccctgagtcgggcaccggggctcagattccaccacgagacgtgtcccatccccatgtcgcaagcctggcaggcctggcacatgtttcccgacgcgggacctggaagccctgtctgatggatggatggacaagcccagccaccccatgtctcaccggctgcatcttccttcccacaggcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtggtgagtggcccgacacgcacacaccatccacacactcacaccatctacacacacaccatccacacacacaccatctacacacacaacatccacacaccacacacacacatttacacacacaccatttatagacacacgcgcagacacaaaccacacacacgcacatacacgcatacaccatccacacacacacataccatttacacacacaccatttacagacacacacgtagacacaaaccacacacacgcacatacacacacacaccatccacacacacaccatttacacacacaccatttatagacacacacatgcagacacaaaccacacacacgcacatacacacacacaccatccacacacacaccatttacacacacaccatttacacacaccatttatagacacacacatgcagatacaaaccaca

SEQ ID NO: 92468 - DNA, 1055 bp, Homo sapiens
ggtcttgaaggatatctttgtatctgataatatactctgtgtcaaagtatatgatgatgcccctgccaaatttatacacgagttaaaagatttgagggaaggtattcacctatttatgtatgtgctatcattaaagttatccttttgatttttgcttttttccatatattttggaagtgaaaatggccgagtcaggccaggccagcactgcccttctcacgcggtgtcaaggacctcagtgagcacctctaggcctccctcgcccttatccagtcactagggtggacatctgtgcctagtgttcagttgtatttattgaatcatttgataattttatgtattgttcatacaatgtaggaagtctagtgagtgagctatctattgatatctgaatttgaaatgactaggaaaaaaatttgggcaaaaatctggatctaagaaaataaattgtaagttatacttttttttcttttaactcctctagatacctgcactttaatcagatagaaactttggacccagattcgttccagcatctcccgaagctcgagaggctgtgagttgtgtgttgttccttgcctttccattcacagagcccaagcctcagtcactggcttggttagattaaggtcaatatctaccaaacacctgaaaactgtttcaatataaaatccatatttctagtctaacaatttggaaataggacttataattttctctttaattgagagtgttgataaaacaggaaaaaaaaaccatttcttttgttttcagattcatttgtattaaataaatgtaatcactgagatttttttaaagctgatatatatttgactgcttatattcttttctacacattttaagaaatatttttcaaaattggtttgttataaaatctctttcaacagatttttgcataacaaccggattacacatttagttccagggacatttaatcacttggaatctatgaagagattgtgagtataaaaccttttgtgttttctttgctgcaaagccttctttctctctgttatctattcacctggttcttt

SEQ ID NO: 92469 - DNA, 1409 bp, Homo sapiens
tccaacaagcgtttcactcagtgggggcgagcaaatcttcatagcaaacagttcttccatcctgagtggatcggaaaatcctcatctggctttgtgctgggtgagtccagtgttatttttaaggaaggaaagggcaagtcaggggagaaacgaggctgaatgaggaagggcatctgtgaatcaccaagtagatgtttgctgaaattttggatgatggggagggcttcttgagctggccaggctgcctttagcacccagggttaggtgagctggggtctctggtgctgcagcttgggttccattcgttaaacgctgtacagtgagcctgagggcagcccgagccccgccctcgggcagggagctgttggggaggggataagcgagtccaccagacctcagtgagagacttgggcaaagggctgtatgtccagggagggtggcttgtgcctgaccctggcgaactgcaccccttccccggatcggctctacagcccagagctattgaaaacatgcattcctggtgacactgggagaccggaatgcaggaatgcccgggagcccggatgcagtccagggggatctgagtgtccctgatccagaaagaaggctctttgggaagctgtggacacaggtcagaaaacacacctggccagtcaggaaacatgcgtttgaattcaatgatgacctcagtatacttggggagccatttcctgtctttggtcctgtttcctcaattgttcagggaggggtggaggacaccccaggctgcctggggccccagcctctctaagatcctgtgcaccctgggccgtcatttcccgtagcacctgtgcagcaggtgccaagtcccacccactcagccgtccccctggccaacctgcattgcagtctgggtggagggatttttacacccatcgctctccgtggggcttgaaataccccctttccttccctcggtcagtacctcctcatccttctgggctttgcttgggggactccacccctgcctgcctgcactgaagcctcgctgagcagctcacagccactgtgccgtggtggtgcctgggtcttacatcggtccccagctgccatgggctgtgaaaggccaaggaccccagaaaaccacaggcgccctgtcagcacactgcctggcagagacgaggctccagggattctgtcgggttcggccttcctcgggacccgcgcgtcaggtgcccgcccgtcatgctcgcccacggcggttttccttgtcttcctgctccagtttttccttccctcacgtttcccattcgtgcgcggagtgctgagcacagacctgtcccggggcaaggggcagggatggtctgcgtttgggggccctccggctgcaggtgtccgcagagactcagtgtggcctgtgtgggtgctgc

SEQ ID NO: 92470 - DNA, 1050 bp, Homo sapiens
tctgttgcttctgttttctaagaatgggattctaggggtgagttattcaaggtgcattcggtcttcatattgtccactccccaaattatttctaggtattttggagatgtatcagtatcagttatagaatcttacagccaatgcattatacatgcctgtggaaaatggtttttatcttcttcaggctttgaagcaaatgtattgtcagcaattcattagccatagtctaaggtctgtgagttgcctgaaaaacccgtcgcagtggtttgatcaccttcagttggcaccggttgcttttagcccccttgagatctgagggaagggaagcccttgggagaggcactgtactcaccgtgcagatggtttgtttgcattctaatacagtcattaattgtaaaactgtctccatgtgtcaatttaattcttcttttccgtctgaagtttgacctcctgtctgtgtgctaatgctccccaatgtttcttgtttcagctatctgtacaagaatgagatccagtcaattgacaggcaagcatttaagggacttgcctctctagagcaactgtaagtgccccttctcttcgtgctttagttcttggatgccgtctggctgttttcctcttgtagggaccagtggagtgagctagctgtttgcatgatgcatgactatgctacctgaggtgcggggagtacgtgcatgatgacggaaaaacagggatgggcgagtcatttgccctccgccccgccttccacccagccagccctccacccacccctcaggacgtatccctggtttccttacggcggcaccaggccctgggccatgctttcctgacaccaaggacagtaatatcgatggaatccctgtcacaacttagaggagagacaggcaggcgcccaagtccgatcaaggcatccttcacaggggaaatatccagggtgcccggggaggagagggctctttgcctcgttcactgttcctccttatgactgtgaacacatgaagctgaatttcttcaattgtggtgacattattttggagaaaacctttc

SEQ ID NO: 92471 - DNA, 1081 bp, Homo sapiens
aaattggaaaggtgacgaagtgtgtgtcgtgtgcttttagaagagtattcttttaagacttagtcactttccaaagagagctatttttaataaaaattatttcagccatttttgttggaaatttttatcatatgtgaacctaaacatgtttaagttattttgatttttttttattttactttaagttctgggatacctgtgcagaacgtgcaggtttgttacataggggtacacgtgccatggtgctttgctgcacccatcaacccgtcatctaggttttacactccacatgcattaggtatttgtgctaatgctgtagttattttgatttttaaaacaaagtcgtcttgttattgttgatgtatactctgaaatctgttttgattctagctgtgtctgtgactgttaattacagagctacctttaactctgtttattaaaatatattccctctgtgcgatatttgtcagtgttacatacatcctttttccctccatcattgtggcataggatgttaatttttaatttcatataaacatgatgaagcctggtcccacatttctatttctaaaatgagaggcaggccttttatttgtttatttaccctttttttttttttttttttttttggtattttgaatgttgtgcaagttccagaagagggcttttgtttcctggaaagtagatccagtcagctgatagccagcattccttgtgtgtgtatatgtgtgtttaataggtttaacaggttttttaatattttatttcattttttgtcactggttttgaattattaagagcaacttagtatgcactcagcaaacacgttcaaagtggagttgttggggatgctctgttttcactgatctcttttcaataaccctcttccgacctcatctgctgcacagccggctctgagcgcccacactccaaactcttccctctctccctcggtaacaaactgcggtgtccctggtggtggaggacacagatcactggggtggaagaagcacaggccagtggtgaaggggccgtgggtcatgactcagaaacggactaaagaccagggcagtggagggaa

SEQ ID NO: 92472 - DNA, 1225 bp, Homo sapiens
ttaaaatatttttatgcaagttacacatgttcatgttagaaaaatttaaaaataaacaggaacaaagtgaaacaaattactcacattgctgtcattcaggagaaacattagctgggctttgttctcagatgcacacacacagaagcattcaggcgtgtgtagtacgtagcagtatttgtctacctgttaatatttatctgtcatgtatctattttcaaaaattgggtcatgatacatgttctgctctataatgcactttgtatggttttaaaatctgggaatatattatgattgtgtgtctgttcaataattagaggcctccatcatcattgttaatgaccacacagtatttgtttgaaatgaccaaatctgcctaacagaatttttattatgggtcatttctttgtttctacttttctgctcctgcaaacaatatttccaaaatgtgattgcatgcatttttgtgtgtgtctgtctagattgtttttacggcacatttctagagaaatctttttttaaaaaaaatttcagtagatttttggggaacaggtggtgtttggttacatgaataagttcttcagtggtgaatcctgagatttgggtgcacccatcacccgagtggtgtacactgtatccaacgtgtagacttttatccctcacccccctcccccaccctgctgtaggaacattctgggaggttttgatctgcaccagggatggtggttggcctacggtgggctttccctgttgtgttttcttcctggcccctgttcatattatcctgcggatggatgttctctgtagctgagcagtggtgactgacttactacaggactaatatagaatgcaccttcgttggggagcctgtaatgggtcaggagggagggctgaagggagggtcaggggctgaaggcaccgtctctgaccccgggatggtggaaatacagcctgtgtaagtgctcatgtttctttgctgagtgactgcattttgattcttacaatttgttttttctgcaaatggtttgattttcggtatgccctgagagccaaaccatctagcgtttgtgcctgtcatgtatgtttatttgccagctctgtctttatcccaggttctgacagttcgcaccgtgtggcttgtctgtgtcttgtttgatctctgcctcacagtcagctgttcttaccagacccatagtcacaccgggccccgcactgggaggagctcaca

SEQ ID NO: 92473 - DNA, 1048 bp, Homo sapiens
tataatcccatcttgttctaaagcagacatctctgaattcttctgcaagcaggtgtggtaaaataaataacatcataaaataatgaccacattcacattcccaagctcatatttaagaaaagatgaaaatgactcaatcctggtgttctccatctgtctttggaatgctgttgccttagtcagggccattcggctttagttggtgtcctgaacaatggcagaacctcagtgccttaaaacagtgtgagttcctgccccactcacacaaaaccccgtgcaaatgttcttggctgggcagctcttcactggaggctcagctctaagccttgggatagctgcgtgttttgtgcctgagctctgtgggatgtgtcaggccgatctgtctccatttcgtctgtggctgcccacttctggcagaggcagaggtgagtagttgtcacaagccaagctgtttagtctggcttggtaagaacatgtttgctctgacattgacccaaggatcccagctgtgccccgcctgaagctccaccatcatccatccctggcctcgaagctgtcacggaaggggagagaggaggttatgtgaaggctctctgctcccacctgctcggagctgatgcgctgtttctgctcccagcgcactggagagacagcacacgtctcaacccagatgcaagggtgctgggatgcggaggtcagctgcctgtccaggaagcccagatgcaagggtgctgggatgcggaggtcagctgcatgtccaggaagtggaagtggaccgtgagcttctcagtttttgccatagctgtcccaaagtttaatagcacacaattattgctcgctctcttaaaacttcctctcactagttcatgtgtgtgtgtgtgtgtgtgtgtgtgtgcgcgcgcgctctcaacagtgttctgttggcaaggatggagcagctctgcctgcttatcacttttcagagaggtctgtgatgttgatattccctttgcttgcttctgtgttctgggacttacagtgattttaccacctcccaacccagcttcta

SEQ ID NO: 92474 - DNA, 1091 bp, Homo sapiens
cctagagccttgtctcacagagcccctgttcccacagcattaaagtggagatgacagagtccctcctggagagccggtctagccattcagtgagtcagcagcacagctcctccagcacgcagagaacagcggtccatggagggagggcgtgagcctggggttttactgaggaaggatgtaagtctgggtttaactaagagagggcgtgagcctgggcttcgctgagggagggcatgagcctggggttccctgagggagggtatgagcctggggttccctgagggagggcctgagcctgggcttcactgagggagggcgtgagcctggggttatactgaggaaggatgtgagtctggggttaactaagagagggcgtgagcctgggcttcgctaagggagggcgtgagcctggggttccctgagggagggcctgagcctgggcttcactgagggagggcgtgaacctggggttatactgagtgagggtgtgagtctggggttcactgagtgagggtgtgagtctggggtcttagtgagggtgtgatcctaggggttcactgaaggagggtgtgaacctggggttatactaaggaagggtgtgagtctgggtttcactgagggagggcgtgagtctggggttcactgagggagggtgtgatcctgtggttcactgagtgagtgtgtgagtctgggattcactgatggagggtgtgagtctggggttcactgagggagggcatgagtctggggttcactgagggagggtgtgagtcgggttcactgagggagggtgtgagcctggggttcactgagggagggtgtgagtctgggattcactgatgaaggatgtgaccctggggtccactgagtgagggtgtgagtctggggttatactgagtgagggtgtgatcctggggttcactgagggagggtgtgagtctggggttcactgagggagggtgtgagcctggggttcactaagggagggtgtgagcctggggtccacggagggagggtatgatcctggggttcactgagtgggggtgtgagcctggggttcactgagggagggtgtgagtctggggttcact

SEQ ID NO: 92475 - DNA, 1019 bp, Homo sapiens
tccagttctctgccctcatgttcacatggtgctgtttatgtatgtctgtatccaaatttccctcttcttgtaatgacatcagtcatattggattaagcatccactcttttccagtctgacctcatcttaatttaactaattacacctacaaagactttatttccaaatacagttaccttcacaggtaccaggggttaggactttaacatgtctttttagaggacacagttaaacttaccgtaaagcataatagcaacatctcaaacttggacctctgctgagttagagatgtcactctaggggcagtatgcagagaattttggagggaaaaagtgtcctgggaacaggtgtgtgaattaggatgctgttaaaatggttacagaaagagattacattctgaaccagagtgaggttggggtagattattttgtctctatttaaaattttgtatctggaaattcaaaggcgttttcaaaaatgtatttccctcctccccttcggtgccaggtgtctgagctttgcaaacatggattttcttgcagctcttctgcgtgttgttggaggccaagctcatcaaactgcccatagtggggactgagcagctgtgcatcgggctgctgagagctgagtttgtttatgtaaatgttgttttattttagtctttccaacgactgccatggggcctaattctcagccaagggctaggaggaaggcctttattgtttagatgtaggcatttgggataatgtgggaagcaaactccaccatgtaatacgtgagcccttcctgggcagctctcctcatccagtgcttcatggagaagcaagactgttgccgccttgggagaggctgcggtctcattgtgagtcaagcataatttttcctttttaatttccacagctttatttagctttggaaacattccttttcaatatattatgttattctggtatatatttccttcctttataataaagctgtggaaattattctaagcatagcctacaacaaagaaaaaa

SEQ ID NO: 92476 - DNA, 1075 bp, Homo sapiens
gggacacccgaaatgtcaccgaacccgtgaagaccctggaggagcactcccactggtagggccgctcctggctgcttcagggaggaggggattacgcaattgattttgctaattactttaccattgggaaagacacaaaccagcttagtttgtgctgctgtgaatcattcaatcaacccagttttatttttcctaaagaaacactaattccaaatctgaatgtttgtgatttataaacgtaggaaaagaagaaaaacattaaattctgttttctcttgaaacagtgctggttcaagtatacaaaaataaatgtgcacagatgttcacgcaacattatttgtaatgccagaaacctggaaaccacccaaatgtccatcactaggggactggttaagtaaattaggtgacatccgtgcagtggagatgatgcagctgtcgggagaatgtggagcatctctatgtggctgtgggaagatctctgaggtcactcattctccctaacatattatttgaatgtttttcatgtgctgggtactttttgctaagtaagtaaaaagatcaagttgtacaatggcatgtatagcatgaatccatttttatgcaaataaaacgtgtgtgcacacacgggtgtacacaagtgtgagtgacacaggtatgtggaggaaatgtctgaaagagtaagagccaaaatctcatcaggaatcctccccaagtcaaagaggggcattcactccctatggcctgcatctctgtattgtttgaattacttatctgaagctgtatgttaaaaccccggattggtagtgcacacttctgataaattcagtgacttgctggaatttcctgtggtctgagtggctgggcctccctgtgcccctggccatgctgggtgcacctcctagcgtcaagggcctggcactgtctgccacctgggccctggagcttgttttggcctcagcatgacgggaggcagaagctcccaggctctaggacccacgccagcaagaaagctgatcccagtagccaaaaccaaggacagcccttgtgccccgggaggccgccatgccctggtctc

SEQ ID NO: 92477 - DNA, 1056 bp, Homo sapiens
ttaaaagtttaggtattatattttagggaagaaatattaagatattgcaaaggtgcaggatataaaaaccagaagatttaaaagtggtttagggccgggagttctaatgtgagagaaaaagatgaaaggaattgagttcctctactttggagagcagagaacaatgatggtcttcagataaaggaagcaaattacaaggcacagaagtttcccattgctcatcagccccattgaggcctgcggtgaggaaggtaaatgatgcaggagtgatttcagtcccgcccacggcagtgctggggaggccgtgcaggtaggagctgctgggcagcgccaggccatgggttctttgctctcctgggcgcagccttttgttccaagccactgtccagcctcactggatgacctgccctctgggattcatgacatcagggccataggcaggatattatgacttcagaccctgcgaggagcagccaaggaccataggatccagggcaaagtgagatgtgtgagtgcgtgtgtgcgtgtctgccctctcatgcatagatgtgtgcatgtgtgtgtacatacatgtgtgggcgtgcacacagatgcacgcgtgagtgtgagaacgcacgcactgtgaacagccgtgtgactcatttcaaacagtccccttctcccaccctggagcgagtgggttgcactggccaccagcagtgttggacctggagctggtgtggacagtggaatggcaagcccagctggcatggtccttcctgctttcatggccttccccactgctcctccctttctctctctctctctgtatatatctatagatagatagatagccggccccttcctgcttccatggccttccccactgcccccccctttctctctctctctgtatatatatagttctatatatagatagatattttgtgttgtatgtgtatgtatgtatatatatataaaatttcccaacactatattctacctcaactccctgtctttttcttttccttcttcactgtgtccttccagaaatgtgtcaggcatcctgtccaaatg

SEQ ID NO: 92478 - DNA, 1655 bp, Homo sapiens
gttgatcagctgcaaggctaattggtagttggttgatggcttaattaattaacttactctttcaaaaatctagacgagtccttaagctgaaggttaggatgtgttttatcccgtgggttttggacgcaagcggtgctccattttgctgactgaacttctgcaaggagcacttacggagttagaagttgaagtgcaagagcttgggatggcagaatagctctgttgggggctcagcttgcattgctcggctcaagatttcgggccttccccttctggaatggccctgtggtgtttcgcacacacgagtcatcaagaacttgtccaggccactctgccgaatttgcattaccttctaaaggtgtgaccttgtgtttctgtcttctaaagagtttcataatgaaccaatatagttagtagaaagttaactggaacacagtatcgattagttagaaacaatatccagccttttcattatatctgctagttggtcttttttactgtattcattgtcatcaatggataatcattaacctgataagtaggtcttcagaaagctgaaatagtacctgtaaaaaatttcacttgacttttttctgtttacctaaagggaatactacaaaggtatttcttcattcatattgtccatgtggaagttaagacattgaacctaggccgggtgcggtggctcacgcctgtaatcccagcactttgggaggccgaggcggacggatcacaaggtcagaagatcgagaccatcctggctaacatggtgaaaccccgtctctactaaaaatacaaaaaattagccgggcgtggtggcgggcgcctgtagtcccagctactcgggaggctgaggcaggagaatggcgtgaaccccgggaattggagcttgcagtgagccgagatcgcgccactgcactccagcctgggtggcagagtgagactccgtctcaaaaaataaataaataataaaaaataaaataaaataaaaagacattgaacctaactaactgtaagttgccaaagttaaagccaaaaattagctcaccctgtgtttctgaaataatgtgtacactcgaatcattgctagtttttgacgtaatgttgctaccaattcttctctttaggaaactgtattccatcattgctgttggcaatgtttattttgacctactccccaactggcttttactaaaggttttcttgtggcttagcgtttagggtcgtgaattttccagctctgttttcttcctcggtagctttgcaagggggaccctctccttggctcctgtgtgtcaccctgcacactatatggttccttggagcttgctgtgggagccacgctctccctccctgcagtgcctgtgcccccgctctgtgtctgggtccatgctgagtgtatctgggagcccgcctcccgcaccagctggaaaagctgcacccttgccgcaaacgtaatgagaaggaagagatgctgtaaaatctgatggagtgaaataggaaggtgggaggcgcctctgattttatgcgcagagcactcccctcttttgttaacatcccccctccgccatggttgattgttcctggcgagtgcctggcccggctgtgccagtctacctccttctccaggaatttggggtgaggtctaagggttg

SEQ ID NO: 92479 - DNA, 1072 bp, Homo sapiens
agtgtcagtccctgaggatgggatgggaacgggctcagggtgggatggtcatggccgttttgtaagccagcccctcccgcttgccgtgcagcccagggtgcacaacctgggacacgcctgcaccaggtgcttcatacgtcctgcgccctagacaccacagccttgctgtttcttcaccctgctgttctctgtccaaggtgagagggtggtgcgtgcttccctctgctggtcctccattttccttggtattggtcagcgtgcatgtagtagggtctgctgtgagtgcggcctgcaagtagtagggtctgctgggagcacagtcctacatgtagtagggtctgctgtgagcacggcctacacgtagtagggtctgctgggagtgcgcctgcatgtagtagggtctgctgtgagcgcagtgctgtgttctctgtagttttcctgtcctccaaatcaagccacccttgtcagctctgtggctcttgatggcaggaaatacagctttttgtctctcaaaatcttccgctgagactcttcttagatatgctccacatgaactgctaaagacgatgccaggcacgtcattttgctcgttaggaggtgtattcttttgttcacattctggcattagtaacatctcccttgaaagttttgtgggcgcctttaatcattccttttggaccaggaagcactgaatattcttctttaatgtcgaaaaacagattactgcatgcattgcaccctgtggagttcttgctgagtgctgtctccatgtccccaggaaaccaaaaattgtgattgattaaccttacaacttacactgcaccgtctgccctgagtagaccctcagaaattgatggtgaaatatctttcaggcttttattaaaatttaccttccaggcttctctgcacctgtgagtgtgaagttttcagggcctgggagtacaggcgttagcatgaccaatggagtggagtcaggtgacagatcctgtttctgcctccagctggctgtggccacaggcagctcacccactctccctgggttctagttttcccagctgtgcagtaagggggg

SEQ ID NO: 92480 - DNA, 1074 bp, Homo sapiens
cttgataaacagactttttctaagtttattttttatgcatttaagaacgcgcaaaacatcctcacatactcagagggggcgggatgaattcttccctcctccttcgtcagcacacagtttactaaaggcctcttaggtgcctgtcacagcctgagctggctgcttgcatattcccatgagtgggaggtgtgagctcgttgctcatacagttgagagtctggccaggaacccgggtgccggtggtgatcaatgtgttgcatgtgtggggggagtgcaggctgccacgggaaaggaccagggaaagtcccagcgacctttgtggatcagtcaactccgtgggaggaagtggtgtttcgaccaaggcctgagaatgtgcaggccaagtgataggaagtaggccacatctctcttcgttgtcatctgcaaactacgcattttattgtaagctatgtgcccttccagcttcagtcctggtcctgtgaagaataatccatcttgccagtctcaggcttgggcagtttgtaggaccctgaggctcctgggctcagattcttctgaattgtctttcttgaccctttccctctttgccttgacatttatctcttaacaagaaagacacacaaaaccgtgattggttagggaaccgcccgtcactactctgcaaacatgtagccaccacccatggctgtgtttccagaaagccacgaagcttctgtttgtgtagttggtttcctagactcctagcaagatgatatctcgatctggtctctctgaaagcgaatccacgatgtcatcatgcacccatctacccaggtgacaggttttcagtctggcagtcattcttcagggccctccacgcccaggcctccctcccacagactcagttggtaccgaggctcaagtgccatgtgaccttccttcatttccctgtgctctttgcagacttcatcacagccttacaatgttccctgtgatcttcagaacccaagaagcatttcttgaaagctttacctgtgagaactcgaagccagttattttctaaagcaaatcaatattacctcctgtagtctttaa

SEQ ID NO: 92481 - DNA, 1496 bp, Homo sapiens
ttttgagacggggtctggctttgtcactcaggctggagtgcagtggtgtgatcacggctcaaccacagcctcggccttccaggctcacgtgatcctcccatctcaacctcctgcaaagctgggaccataggcatgtaccaccatgcctggctaatttttaaattttatgtagagatgaggtcttaatttctaaattttaggcagagatgaggtctccctacattgctcaggctagtctcaaactgctgggcgcaagcagtcctcccacttcggcctcccaaacactgagattacaggtgtgagccaccgcacctggcccagattcttgtaagaaagatttacatcagtgctggttggctttagccagcctagatgcgcttaggtgtgaagtgcctcacactggcatgctttcctggttactggctcctgagcagagttgtctattagctttccaaaggagctcagaatgatgcctaacatcccttagtttgtgcaggaaaagaacaacttgtgttattacaggagaatagaaaaatgtcttctttcaagtttgtttaaagtctccatttaaaatggggaatgaggctgggcatggtggcttatgcctataatctcaacattttgggaggccaaggcgggtggatcacctgaggttaggagtttgaaaccaccctggccagcatggcaaaatcctgtccctactaaaaatacaaaaattagctgggcacggtgatggctgcctgtaatcccatgtactcaggaggctgaggcaggagaatcacttgaactcaggaggtggaggttgcagtgatcccagatcgctccactgcactccagcctgggtgacagagcaagaccccatctcaaaaatacaatacaatgcaatgcaacgcaacgcaacgcaacggtaaagtaaaataaagtaaaataaataaaataaaataaaataaggaatggttatcagagtctcccttgccccatataaatgttattaaaattaattattagaaaggagatgatgagaaaatactttagtaaaatgcaaagtacaggcgcaacttattctaggaagagtcataatacaaaaatctaaatatacagtgcagaaaatatagataattacttatattgcaagagaaattcctatctcccctaggattttagttcaatttccattaaataatgtggttcaaaagtatgtttttgttgatccttttatgaagcaaatgggtgttttaggtaaagagaggcagatcggtgtgtccaggcgaatggctcagaaaacgccttagtccatttgggctgctttagcacaatcccataaaccaggtagcttccagacagcagaaattcattgttataagttctggaggttgggaagtccacgatcaaggcgctggctaagttggtgtctggtgaggcccctcttcgtggttcacagatggctcctttttgctgtgtcctctagtggtggaagggaagaaggagctccctca

SEQ ID NO: 92482 - DNA, 1078 bp, Homo sapiens
gcttttctaggtactctagattcctggagcatcttgaaaatagagtatcaagactcagggagaccgagcagccaccagcaggatcgtgtaaggatggcactctcatttctaggagaagaggctgtattgatggtgacatgaccaggctgggctgccacctgctgcccaccagggctccaggcctcagcatgcgatgcctctgaatggcattaccttccggtcccagatactcatcactttaggtaaactgaggcagaataacatgcgtgacaggatttccgaatggaatatcgctcagtgtgcctaatagtcatttaaggtgatctcatacagctatggagagaaaacccgtttaatgccaaccttagacaccagctgcgtgcgtggtgattatatctttagtcccccattttgctcccttttttgaagaactattgaagaagaacggaaggaaatcgattttgaggaaattaaattttcttttgaaacagcatgatggtttttaaaacaaagagaaagtggggaacaggatgctgattacgaaccgtgccgggttctgcctgccgactcaggctgtgcttctccctgctccgtctttgctgcctgcaatcgtacatattttaaagagcagatgcgcgctgcttatggatttgtgtaaatgtgcgtgtgctgtctgcagaatgcggggcacaccgtgctctgttgacattatccattatgctctgttgctcagcttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctggtaggattttgcatatttcatgcgcccagaacgagcctgcaggttggccaggtgcaggagcttgtgcagattcctttgcaggagccaccgtccacacctcggaaacgctcctttcttttaaaaagctgcgagaatttgatttttaattttagtccctgtgttttctagattagccgcattgacagaaa

SEQ ID NO: 92483 - DNA, 1037 bp, Homo sapiens
cttgtgcccactgtgtctctggagctcacggccagcgagcccctgacacctccacttctcagcacccccttcctgttggggcagcagcctgttgtgatgctggcaccacctcctgctgcctcctggccagcagagcttgtcagaggcgcgggtgcccctcaccagtgcctggaggataagagagttggtgtcatccttgtcttgctcatcagccttgccgccttctgcaatcagtctctgcccctgcacactcaggcgatgcaatctgtacatggtgccatccctaaggcatttaaaaggccatcgaggaaggtatttttaggcccagatcttcagacatcctgttgtgcaccccgaggcgtacctgcatcaggtgagcgcccagtgaggctgtcatttgtcctcatccatcctgctcagctcctgccagactcagagatggctgcgggctctaaaaatagtcccatcttaaggtactgcttatgcagccctggaaacctcctcctcctccagctggggatcagattatgtcccccaggcagggcattgttcgccctttagccgggctgactggagctactattcatgctcacaaaggctctgatctcctttgaattcctgtaagccttttgcctggtaatcccttccagcaggcagcacacccgtggctgcagttggcagtcgcgaatatgcctccctcccttcattttgccctgattatctctttatctcattaagggccttgagctcttgtgttaacatgtgaaaagtaggtagtggcttcaaattggctttgaagatgcaacttggaattttctctttcaaagcagggggctgttatgggagtcaggaggctccattcattctggacatcagcgctaatgagctgtttgaacttggaaaagtcagtggcttcactgggcctcagtttcctcatttgtgaaatgaaggggctgtgttcattcagcatgatatcggagttccctttcagcctaggtatcgtgtggttctctgacttctgtcggcacagacacagt

SEQ ID NO: 92484 - DNA, 1039 bp, Homo sapiens
agggcttagccaggagctgtggcagggcccatcagagggcattgtgtggttctgtgagcgaccgtggcagctggaactgcggcactcaccctggaggccgtgacaaagggtgtagtggtcgtgatgagaggcgtggatcaaggtggggccagtatcttgtggcctgagcaagcatgtagcactgatgctgtctgttgagacgggaagccccgggaaggataaggctgggggccgctggcgttcagctttggacactaagtgtgaattgcgtatcatgtgtctactcgtctgctgaagctggtggctgtgggagcctgcgtcggggagatgagcatgggaaatgtgaattgggtgctgttgacacaccctacgggattcaaagccctggggctcattttagacatggtgcacatagggagacaggatcacggatggctctgggcatgcctcgtttacaagctgggagggagaccgagggaaccagcacagaagcggaaggccaggaggctggtgcagagtggggagcagggcatggctcccaggatcccgtggtccctcagttcggttttgggtctgccattgcccttctcccacagaggacgagactgttccttctgtcatttttgtaggcatttgagatccaacaacatactctgggtccctgggtcacacgccccatcctctgtctggacagagagaaaaccctgagctcggcgttctttgttttaaaactataatttggaggatcacccagagagaagagagagacagcgaaatgattgagaagaaagagacaggaagagcgagccctgagaggtccaggaagcaggcggcaaagaggtttgccaattaatacagaaacaaatcctcgcttgtctcccctctcccctgaaaccggtggggagatattaatagagcagttctgttgcctaggaagaaagcaaatgggcaattaaaactccagaaagctgagcagtgcgtgagcgtcatggatttgaaagcctgcattttaattgcgggagatacggccgtgcaggca

SEQ ID NO: 92485 - DNA, 1105 bp, Homo sapiens
gggcctgtagggctcacggtcttttttgtacgagtatcttatgaaggggcacttgaagatgataaaccattaacataaatgatgggtcagccacttaatggactgggtcccagtctggccgcgcagtcacctgaggacttagggaaagttccagtgctgcaggcctcaccttgacccagaatatttcccaacagggccccagatgttagtaggttcattcctgagtgatgttagcatggagccagaatggaaaactcttcaaccttcctcacagagcagagcatgtgtggcaggagggttcagtggacataggctgccatgtggccccgtggcgagcacgtgtgcatggtgcccctggagtggatggcccagcggggcccctgacggccacaggaccaggacacagacaggcttggggctgacagcatccagctgtgccacctgctgtgacattgccatggtcatgcgaaggtgaccaacttacctttacataacattgtgtttctccaagaaaatcaggaaaacggcactaaggttgatatttgagaactttggtttgctctttataaagtgataacaataccatgatataaaaaggtaataacttccacgtctattatacagattaaatgagagaaaggatggaaagggcctgggtgagtttcttagccacactccctcacggcatcaccccagagaccacttgaatgtgttccctactcaagacaaatggatgcagattgaatttaaaaaccaattttttaggaggtatgctttatgtttagataaaactatcttttaaattatgacgtttttatgatataattttgatctatatcataatgtatttaacaactaaccatctctcttagactccttttgaaagcagatagttatgagttctaagtgttcagcacccagcatagtctaatatatggatttgggtacactgcagaactgtgcatgcagcccgctacgtgggttggggtacacggcagaactgtgcgtgcagcccgctacgtggattcgggtacacggcagaaccatgtactcttcatataggatgatagcccactttgtgctgatgtgtgtcctaattacaaca

SEQ ID NO: 92486 - DNA, 1174 bp, Homo sapiens
gcttgcatcctgaagctgaggcactgacgagaaggagagggggcgggcctgtgtaaaggcatttagatagacctgtgctggaaagaccagaagccagccattcatatgtaatcactgtctaggtacaaaggagagtacatgtgttacaggggaaactgtcgttttaatggaccaaatagaattttggagttttgacatcttaaaactagttttccataatataggacattcattttgcaattgtgaaaactgggaggttaaaagtcttgtttgggatttcacagggttgaattatatgaaattgctgaaatttgaccctttttgacctataagaatggcagtttcatatggttcaaactattgatttagtgatccagccacagctgtctgcactggagtttgcgctttgccaggccaggctgcatacctcactggggaatcttagggtccctgtcaagaggcaccttggagaccaaatagtgtgactcttgcgtcataaatttgctgagtctgggctctgagcacttgagtgactggcccaggatcactcgactgtgagtggtggtgccgagactgggaacgagatccttttcactcactgcctagagaaccaagctttctacagactgtcaagagagggaatgcagcttggtgaatgacatcttagggacgtataagattgcatgtaaactgccaggttgtctgtcttccgtgatttggcaaaacctaagaagagcttacatagcttacacgtatggccataactcaaagtgtgtgtgtgtgtgtgtgtgtgtgtgtgtgtgtgagagagagagagagagagagaaaatattttcctttctgaaatttaaaacatacaaatgggaatttcagcaggctatagtgtcaaagtcaatagtatgatttgcccattaaaacaaaaagccaatctaatccaaggactctcttttcctaagagaaggagatattcgtaacaaggccgcgcccagtcagatcacatccatgtggcatccagctctcagaatgccatcagcagagccccaagcagagtcgctgggacaatgagctgacccagggccgagcactgcaggacaaggggccaggacagtgagctgacccagggccgagcacggcaggacggggggccaggacaatgagctgacccagggcggag

SEQ ID NO: 92487 - DNA, 1056 bp, Homo sapiens
caggcttcaccagaaccacagaatatcaggcggtgactctgatcctgtgattcattagacattggcccagaggcaccctcgttaaactcaaagctgattgagtttaggaaatcaggggttttctttttgctgtatgccggaaagttttcaggtggctggatctggaaccccaagtcgctgagggagtattctatacacaggtttcttgaattcagttccactctggagattttcccactgctggcgtggcctcaggagccctgtaaaagagtcctgtgagcttctgctttatcgcatctggcagtctctccgccttcagagccctcatggtggtcctgtcaaatcctaactgatgcgctgctccgccttctggcctcctgacccttgttttagaagtgagaagcccagatgtgagttctaaatttgtttttattcccacgtgttcctgatagaaacacctaccacatctaacacctaagacattttaaatggtgggtttgagtatccacaggtatcaaagatgactaaccatcccttgccacttgtcactttatttttatcctactgtgttattttatcaccttgagactgtatttaatcagtctctgaaatgaaaataagaggtttgaggtgtcaaacaaatattataagaccagaaacacttttctcgtttggttttgtttttaacacagttcaggtatgtttggccaccattgtgggtacctgagtaagaactaattactcaataatgagcctggcccacttggaagaagaaagagcattgtctgacttagtgacctggcctgggagactcctcagtgttcagatggctgtcccctggcaggcacagggagtgaaggccagttctccttggagcattctctaacttagtgacctggcctgggagactcctcagtgttcagatggctgtcccctggcaggcacagggagtgaaggccagttctccttggagtccccgggacctgcctccatgcttgttgttgtgaaggggtcagaaagaagatgtgtgtttgttgccgtctactgcatctcact

SEQ ID NO: 92488 - DNA, 1013 bp, Homo sapiens
ctagctggaggctgggggagagagctttctgcaggcagtcagaggggcatcggagcctagaaccagaggagtcccaggatcaggtgtgtccttcagaaggtcccagggggattgggaggggacacaagagagggacggcaacaggctggccggtgagtgagaccaccgagggccctgagcccagctcctgctcctcttctgcctgtcacagaaatgcttgtcaccctgtggtcttggaaagatagtctttacgaagaaaagccaagtacagtgaaaatatgaaaatcctcaacatactggtgaaatttcaggaagaccaaaaaagagagtatagccttaaaaataataaatgtccacccatgatggagaataaatgtaaaatgatgtggcaaagattgataaattaggactgtgaagcctgctgtataattgggaactggcttagctcgagcaagccctggcctcaggaaagggggctgagtggcagctggcattagcggcagccggaatcaatctcctgcctctgtacttgggaacgagcgtcccacgttagaactgggatgaatttttcagcagaggaaggtgaaatgtcaggaagactgtagatcacgctggcgcagagtcctcgggaaattagagccatgaaaagctgccagcgcggcgccccaatgacatatggccagcgtgtgtgctctgcatccgccgatgttgctccccgggtggtgctctccggggagctagcgtgagaggggggctgggtcagctagtgccaccctccccgggtcccagcggctcagggccattgacccaggcccgcagctcggggacagccccggctgctgctgtgacccgctgctaatgaagaccggggggtgagggtcagatgcacataatgagccctcttgcctctgccttcctcgccctccctgatccgaatcctgttttttccttcatttctgcccaggccccagcttgggccttgagtttctcatgggaacaaagacagtttgact

SEQ ID NO: 92489 - DNA, 1047 bp, Homo sapiens
agatgctgtcgagaattggcttttggaatccttcattgtgaagagcagcctgtatcatttgagctcatgcgtggctgtgggcagcgtggcctttgtggagatttccactgctgaggagtccgtggatgaggcagcgtctgtgccttctgttcactgggagtgatgtctgatgtgcccgcctggtccaggacgtgctttttaagctgtagaaagaaggtgctgaactagagggttcctgagatttcttttagcttcgaggtctggaggctctctgctcatagtgaaaactgtatcctcctctacagattaacaagaaagtcaagatacaatggttcttgtttaaagatgcattttccccttgatctctgcaccaaatgagaagaaagttgcatttttgagtggttactttgcattgtgaaaataagctgagagaagaagtgggttttcgctggaaaatagtattcttagtctcctctttgtgaaaccagaattctgagagaaaatgaccgagagccctttgaaagaatggagtacgtgagaggtggggagaaaagttggaatccatcagcctcatcgtcaagtgcctgcttaaagacggggcggcgggggcagaggacgctctgctgcactcaagatgctgatacatttctcaagcatgccggcttgtgtgtctccggttaaagtttccttcccattttctgtgcagatgttaaaagattgactcctttccttttttcagggtataggtgctcagctgggaaaggtgagagttaaattttctcatgatgctggtgccaagaaatagcaccttgaaaagagaaagaaatcaagacatgatctccagggagctgtcgtttggagcacattcccgagagctctccctgggccgggaggctgcgtggtgtcgttcccctcagcagcatgcttcaggtggagcctcctgccctgttcagatatgttagataaaaacaccttgacagtgccagcccgtctttaattttcacaccatctcaagtaaaatatgttttgaaatgaaaacattttgca

SEQ ID NO: 92490 - DNA, 1022 bp, Homo sapiens
gcatttctttgttgccttggtagttatctgaggctgtgaaacagattcaggttattcttttagtttttctagttgttatctgcagaagagttggtttaaaccccctactctgctattgctggaagctattttctgctgtattgttgaagtataatttgtttaaccagtcttttactgttgaaataatagttttactaaaaattaatttaaacattgatgtgtagataatttacatctttattacttaattttgtacccatttacaatgatttccatatgcaaatttgaagtggaattgtgttgaaagtgtgcaaaagtcaaaggcatttaatacatatttctaaattgctttccagacactctgtactaatttatactttatcaacagtagatgagataaactgcctttttaaatctaacttcataatctctattaaatctaacttcataaatgtgcatgtgtttttcttccctcctgcaggcacgtgccttaacacctcaaactgcagaaacagatgccattcggtttttggttgggacgcagtctcttaaatatgataatcaggtaactatttttgacaaatgtatacatgataattactaagcctattcttagttttataaccattttgctctgattttccagcaacatttgagaaattaatgccacataaacaaaataaaactttcatttggatttaagtctatcttcaaatcaaagaatattatccatctatatgtatcgactgtgttcagtaatttaaacttcctctgtttggcatgacttccgtagtcttgtttggctcttgtggttatatagatttggctttatgagcaattgagaagcaaggatatgtggtcaccactaccccttcttcttggcctgtggattccttctttaattgctcatagaactctttctaggtgagtgtggggtgtgtcacaacctcatccctacttgacccaggccacttgatctgtcactgccccttgatccaggtggggatacagatgggaccctt

SEQ ID NO: 92491 - DNA, 1041 bp, Homo sapiens
tattcttcccagggagatgcagttaaagacttgatgcttcgctttctgggtgaaaaagctgcagcaaagagacaagtcctaaatgccgactcagtggaacaatcttttgttggattgaaacagctaatcgtaagtgacaatgtgtttgatttcagtgttgttttgtgataagtcctgcctgccttcataatattttctctagaagtcaattattttgaatattattcaaagctcttgcacataagtagaattttgttggagtagatgccagtcctgtgcaccaaaaagcatcatattaatacatggatacttttaagcctaattagttaaaaagccattattggaaatgatcaaattactcaaagcagtgcatactttgattgagtttgcttcatcatatataatagagataaatgatttgtgttcattttttaaatatattgcattttctgcattttgtgtagaaagtttattattgaatgggtgaatttctgaacatttttaagctttgtcatgaattctataagtaggtttttaaaattcatggctgggcgcagtggctcacacctgtaatcccagcactttgggaggccaaggcgggcagatcacaaggtcaggagttcaagaccagcctggccaacatggtgaaccccatctctactaaaaatacaaaaattagctgggcatggtggtgcgttcctgtaatcccagatactcaggaggctgaggcaggagaatcgcttgaactgggacccgggaggtggaggttgcagtgagccgagatcacaccactgccactccagcctcggctacagagcgagactccgtctcaaaaaaataaaaataaaaaaacattagtactggatcaccattgctgtacaggttgatttgtttccaatgaatttataatcttaaagacagctgtaattgcgttgggtagcttttctagattaaggagaagatattggaagtttgtcgcgtatgtttccttcaggaatcctatggtagccatggggtaagtactctgaaatgagagcccca

SEQ ID NO: 92492 - DNA, 1049 bp, Homo sapiens
gtcttgttcaccagtgcatctgaggacccagcacggtcaggcacagaatgggtacacggcgtcttcttgagtaaataaagggatgagggaatgaatagataagagaacccccagtcggtaagctactcttttgataaagaagtagcgtcagaatgttgggtttaaagaaatagagaaggagctcatacaaaaggatagagtggggggcggttacgggggagggggcgcaaagagtgaggagatgaaaccacaagaagattagtctggagaaagatggaacatttcttcctctgcaatgacagaaaaggaaaggaaggatttgaaaggaatgaaaatcgaatccagcacattttcaaactgtgattctgagaaccctcgggttccagggagggaccttggggtgactgggcatggcctgcggaggtgacttggtagggccagtgtcaggcagagcatttcagcagggtctactttatgtagaagtctctcttgagatgtctttttttgggggggtggggggaaaggaggatgaattttactatttaaaaatttgaaaaactaacatagtccaaaatgcccgctttgtagattagaacactaagatctacaaaggtgtagaggttggccccaaacaaatgtccttgctcctgttaccagtaccatccctactgccccatgtcccttacacagtccgcacagcccagcaaaaagcacagttgctggtgttggttttgctcattgactacctcccaccaaatgacttagtatttctgaaccgtcggatctacacaccgtgggaattacgcttttcaatacagcttctaggactggattgtatccaggggtaggatttcccatgagaagaccttatatctgatgggattcaaacaaacaagttctcacttgtgtttcttagtgtattcattgagcaaacacatattaagcctcttctctttccagcaataacaataaaggttgctaagctagtgctcttgctccgtgaagttctgccttcttaaccatttatgggatttactcagatttagaag

SEQ ID NO: 92493 - DNA, 1054 bp, Homo sapiens
cacattgttattaagctcaatagtaatttcttcttagagacagggtctcgctatgttgcccaggctggactcagactcctgggctcaagcaatcttcccacctcagcctcctgagtagctggaactgcaggcatgaggcatcatgcccagcttcaagagtaattttttaaatacgattgtgtaaatatgcaaagatagaaagttaggttagcccttattttaatatatgagaaattaacctctaacaccaactcataaggaatagcaaattctgaactggatatatgtagataacctattgtttccattgtattttgtttttagctctggtttgtcaggctggcactactagtgaagttgggccttttccagaatgctgagatggaatttgaacccttcggaaatcttgatcagccagatctttattacgagtactacccgcacgtgtaccctgggcgcaggggtaaggccatggtatttaatatttgtacatttgtctgtgtgtcgctctggtttgctttgatttatacataatttcgtagcctcagttttccttatttatccagtcttgaaaaatcagataagtacccagcaacaagccttgacttacagaatgctcccactccgatttaccgaaacactgacctggaggtgctccctggtgcatctgtttgtacatttagcagctacgtgtcaagcacctgctctgtcagggcagcatgatttggtgcaggggccgggtagtagacgtctgagctgcgctccacagggaagagccgtcccatatcgggacctggcgcacagagatgcagagcggtggaaccaaacgtgtccgtgcatatggcacacgccgtgacattttccgtttgtctctattctgatttaatttattttaaaaatctggttgtggttcaccctttgggtcacggtcacgaccattgtttggaaaacactaggctacagcatagggtagttctaggagagtgacaagaaaccaccagttgggaagggagaagggcgggttacggagagccttctgcagcactgggagcct

SEQ ID NO: 92494 - DNA, 1038 bp, Homo sapiens
aaatggagacctctccttatcctgtctgcacaagatacaggccttggccagtcactgggctgtagctgaagccacacgtggattgcacatgactgtggcagacgcgtacagaggcagtgacccaagcctcagtttgtcttcatgcttcagggctttagttaagcaaatcatttaaataagaaatatttaaggtatttttttctcttaggactttctcactgtttttgtgtttggtttgttttgttttgtttttaatttacaatgccacattaaagtcaaaaatgacttgttgagagctgtaagtgtgacactgtgtgcttggccgggcacagacaccaagcagtatccccagcgttgagcacaggcaaaccaaaggcatggcttatcctgcctgctgaggtcaggatagggaaggacacacccagacaggcagagacagtgggaaataaatacaaagcagtcttcccagcaaagcactcgcgtaacttgaaaatgagacggaaatgccagggcaaacttgtaagtttgtgccttactgaagaaagctgttaaaattgggcaaagggtctggaaggctcccgcagacccttctgtgaggcaggtggcacaggcgtccaggcatcatgtcacacctgctgcggcctcacggcaacctagctgcctctgggccctcccgccctagtttgcagtgacacagaaggctgcagagaggatgtgagccacccagcacaaacagctagtgagtggcggaaggtagcataccccactgaagggaagctgaaatgtcatctttgttccctttcatttttcactgcccagcaccaaggcccgggcaattcctggcacatttctcttttctatagtggcagcacggattttcagcacaacaagggacggtctgaaataaattttgtaggagtattttcatttaatgttttctaaatgatgaatgagaacacttctacagtatttataccaacctagattttggcaggtcacaactatacatgggaatcttccggaaaaatagatccacta

SEQ ID NO: 92495 - DNA, 1043 bp, Homo sapiens
cctgctcctcccacgcgccctgcaggctgtctccctctggggtcgagagagcttcacagaccatttgggaaagagccaagcaaacacacttctgcaagccatttgcataagtagacataatccatacggaatgatgcactgttcggttgtagtttcattcgtcagtgacctgcatctgcccgcccagtcttgagttcagctccatccctccctgcagttccgcagcctccggcttccccacctcagcttggctgagagtttcacgttcatccaagtgcttctttacagactcactcccagctggaggaggcagagggtaaggtacattttcgtgcactccggaaaagaaacgtattcaacaatgtccatgtagcttttgcttctctattgataattgctaatgtggtagtgagagctttgtttgtaggaagagttaatatcttttctaaaagggttttttgacagatggacattcttcagttttgctgtcttatttgttaagcaaagttagaaacataagtgagaacaggcgtggctggcctctaacactgtcagggccaggactcagggcctggccacccgcacaccgacagtggccagttattgccatcaccgtgcctgacccagagggtttggttgcccttcttttctgctgcttccacagaaaacaaattgattgtggcttaatcagatgagatgggaatgactggcaggtggggagaagaaaggaaaggccgagtgaggatggccatccatcgaggccacttccctgctctttgccattgaagcccatgctcctggaaccccgtgtgtgttcagaatgtgcaagcagaagaagaagagggagcggaaagcactgggcatcagggctttccaggggaatgtcttgacctggctggcagtggaaattcacaccttcagaaacctctagagttcatcgtggccaatcctgggacatggacttaggaatgcccaaccccgccacccagccgtggcaacccgattcaaaaccaaatgcaccaaatgtgaactcgaaggccata

SEQ ID NO: 92496 - DNA, 1165 bp, Homo sapiens
acaagagggatcttttaaagttaaattagaattcacaggacccagtaattgagggctagaaagagcctcgaatttatttgtgcacttacaggctgctcttaccttgtagcctctatccggctgtggaggtcacgtctgggccgggtgatgtactccatggcaaactgtctgctcctgatgaaggtacgtgggtggccaagcagggctgccatgtgatctggaagagcggggtcagtgggagccgcgagggagccgctggtataatagatgctggcagggaccggccgtgcagagaagccagctaagtactggcttaacagggagcccagtgacacattatggggctatatgtactttatttctactgcaagaaatttcaacagaatgtagaatttagatgatcagatttcattattgaaatgtgggtctaaatgatttaattaaaagtattgttcattttcccccatttttctctgaactccatccccagaaggtgtcctttgttctccctatcttcgtggagggtgtttttttcacctcatggttttgattttatgattgatgcttacaacacctgaagacaggcttccccacaagaccttcttaggacgtcaccccagagctctcagcccgcagggaaacagcttagaaatcaaggagctgaactgaggctgtcatctgtttttccgtgtctcctggctctcgccagcctgtgcaacggtgttttttggctcctctctttgtttggaacgcaccccacacctggctcacctcccacactgggcatcagggtgccctgtgtggagctagtgtccctgcagccagctgtgcgtactgagagctactgcaggaatcagctagcagcaggcgctccggagcagtgctcgtaacacctcctgggctgttcgaagacagcgaccttaactcccacacccatgcggctttcatggggccaaggtcattcctgagcttgattttcagcaaggcagagcaggcaatttaccagcggagaactgtgctcacgggctctgtcatgaaccctgaagtggcagccctgctttatgcacggaccctgcagcatccccagaggtgactgtgaccccgggcactgctccgagcaggctgggtgcgggtatagattcacagccatcagtggctcaggcat

SEQ ID NO: 92497 - DNA, 1155 bp, Homo sapiens
cagtgtcactgggtcattccagtgccccactcacgccactgatgctccaggctgaggcggccaccacagagagcgcagggtgggggcgtggtgggggcgcagcactcactgctagtgggcgatgccgtggccagccgcatcaccctaaccgctctttcagtgctcagggccaggggtcagtgtttctgaagataatctagtatgacaaaagacaggtttttacgaaaccaagccatgctctttgatgggaagttactttaggcatggctcttcccaaagagcacgtgcacaggcctgggagccgtgtgagaggaagctggattccaggccgggggcaggcgcggcagagaagggatctcgggggcccctgcacccgccggcagccactcccaccagctcagcaacagtagcgctcgccagtccctcaggtgtgaacatgacacgtgtctgtgtgtccgggctgcagttgggggaagaattctggggcacttcagggggcccatcgtcaatacagcagatgaggatttgggattgtgttacaaagtttccttaggttgacggttacttaatgactttatttactgaagaggaaacagcccttcacaggtaaaatggccaaaagaagctcctcaagagagcttaacctactctccagatcctgtggatttggcttttgtaaaggacatgaatgacttacttccagggacaagtctattttagctcaatcttcaccatttcttttcagcagccacacgtgtttacaggccgtgaaactagatttacaaccattctgcaaccagcaaggacttctgcagtctaatttcagcaagacggaaggtagctgatgcagctgcgtgctcctttccatcatgtgcggagccacggcgggttctgatgtgcatactggcgagctgtggggacaccaggagggaagtggcctcccaggggcacccgggggagggggggcccaagccacctaaggtggcaggcacctgcatccatatggtctgccagtgcaggtgccctaaggctacagtgaggcctaaggagaggaagaagtatttaaaaagtgaagatagtgacattttcaatgctttataatacatgccactgtgcattatagcatatcatgcagatttatccagggctaaaacg

SEQ ID NO: 92498 - DNA, 1030 bp, Homo sapiens
aaacttgttttgtggtttttctttacatgtaaaggtttgaccttaatttctagcatagaaaacgtttaagagacactttaaaaatttggcctatgtatttggaggatggagatgagacagcgttcgccaactcacatgataactttgtcaggaaagagagttaggtgcagtccaagtgaaatatgaatcgctgtttagaagatggaagcaggaaacagaccctcaggcccaactaaaccgcgacagcccccggtgacaggcaggaccccgccgttgcgatgcgcacagctcagaatcccggcccgactgcagtcgggagagcagccgccccctggcagccgagcaccgcgtgctggtttccagcttccccgccagctcctgcgtcagcgtgtcctctctctacaccgcgtctgtatacacttgtgctcttctacacgtgtgaaacccacagtgctgttctcagctctaaagtacgttgggtttttcttcccacaggattatgtgctggccgtggaggcgtatcattcggttatcaagtattacccagagcaagagccccagctgctcagcggcatcggccggatttccctgcaggtacctgtgcacggtcagacatgagccagaaaggccttatgatagttctttgctcagatgggcgactgtttgcttttaatcattttaatataagaaagactgcagaaaatattccaattcaaatgtatgtgaccatgaaaagggtgggttctttccaggagttctggtttgactgtgggaggccctgctggcttttgtgcctgttgctaaatgtgaacccacagaaagtgtcatcacagccacactgaaatgagttactctagacattgtcctgctgcagttacgaaagcactgactaaaccgtgaggaatctcagttcagcttatcccgtaatagtcactcgctgatattttgcctgaaataacccttgaatcatgtttgctggacagacaaagtccagactgaacagtggtctcagtaatgcacaaagctcggc

SEQ ID NO: 92499 - DNA, 1923 bp, Homo sapiens
acccacgccaaaaggccattcttccaggccagcgtcccagggcgctgctgtgcgtggttcgcagccccggcaaacgatggcctgcactgcgtgctgtccgccctgttcctgctggactctctgcactgtgtcctgatcaccctctcagctgatagtgggcactgcagtgtgaatcttctcatggacaacagaccaatcctgcctccaccagtgccgtcgccaaatcagtaacacagagcaacctcaaacatttctgaatgtttaggtcatctaatacttggcaaaagagtgggccgaacacctccaccctcagctttctcttctgtttgtgtgtgagtgtgtgtagcagagtctgagaaagatacatacagccaccttccttttctgagcttgggaaaatttgaacaagagcactgaaatgcaaacactaatcaaaaaggaagtattttccattttaattctaaagagtggaaatagaaaaaaatgattttgctaaaacaaaatatgcagacacctttgggaaaacgtgctataaaggaaccatgctaactccagagatgacccagccggacagaggtgaaaggggtggacggacagcaaggttctagatgattccacacagttgggctgagaacactgtcaccgcacctcctctttgtgtttaaaattttgcattgaatgtaggtgcctctgaaatatgcgagctaaaaataggaagctcactcactgaccacaccaacagttgcccggtcacacgagaagatacactggcgaatacaaggatggcacagatgccctcactttgtgttaggcctccgaggagctgactttcaattttaatatttcaaaacgtattctacttttgaatagcaatccttattctttccaagaaattcatagcataattctgggcactgagcaaagggtcacctgttcggtttgtgtgctgttcacattccagctggaaaccctggctcaaattacagaattgtacttggggtttaatgcctgcatataagggaggatccatctcccccctcggcctcgtcccgcaggcagaactatcatagccacgttccctgccaactgtcagcgcacccgccagacaggtgacagccgtgtttcaaaactcacatgcctgctgtgatcatttccacagtcccttcatcttcatcacacagagcctcctttagagcaccagggcctccacacagcaagggggctgggggttaggaggagagagaatggggcccagtgggaatttccagttctgaaggaaatctgtgttgtaagcaagattgaagtcatttgtattccagaggagtttctcacataatctaaattaaggaggggcagaagcaactgatcttcaaacagaagaagcattatattcatacttcttagaattacttcactccaacttagattccacctcagaatctcttgacttgggtcttagagggtcctcactgggacttgggactgagagggtcctcacttggacttgggtctgagaggatcctcacttggactgggaaagtagctgtggtgcgcaggtgcaagtccagcagccaagcacagacgaggggcctgtgcttggcattggggcagctgagcgcagggtggttctgcagtgtctgtggccagtcctaggcctcggtgtcctggaccaaaggtcagagcccaaggtgatcaggcaggagaaagcctcagccactgcaggagtggtgggaagttgggataaaccagccaccccaggcaggacgaagggggacgggatgcaggaccactcaccgctatggctgagaggacctcagcaagaaccaaggtcacctctgaccgagttcccagagagcaggaacccagggcagggtggggagacgctgaggtggaagaagggaaggaagggccagggaagcgctg

SEQ ID NO: 92500 - DNA, 1045 bp, Homo sapiens
gtttgagtttggtttggcttgttttttacagttgaattctatattatttggtcaaaatattactttgcaatttgcaaatgtggtggcacctaccattttactagccacaagtaactcataagttgacgtaggacctgctcatattataccaatattttaagtattttatgtttcatcttattagttattcattttattttatctaatgctctgccagaattcattccaaaaggtaaaaattactaaactataagactcttaaataaggcgtgtatattagcaacttagtttctgacatatagaacattaacattccactgtatcttaaatgtcttttgcctttttattaaaaaatgattaaatggttactgaagttttcctctgcctgacatataaatgtcttcatattctaacatgatattagggaactaaatatatgagtatagacttaatatttcttttgtcaactaaactgactaaattttgtcaaagcagattggagacataaaaacagctgaaaagtattttcaagacgttgagaaagtaacacagaaattagatggactacagggtaaaatcatggttttgatgaacaggtaaatattttaaaactaaatatatgttttctcaaatttcccagaggcgttcaagccccacttactgagttggaaagctccctagagaaggcgcttctccctgtatctcctcttgccctgtgtctctcagagcggagacccaaggagtatacaggtgttttcttgaatcgcagtgatgttcttttagtcacagaagctgatttttaaggagctattcccccttgttcttcagagaagcgcttgtattgcccccgttttcagcgtatgtgtgtgtaaaggtcaccattgctggcgtagcggccgttctggatcctgtgctctggtgttctgtgtctggatcccgtgctctggtgttctgtgtctggatcccgtgctctggtgttctgtggtagaacgcacagcgtcgtgcgagtgcacgttcgtgaggaggaaacacgccttggacaaag

SEQ ID NO: 92501 - DNA, 1046 bp, Homo sapiens
cctgcctgtaagaggctcaggatgtgatgtggctggggatgaggcccggtggcaccttcaacgcaggagaggagggggtctggatcccaccgtcagagcacgcacgcaacctgtccactccctcaggactgcagaaaaggtccattcttgtatttctttttaagttgaattaaatccatctctagcccctgcctctgaactgatggagtctggctgtcattgggcctccctcacccgcaaggggtggaaccagagcttggggctgaggcgctcctggagtgtttagcgcctctgctgtcaggacatcctgtggccactggcacgctgtctgcccacacagtgcccccgaccagcagcggagccacccactctccacagccagggttgggagccctggggcccgagtccccggtcccacgtgccacacaaggcaggacattctgggtgctgtcgcatccccggaatcagggcctggaccctggtcagagcaggacctgcaggtgaccccgggtggggcagactgtcttctgtccttggtggcaaagccggtgttctcggcgtcatgtctgcacacgtgtgcctgaagccacgggaacgcaggggctacctctgggcctgggcctggacctgtggagcaggatcggggaggacacacaggtgggcgtctcaagaactgtggtgtacacagctgagcccctgcagctctgctttgccgggcctcaccctcggtgctgggtgcaagacgtgacaagatggcatgggaagcttcccggggaacgctggaactgggtgtttgaaggaggacctcatggcggcagctccagcccaagtactgcaactgtggggccgtgccaggagcaggtgctgcggagcctgtgtgggtccaggacaagaggtaaggggagtgtggacggggctgcactgtcctggggttgagggcaggcttcagggggtgacactgaatagggactaggaaggtgcatgccaggaggggtccaggcagagagaacaagtgggggcacaatcctcgagggggcatagaagag

SEQ ID NO: 92502 - DNA, 1356 bp, Homo sapiens
caggaagctactcagtgggcgtttgtggttggccgctgagcattcccaaggtcacggccccatcctaagccctgggacctgtgcacgtgacctgttttggaaaaagggcttttgcagatgtaattagcttaaggatcttgagatgagaagattattctggattaccgtgggccccaaataccatcttaagtggctccgcaaaagatttggcacacggaggaggctgtgtgaccagaggagagaccggagtgatgtggccacaagccaagggcaccgggagcccccagaggccggaagaggagaggaaggagcctctctaggaatggcctgctgacggcagcctccagaatggggagggaatcaagtctgtgctctcatacttaggagtgtcttacggcagcctcaggaaacagacgcagtttcccattcacagcctggcctctgtccccatctgggggtttccccacagcctggcctctccctgttgcccaggctctccccatagccaggtctctccccatatcctggcgtgtccctgcagtctggcttctccccacagcctggtgtcttcccatagcttggagccttctcacagcctggagtctcccctgcatcctggggtctccctgcagtctggcttctccccatatcctggggtctccctgcagcctggggccttctcatatgctggggtcttcccgcatcctggggtctcccatatcctggggtctccctgcagcctggggccttctcacagcctggggtctccccacatcctggggtctccccgcatcctggggtctccccatatcctggggtttccccgcatcctggggtctccccatatcctggggtttccccgcatcctggggtctccctgcagtctacccatggtgccagggcagctcttcctcctgacatgtgtggggggccctggggtgcagagaataaactccacccatcggatgtgaattccagcagccctgagggtgggtgagtttcctggagcagtgggcgagggttcagggatgcagttcgctgactgtccagctcagcacgcccagggagctggcagggttccctgaccccgggaagcaggtggaggctgagacaaaggccaagccagctggaggctttagggagacgcactgggtccactccacaggcagcaggaccccaggctcactgtgggcatttgaggagtgggtgtcagggtgaccagaaggagccagggtggaggtcgcagggtgtcatctcggtgggcagagcctcggggccctggggtggagggagtgaggctggagagcctggctggctgtgctggacgcctaacacggtcccggagatggcacttct

SEQ ID NO: 92503 - DNA, 1234 bp, Homo sapiens
gaaaactgtagccaaatgaggcggagaggaggtggagggtacatggggttggagccagtgcttttcctgactgtgtgtctctatagagagcacggaggtgcggagttcaacaccaagcctcagctccagatgctcttacctggcacgtgaggacaggcagggccagctgcaccacctgatacaaattttccttccacgaataaaatgtggcctaaattgttaaagacgcagaataaaaatagcaagtaaagtgtttatagcaattaatgttaacaagttgatatgttaataaatactaagtagaaggccggctggtttaatgagatgctgggtgtgtttgtctgttttccagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcat

SEQ ID NO: 92504 - DNA, 1045 bp, Homo sapiens
cttaatagagataggattgtgataaatgaaaatgttgaatgggaattttaggcatagaaagctgtcatgagcaaggttgtggggatgtgaaatatcaaatatttttaagatagccgatcatcctatttggtttagaatgtagagttctttaaaaagtaggagatgggaacagatagaagtagaaaagtcagctggggccagatgatagaaggtttctcattccagtttaattaacttgagttttatttgcaagctgtgagagcatacaatgttttggctcatggaaacaaactgaccaaagagatggcattgaggatcaatgagactcatgagtgggatggtggcagagaaacagggcacagtgagggacctgtggagtggacagaaaggcctgaggtggtgagactaccatctcaaaatgggaaaaagaatcccctgggatggactgttgcagagaagggaggcagaaatcaaacagaactccattgtatgtatagctggtgttttggagaatggaaaatccattaaatggctagaggagatgaagagagttagttgagggttgaaaaaataacaaatgataaatttggagtataaaatcatattggagatccagaaagagaatgtttctacatctccttgttaatctgagctcttgtttttggtgggttaactcttttagctggatgctgacaaatatgagaatgatccagaattagaaaagatccgaagagagaggaactactcctggatggacatcataaccatatgcaaagataaactaccaaattatgaagaaaaggtaagggagccctggattacctggaaaagaagtatcattatattcactactaatagacgcaatattttctttcttttttcttttaatgtctgtatgaggccattcttgctttgctataaataaatacctgaaactgtgtaatttataagaaaagagatttaattggcccacagttctgcaggctctacaggaagcatgtgcttcctgtcaccaccatctgcttctggggaggcctcaggaagc

SEQ ID NO: 92505 - DNA, 1015 bp, Homo sapiens
  misc_feature (1)..(42): n is a, c, g, or t
nnnnnnnnnnnnnnnnnnnnnnnnnnnnnnnnnnnnnnnnnnccttactgttttctctatttcccagcaagcccttcaggctgttccatttagaagacattaagtcagttttggccctcccaggaagagtggtgtagactcagcctcctccacagaatggtgtctgccctggcagcactcagactgggttcaacagggaacagccaggagggtatgagacctgaagtcgtggcattgagagcagctttgctcgtctctttcacttgcaagctgttggaaacactcaccagtaggacaccttggcagcttagtatttgtcatggacgtctggcctgtcggtctgcccttccaccgcccctctccctgaccagtcgtggggctgaggggctgccaggcagagcacctcccagactgggcacccggccaggcccagggtagtggagtctgcacctcgggctcccagagagatctaaagggcttgcagtctggaatctcccatgagactggatatcccatcattacataacagagctcttttgccttgaattgcaagcaagtgcagtcttagagctactggcggctgttttctgacccatgcagagagctctttttagtagctgagtattcagacaaggcacagagaaaagagggttgagatagggaggagagagagaaagagagaaggagagacagagggaggaagagagacaggagggagaaaagggggcagaaagagggagagaagagaagaaaagctaagtgaagagagagacacacacatatggagaagatagagacaaagagacatagacagagctgttaacatactttcagccctgaatcctgccatgcccaaggtgcgttctgctctaacccttctcatttatgtgatccaacatatctttgttcccgtttgtttgcttaggtaacttggacttttctttttttgagatggagtctcactctgtcgcccaggctggagtgcagtggcgcaatcttggctcactgcaacctt

SEQ ID NO: 92506 - DNA, 1159 bp, Homo sapiens
gatttcttctgtttttccagtaactgtgaagggaaattggtaggaggtgttgtaacagggcaggacccaaatgggaacggggggatgacattggtttgtcaggtaccgagcaaagagtgaggattttggagtctcccttctgctgctctgatgttttccacatgcttatttctttgccaggcactggagatgcagtcagaagtggaagtggctcttacttctagtctgtgtgtgtataagtcacttaagatggcgtgttgactgcttctttgggaaatgccctgaataggagcatgtaggggatgcttacgaggctggggaaggctcctgggagaaatgacatcttaagctgacagctgtaggtagaatacaagttaggggaaagggaagagaggagggtatttcaggctgtgccaaaggccaaagcaactaaggccagctaaggaagtgaagagtcaaggatggtgactcagaatacaagtgggatcaattataagaggtaagactaaggaggtgaaaaaggcaggacactcaagattgactcaccagtgatcgtgcatttttgtaggtataactaactgggttcaaggttggaagaaaaatgggtggaagacaagtgcagggaaagaggtgatcaacaaagaggactttgtggcactggagaggcttacccaggggatggacattcagtgggtgagtatcttaaatgttcatgtcctatggccattatgaccaaataagctaagtttactagagattaatggtttatgtaagtggtttaatgacataacaatttccatgatattaatatcataatgtatattacaacgtatttgaggctgggcgtagtggctcacgcctataatcccagcactttgggaggctgaggtgggtggatcacgaggtcaggagttcaagaccagcctggccagtatggtgaaaccccatctttattaaaaaatacaaaaattagccgggcatggtggtgtgtgcctgtagtcccagctactcaggaggctgaggcaggagaatcacttgaacccaggaggcggaagttgcagtgagctgagatcgcgccactgcactccagcctgagcaacgatatgagactccaagaccccgtctcaaaaaaaaaaaaaaaatatgtgagcctgggctc

SEQ ID NO: 92507 - DNA, 1158 bp, Homo sapiens
gctcttttaacactgtgcaacctgacctctgatcccaccacactactgaagtgtcctggtcaccagtggcctgagaatgcccccgtcagtccttttttaccttgttctttacagcctttgtgtgtcaatcataccctctatctagagggaaagaagcaaagacgggaaccacacttaactagcagcaaatatgccagggaagaaattagaccagcactggtcaggagactgggccctctggcaggcagggtcaccgtcatgctgaggcgctgctcgtctctggaggatggctccctgggagtgaaggtgaccctgccgtggagacagcgccattgtcctctgaacccacagtgtgggatgtgaacagtagtttttactgcagcaggctctagttttacaaggtgattgccttcaccccgaacttgcctggcctgcaagatcaaaatgtaagtggattccaagcataaatgttaggtgcccccttgtaaggaatggagcatgttttcctagagagaaaacgtctgcagcgttgtaaaataccctctcggtttaaaatgctaagtcgacctagtggatttttgaggtgaatttcagtttttagtaaggtcagcccagcagcatgtacttccttttcccacaggagacttcgtcgtcgtctacactgatggctgctgctccagtaatgggcgtagaaggccgcgagcaggaatcggcgtttactgggggccaggccatcctttgtaagttaaacgaagctgagttttactgaatcatgttccacaacttgtgaaaagatgaggcgggatctgctcattgtttgattattgggaaaacctgcagataagtagctctggcaggggtggcagaggagcagctttggttcgtgttggggctaagcggcattgcttttcagaacgtgaggtacctcagctttacttcctttgctttttttttttttttttttttttttaagacacggtctcacactgttgcccaggatggagtacagtggcacaaacacagctcactgcagacttcaccttctgggctcaagcgatcctcccaccttggcctcccaaactgttgggattatgggtgtgagccactgcacctggctttggtgtttctttcttgccctggggaggagtcttttttttt

SEQ ID NO: 92508 - DNA, 1050 bp, Homo sapiens
ggttcaagggcttcccgcggtgacccgagcacgccggggcgtggcccccgaactgcggcctgggggcggggagagaaggggcccaacatggtccatctcgaccttcctctgccgggcccagggcttcagccccgctcccataggccccgccccatcccagacctcgcccgccttcgggatctcagccctggctccgcttcttcaagtaccgacaggaagttgacgagttcgggctcgtcaggggccgagctccgggctccgccctacgacaccgcccctccctaggccccggccctcatcaggactccgcccagacgtgcgtcatcttcccgcgccggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggtgagtggcccgcccgccgaggcgcctccctgccggcatcggggtcgagggaggccggagcccggctaaccccggcggcgggagcctggcggtccgagtctgtgccgcgcgctgtggctgtgggtggtcgggggaccgcctcgttttcctgctcggccggcggggttccaggaggctcatggcctgggactggaacgcaccgaagacttgtttgaaatatcagaaacgtcgcgtaaaggttaggggtggcctaataaaccctgtgtttaatcctccatctttgttgcagttaaagtgcaacaaaaagtgacacgtaatcagaacgaacccccgttaccagaagactttccgtaccagctaaattgggattggaactcagtacctaatcttcccttttaaaaaaggcaaattctaataagccagtatttgcagttggatccttgtaacaacccttggaggtgagagggattattctcactttcaggtatagttcttgggg

SEQ ID NO: 92509 - DNA, 1527 bp, Homo sapiens
ttttgtagacatggggtctcgccatgttgcccaggctggttcctgagctcaagtgatcctcctgcctcggcctcccaaagtgctgggattacaggcgtgagcctcagcgcccagccaagttagccttttttaaacgtcctgtctccggaggttgccgaagttggttttcttcggcctccttctctctcccaggcccagggctgggacgaggccggttcccgcctgcaacctgcactgaagacgggaaccttgggagccggtaccggaacgctcggaaacggcaccaaagtacgaatcctagggcggaaaagcgttaccaagacactcgtccccagagccgcttcctgggactctctagcctcctaccgcttctcagtgatgttccggtttccgccctcctcctcgcgctgtttccgcctcttgccttcggacgccggattttgacgtgctctcgcgagatttgggtctcttcctaagccggcgctcggcaaggtaggttggcggcctgctctccgacagaacttttcttcttgggttgaggaaaacgccttttggagtcaggccctggaggggcgagccttgctcacagggtggggatacagccgattacccgccctgtgctttccgatggcttctgcggggcgagcggggcctggccggggggtgcgggcgggagggcgagccagcggcgcctgcagcccgggccgcgtaacgctgaccgctgtgccttcagttctcccaggagaaagccatgttcagttcgagcgccaagatcgtgaagcccaatggcgagaagccggacgagttcgagtccggcatctcccaggtgagagggtttccctggggtctggggtggggggaggcgccccgcccgggaggggaggcggccgcgcgtgtgttgggcccggggtgctcggacgcgcgctcagggtcggtcctgctgttcgttgcttcttaggctcttctggagctggagatgaactcggacctcaaggctcagctcagggagctgaatattacggcagctaaggtaagctggcgctccctcggctgggagggaggttgcggcgcgtctccccgcgcagtgcctgagagggttggacctgggttacggttgatgatgacttgccgcctggccgcctaacctgaactcaggttcggccgtgttgtttgggagtgataccgcccaggtgcggggagtggggttgcaggtaccctgcggcttaagctgtccacatgcgggcggtggagaaacgtggagtagggagggcctgggcccatttcggaccttatttgcccttacttagttatagatacggcaaagagctgtggggagctcaggatgagattctctctacccttagcccggagttgccgcaagtgggggtgcagaagtggtagtgattggcctcctggcctgaacagtctcccttcctggaataaggaaatgtgaaggttggagagagatgagaacatttccgaaggatgcatttatgattaactcaaaactagtattagtttgtagtg

SEQ ID NO: 92510 - DNA, 1710 bp, Homo sapiens
tactcctgatgtctcatggtacatggtagctgccccaaaagcttgcaattaattgaaacttctcatttgttaggtggcaggtaggtaggttttgaacttggtagtgatattcagacgaggagcaagattccactggcagttctgtgatgctaagtaaatgatgtgatcatatccgtgctttagaaagattatcttgacattggaagggggtggttttggagatgagcaagagtgttaaaggttattgtagtgatttagttgagaaataatacaagtgaaaataaagatgtataaaagtcctctaatctcacattccctagagatggtcactcattgccttggtgagtttgtagtttatcccagagtaacatttaaaattgactgagcttttgaaataaatcagtaagctattaccctattctaggtaggcaaaggctttagtttggtacgtgaaatataacaagcttatttgaaaatgagtgttaatttgacttcaggaacctgggatttgcattttcattttgacttaaagaggtgccctctggagttgcccagagggcaggcgttgctaggttgcttaccttttaaactattcttttagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttagtgtaaccagtctccatgcgccaccatagcaatgactgtagtaaactcaggactagttcttttacccgcacttcagcctgctctcctttggattatgtgtcaggtgttaaatggagatgtttcaagaattgaacacttgaaattctctgtaccttttggaagtagactctttctgtggtcttttagttaggctgtatattcttggtgagttaggggtgggtggtgatgggatcagtgtcttggggggacataaccatgtgggtgactgctggggtcccctgatggcttccccggtgcagtggtgtacagttctgtcccacagcattggagaagagcttgtccccggtcgtgaagactgctgcagacatgttgtgtgtacttagttgctgaggagaaaaacaatacagggcacaatttcacgaaactattaggttttaagctgagtgtgtatttcaaagttctgtgatgaattctttcttttcttgtaggttgaaactttttctggtgtctataagaagctcacgggcaaggatgttaattttgaattcccagagtttcaattgtaaacaaaaatgactaaataaaaagtatatattcacagtactctgtttcagttatgtttttcaaaattccaaattcacggatgcgcagctgtcttcattatcagtggcgtcctgtgtgggccagaggatttcagtaggaggggtgtctgtgccagaaagcttgatgcctgtgaggttctgcttgtattcaggggtacaagtgtcatcacgtgatgctgcagaaatggctgaatattggcacttttgcatggttcaaactaaaaatatagcaggtactttttttattgtgctatacgtaaaatttaccatattacccatttgtaactttacagctcagta

SEQ ID NO: 92511 - DNA, 1039 bp, Homo sapiens
ctaagacaagaagaataaacacctgaggaacaagagtcctctgagcagccatgcctgggacagccacactgagagcagccacctgagatgccagagtcccccacgcagccatgcctgggacagccacacccagagcggccacctgagacgccggagtcccccacacagctgtcctcaggacagccacaccgagagcagccacctgagatgccggagtcccccacgcagccgtcctcaggacagtcatgccaagagcagccacctgagacgccagagttgcccatgtagccatgcctggcacaaccgtctcagaaacacatgattaaggggtaacaaaacaacaaacaccatgagaacaaaatgtgaaccatgttgtgaagaaacagtcaaaaactagaaaggatagcaagacaaatgaaaataaaagcggacattttttcacattatactaaagaggtatgctggtggaatattaaaatcatgaatttcatattttggtggcaagactttaagtttttaaacacatgttgtaagccgaaattcatgtggaattccttcctctattccctaactgtgcaagtctgggagggaagagggttgttagcgagactgggtgaatcattgcccgctggggccgaccttcccttcttacactgtcaacccacacttggcattctagagtgacttagccactttgcgaacggcacatgtttacatagttatctctaacatgttctccctttttaaaagcgaattaaggcatattataataattatacatacctatttttatctatacacaacacacgcatctatgtacatgcatttgccgatataggtatatatatgccttctatgtcctaaatggacagtagaatcctatgtacatttttggtggctaagcgaatggactctcaactcaatatacagttttggcttctctcctctttaagggtatgcacgaggtctgtggctcagtttagagctaataataataacgaactcacaggctgttgggaaaattacttaccataagcag

SEQ ID NO: 92512 - DNA, 1033 bp, Homo sapiens
taccataaacagtgtggaaattattagtgcatattgtttaaagtcttcagaattaaaccccttttgcagctctgtacacacactgatgttaagctgggcagtggttttctgaacgaggcctcctagcaaaccattttcacccttcctcctttcacttcttcataacaatatctattcagatcatttcgggaactgtaagaaatctctttatctattggactactataattagataatcatgtgttttacccacgtgccttatatctggtctttaactcacaaatacttgtcatgtccatatttcaatttgacttttcttacttaatttttatcataaaatttgtcaaagatgagttcttggctgaactggatcacagcccttctagtaaataaaaagtcatttctgttttcctgcttacagatcctagactatagcagtcattcctcatattattttagagtcattgtgttgagctgacaactgtaaattaatgtagaggctgagacatactacaagctaatgatgttgaaagtgtatgttaaaccatggagacagtatagcaattttggactaataaccattctagctggagtgagaaacgttcttcctaactaagaaagttctgtcatttttacctaatgagaataaggaagctggacgctgagcttcttataattaatgggatgaggaccggagtgatgcgggtccgctctcagtgtgcgcgtgtgctatgcgactcccttctcaaagatccaggattaatagctgccttctggctgttccctgaacgtgccgtgtgttttcacatcccctacatttgctcgtgctcttctattaggaagctcttttcccctgctcctttgactggtcaaaacctacttgccctttgaggctgcctcagaccctatctcctttgtgccagttgtgtgtttctggacaacgttgtttgtatttcaaccgggttttcagcagacagagcctgcctcactaggaatgtgcctgtctcctgctcctgaactctttatttattat

SEQ ID NO: 92513 - DNA, 1017 bp, Homo sapiens
ctggcattcatattccttttaattaaggcccctaccaagaaatctggaggagaatattacatagctcaggggccctcaactgcaaacagtctataatatatcaggaggatgttttaattggaataaaaggggcaaatcttcaaacattacatgtttaatttataggttggttgaatcacccaagttcaataatgtcccataatttctcatcacccccagagagtattctcttggatgaagatgattttcttaccaggagtgcacactcagctcatcctctcctcctcgtggtctgttctctgcttcctgctaatgcgcaggtttccgccctttctctagttgtgcacagagctgattggttcttcacgctggagttctcactttgatatttaagttgctcaccgctctagggaaggttgtccttattttccaccaagaagagcaggaggaacagttggctaacagggcactcagcagagagggtacaggcaggtcccccgggagcagcagcaagcaatgcacacaggagggagggcgggtgggtctgcagcacgaagctgcaggattgggcccttgattgcatttacttttgtcacagacattttaggaggttgtttcctaggtgacttattacatggtattctacaaagtgaccacttcgaaaacagcctgcttggttttgagggtggaggtcatattgaagtgcttatggggggctgtgaatcacactgtttattatgaagtgtgtacttcaaatgggtgcccctgccccccgcaacccaggatggcaccttcactatgggaaaagatgttgggttaaatagcagttttaaacaaacagacccagagataatggtgcacccaaggagacaggctttaattggcaatctttggttgctgaaaaaccaactttggtctaacctagccctaaaactcaagcaaatgacaacagcaaacccacatagtctatgacgtaacatgcccctgaagacctgccctccaccttacctatttggc

SEQ ID NO: 92514 - DNA, 1053 bp, Homo sapiens
atttatatttataagaacctactgagcctgtagaaggcccagtaagcttttttcttccttcccttcccttccttcctccttccctccctctctgcccccctctcttcctcctcctcctctcatctccttcttccttccctccctccctgcctccctcttttccttctcctctccttcccttccctcccctcccctcccctctcttctctttcttcttttttttctttctttcgtgattatacactcgtaacaaagaatgtgagtacacaaggcagtcttcccacttcgtagagttgaatcttctctgtggtaagacaatgtgcgctgatgcagttctaatagttaatataaatagggataaaagtttgaccctggctactcattgaacaaataaaaattaagccagtagggatagcatttctcatgtataatattgataaatataaaaataatcatttcctgtgtaggaaagtgagcactcccttttacttgggtaggcctaggtgttgatgcggtttttctgaaggacaatttggccctcagatgtgtttgtaatacatctgcaaacgccatgattagacactatccaaaggaaataattaacatttaaaggcaaaacttttaattttagatgttaataatattcgaaatgggggattttctaagtaatgatatggagatgattaaataaatatggcccacctatacactgaaatactatccaaccatttcaaaattttataggtgaatatttattgacatggaatgttgttcacaaagttgtaagtttcaaaaggtaaaatgggttataaaatattatattacgattccattttggtaagaacatgtacatgtgaacataaaattctgtctggaaaaatatatactgaggtgccaacagagggtgtatctggtattgtgagcatttttgtttaactctctttttgcttgcctcttattttttctttagtgagaatgtggggttttttttatatacataaaaaagatttatcactatgtaacccccttccaccttcaaccacttttctctag

SEQ ID NO: 92515 - DNA, 1044 bp, Homo sapiens
attagcttgaatatcaaacatttcattaaatatttcagtgctcttctaaactatataaaaggtttggatgaactaggtttgaaaaatcataatggcgtacccactcaccaacaccacttaaaagcatctgcttatccatcttgtcctcctaatgctatcacaaccttcctcattgagcaagaagccatttctgagctgcaaatacctttcagtttgtttctggggcttctgcattatctatctaactgagataacatttagtatgtataacttatacactatttaaatacttatttattgctttatcagtgttttgatttgttattctatggtaaacaaatgaggcatagatatcacaaaggtttcatgttattgatcccctgacctgaatttttgcatctgtgtgtttgttcttctcacaagaacatagctcttactccttagagcagcaagcagagaagattagggtgacttgcgctgacttcatgtgaagcctggaggaatcaatgacacaaaggaaagtgagtgtgagcatgacgtcaagtcagaccatcattcctgcatttttgctggaaacagctgtgtccgggtggccaaggaacaccagagtgggttggccattagtctctttggtagtttgccaaatcatacactccagaattaagtgacttcaatgctgatactctgaaaggccttggagtcatatttttatggaatagcattactatattttaagcattctctacttccatagcaatgcttctgcagatgctatatgagaacaggtgtacacacatcagaacattttctcccaaaccatgctattgcttagagatagtctcatgttaagataccaaggcccaaattatggtgctggttccttcaaagaacagagtaacaaccatatatatagcacattctatagcattttaggttcacctctgaaacaaattcacatacaaaaataaacaagtagctttgccaggaaagaaaggtctttcctgttttgaaaaacaagtgatgaatctgtactcgctatagact

SEQ ID NO: 92516 - DNA, 3225 bp, Homo sapiens
ttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcgggg

SEQ ID NO: 92517 - DNA, 2643 bp, Homo sapiens
ccgcttgcttttgccttactcgatcttaccaccacccctcccccggccccccgactgagaactcgggcctctcacccgccccccagcctcccgctctgggcgagcctcctccccagcccccacccctgggatgcgaagccagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttaatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggcttttttttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcac

SEQ ID NO: 92518 - DNA, 2195 bp, Homo sapiens
atttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttcacttgtggtttttatgtgacttttttctagttttgcatttgataactgctgtttaattctgaaaatgttgtctcaaaccagatgtcagggacaggcttgaagattcctgatgtctcagcacccagcacggctgtcagcctcggcaggaggaagaccacggaaagtgagttttctgggcaggttggagagctgctgacagtgagaatgagcatggtgattacatctcaatatattaaactggctgatagagggaataaaaccacagacaaagtgtagaggggtagattaacatgttttgtcagaaatgtctgaagtagaaaatgaaggaaaaatatcaggggcagttgctgctattgaattcaataccagcaaactccattcctcagtgtctttttttttttcctataaacaatttacagtgtaaatgtattttgacatagaaatcattctgtattgagattcttgatataaaatgcttttatgagagcctgtaagtgatccttggaattattatcagattttttaaaagatgtgtttacatggtgagtgtgtgttgcatattaaatttggttttgtagaaacgtttgtgttgtattgtaaaaaaatctcaaagtgcacaattaacacagccgctcttaggttcttggttatgtcaatttccactacagaccaaagaacaaacatcagacctatctatggcaactttttctaataattacatcatttattcaatgtcttggcctcatttcagaatatttttgaatgtctttcatcttggtaggattttatttttatttaccttttgaaggaaacaaaacatagaccctgtagaatttttatctagcaaagaagttccttgcaatgaacactaatagatcctcaatatgtgtcaaattccccattgggactccttgtactatttgctatacaatttgcctttcagtgatgtggtgtttttcttaaatagatttttttttctaaaatttaataaatttatt

SEQ ID NO: 92519 - DNA, 1602 bp, Homo sapiens
tcaggatgtccactccaaagttcgtggtcttttttctagagaataataatttttaaaatccattgaactggccgggcgcggtggctcacgcctgtaatcccagcactttgggaggctgaggcgggcggatcacgaggtcaggagatcgagaccacggtgaaaccccctctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaaaatccattgaacaaacatcctgcgctgcctcctgcaggatcaaggctggggtaacagaggagtgaggtaaggccccagggaactatccccagtggatccctgctgccctgcggtgagagggggtctagctcctgcactaagagcctgggaagaaaacacttcccgtaatggggcctgggagatggaaggaggacatgccccagtgaatggggctggggttgagagttgagcctggcagataagatggatttgtaaatgaaatgccaggtagaaagtaagttggtgtagacgcctgtggagctgtgggagcccccaggagggaagggagggagtcagggtgtccctgcaaagggagtcccctttgcaagggagggggtgtctgagtcaaagcttgcaggtggggcaggtcagaggtggcaggaagggcctctgtccagagagagctgctccagcgcaggaagggggagggacaaggtgtgtgacaccgtgaactttcccaggggattcacccagtggctccaaaggagacaacagccttttttattgtattctcttctccggtactgagattagggaaccttgttttttgcacttttctaatgccttttacatttttgtttttatttttaaagcgtgcaaaggaaatgtgactagaggggtcagaagaggataaatcatgaaatctttgaattctaggccaagactttgggtttgactctgtgtcagtgggagccattgatggttttggaggaggagggtgatctgagccctgctttagagtgatttccgcggtgttgcgtggaagggaaggcatggtgtggtgtgccttactgtggcttccgagtcagacccccactggctgtgggcttccacctgcatcaggcatcaaaggctgtggatggattgaggacctcatgagaaaatgggtgcaaataacccaattttaatgggatggaaattttccagacccagtgcaatttgatttttgcagtttgtgtttttaaagagctcccgattctaatgtcagcaactctggaagaggaactaatgaagggcaaactcaaatgcacgatgcaggcacccccaggtcatctgtgccatgaggatttgggaaactcaaagagcattgtaaaatgcatatattttataaatagattccagtgccctcagcttgctagttggtaatccctgtatccagactgttgctagagtaagtcacgtctcctggggattcagtgt

SEQ ID NO: 92520 - DNA, 1574 bp, Homo sapiens
gcaaggaacccctggcttcacaggatgtgggatctcagaggcagcccagaggcggggaatggaatggagtgcttctaaggaagagggactctccgtgttttctctggggaattttctaacattgagatcgaagaatgaagttggaggtgcctttcttttctttaagaagtaatcatttccaagactagcctcctttctccgttgtttctgcattactgaaacacatgaataccctttcttagttagatgaagaaattaaattgaagccactgctcacatacctgctgggtagtggggctgaaggatagagcttattacaatttcctgacccagctgtctggccctgggccagcgtcttaacctccctggatggctccagttttttgaggataaaactgaggtgttggtgtaaatattttccaagatccagaaataaaaatgtactgttggatcatattttttttccaggagaataaatattacaggacgactcaccaagtacaaccattcgtaagggtttgtttgtttcccaagagaaaatattttaactttcagaagagtggattttttccaaagtgaaatggtgagaaatgaagctttgaggagggtggctcattgctgataggagccttcaccttgcttcactccacaaataacccaagacctgaatttaaaggtgcttacttcctggatgttccgtagaactggaaggcaggctttctctaaggagcaggcttataagctggatgcagtgttccagacaaaagcaagctccttggtggcatgcagtgtgtcaaccagtattttatcatctcaggtgtgtttggcactagaggtggaggaggtggttgatactcattatggatttgcctgatcttcagggctttgcttgcatcgtggatgcagttctcacacagccctgcagcacaggcgtatgttgctatccctagctgacagaggagcagagtgaagcagagagcagggatgttgtccaacatcgcacacacgtcgtcaattttgaagcctggctttgaacccagaggcctgcagataaggatagatcccatgaccttgaggaggctgtagtctagggagcgggaagctcaaacattaacagattgaaccgtggggtcagggcagcatgggaggtcagggcagagagcagtgggacccacaggagggtgcctggatcagccccgggtggcagggaggctgcctgctggggcgatgctgttggtctgggatgggagggacgggtcagagttagctaggcaaattaagagggacaaggtcacattctgggcctgggaacagcaagaaacagcctggggtggacagggaacttaggaccagcacacagggccgagctccccagctgccttaccattggcctttttagggtggctggtggtctctgagctgtttggacccagatttccgtgtgtaatacagccgctttcattactggcatctcctggaaggtcccatcagtgcattttccttttcactgttttgttttggagcgtctttccctatctgtgttccctccatttcctttcctcctcctccagttc

SEQ ID NO: 92521 - DNA, 1059 bp, Homo sapiens
gtgttcctgggaatactttttaggtttcccaagaactgctttcaggtaattctgtggagcagggcatgtttattgttgatgcatggtgtgttaaggtcctctggagggcagaggagtgcagaatgcagcaagcttgactgcctcctgcgagccatgcagaggggacccgcccggtttttcttgtttttcttttttttttttttttgagatggagtctcactttgtcgcccaggctggagtgtagtggtgcaatctcagctcactgcaagctccgcctcctgggttcacgccattctcctgcctcagcctcccgagtagctgggactacaggcgcccgccgccacaccctgataattgtttgtatttttagtagagacggggtttcactgtgttagccaggatggtgttgatctcctgatctcatgatccgcccgcctcggcctcccaaggtgctgggattacaggcgtgagccaccgcgcccggcctcctgctttttcatagtgtgtctcagactccagggtgtgtcacctggctggtgatctggtgggttgcaggagtcccctctgtgcaccctccgtcgctgactggtctgcagcctcctctgcaagtttccagcattctagagtgaactctctgatgtctgcaccacctgctcgacccctgctacagcctcttcagtgaggtctgcccatatcctctgaatgaaagggggcctgccagggaggcagcagcgcttcctcatgtccccatttgggtggtaggaagtgttccctccacagaaatactcagatgtctgcatgaagggactctctcctcaagttcaaacattcactgaaacggaaatgcgctgaagctggaatcaatgcacacctttttttttgttaactttcttgggaagcttgtgtgttaagcctgtcggtgtctgttaacacttctctattcagagacctccagccacgctcgttgcccaagttacctgtgagcccgcgggttgagtgttcaagcctcttcctgccttggctccagcctgtctttccagggctgatctcagcagctgc

SEQ ID NO: 92522 - DNA, 1070 bp, Homo sapiens
gtggtgccagttgtgcactcacaagcataacacaggctgtgtgctccaagggagcctttgctttgggaagggtgtgggcttccagagaccttggggctggctctttgacggatggagaatgtcaggaagcacctgggtccttctgtgagttttctggcgacctcgattgccacacggcgaattttgatagcgtatgcactggagctttgtagcctagggcagtggcatccaaagagcttccaggagactttctgagttggcaccttagatctgaactctcttgactaaaacacttgcatttccttctaaccacttggcagaagtaagtgattgtaatccctggtgtggatgggatggggctggctgtatcctcacagatctcactcacagattgcaggcccttctctcttcttcttgtctcagtgaagcactatccaaggccctgaaaactgagccagtctggtcattggtggccggcagagtggtggatagggccaggtgtattaggaaaaagaaaaagaaatctctttatttaatccattgtgagacactaagaaaccatctgtgtttcagcttctgtcctcccccttcccccccagttgctctctttactttcttcttgttatcatgtgtaggggtgaaagtggccagatatgagagtaagagttcccatttatccaaggacagaagcaggcaggaacctcaggatctgatgtgggcaagccgcaggtaaagggcaggttcaaggcgcagaatacaggtagatgattctctctgatatctgcctgcatcttcatgtggctgtcttctctgtctctgcgctgggggtgcacctcttctcacaaggacttcagtcatgttggattagggccaagcctgttgatcccatcttctcttgattgcatctgcaaacaccctaataaggtcacattcataagcatcaggggttaggagttcaatatatcctttgggggagacatgattcaacacacacgtgtgcgcacacacacaaacacacacatacacatgcatcaatacacacaacacatatatatgtaccagtatcaggc

SEQ ID NO: 92523 - DNA, 1005 bp, Homo sapiens
ataatatatatagatacacacactttatctatctgtatatacatacatacgtgtatatatatgtataatttatttttttgagacaggatcttgctctgtcactcaggctggagtgcagtggtgcaatctcagctcactacagctttgatctctggggctcaagcaatcctcccacctcagcctcctgaatagctgggaccacaggtgtgtgccaccacacccagcaaatttttatattttttttgtagagggggggatttgccatgttgcccgggctggtcttgaatttttgagctcaagcaattctctcacctcggcctcccaaagtgcttggattacaggcatgagccactgcgcctggctaactatatatatttcaaccaataaatccaccttatgtcataagtggacattttgctgccatgggattgaaatgaaacaaggaagaaaccctcctattattaataaactggacaaagccatgcaagcaaccacattgctcctaaacggctgccctcccaggctgacctgataccatgcacctgcaggtctgactgagtactgttcatgtcagaactgggacagtgtgcccggcagagtccagaagcatctcctagtgcagcggtcgtggtcagtgcttgagcagagaaggcaagactgtggggacagagacaggatcctgctcaagacttcaggccccactggatttgtgaaaagacctgtgacttctctgtaaatgttcctgttttattcatctctaaagtgagaattgtaccagggttacttcttttgtgggaatcctctgaggattaaagaaatcatgcctatgaaacttcaaaggaaaaccttgaaggcctgtccaaaatgcagattaacaaattaccattggaattacccaggtcagaagctgggttttgggaatggggagggacaggcctgctgacagcattcagagtccactgtggagaacttcattggctcataaaagactgccctctggtccac

SEQ ID NO: 92524 - DNA, 1681 bp, Homo sapiens
ttttcttgtttgtttttacatttaagttgtgttttgtggcctggactcttccctttgaactaaaggaatgtgtattctgctattgttggatggagtattctttatcaagtagatcgagttgattgttagtgctattcagttcaactatgttcttattgattttctgcctgctgaatttttccattcctgataaaggggtgttaaagtctacagctattagtagtggatttgtctgtttctccctgcagttctgtcagttttgccatatgtattttgatgctctgttgtagggtattacatgtttagcattgttatgtcttggaaaattgatctctttattattttgtgatgaccctctttgttgtgatgatttttttcttgctttgaactctgctttattcgaaattaacatagctagtccagctttcttttgattagtgttagcatggtatatctttttccatccctttatttttaacatgaatcttcctatttgaagtaggtttcctgtggacaatgcaacatgtagttgacacttgctattttaccctccctgaatatctgtaccttttaactggtatatttagaccattcacaattacacacactttaaaaatagaaaatactgtgtattgctatttggagatttttttttccttaatatattaagttaccttattcctttacaaaattacatagccaaaggaattgctttctaagttctttaaaattggtgtgtgttttatctcaccattctaaataaactatttttttcctgtggtaatgcctctactataacaagcttctcattttgtgcctaatttggtatccggtcagataaatcaattggttctttgtgagcagtttaagcctaagactcagcttcatttttatgagtgataccttagaatcaggaatgacggcagaattagccaaatgccttttatcacaataagagaattttaaacaatactcaatcaattgataaccaatgaaccaacaagtttgttccatagctataatttgacaaatatctccactgctgaagagtgtattttgttttcccccagagaagacaagtgcaaaataactcactgcagggcaactctaaagggatccctgtgtttcccagtgtacagactattagtatacgatgcatgcaaacagagaggtgctttattgaagcgggacaagacctctattcatagtaaagtcaaacaaaccacgcatgtgaaaacctccacttatagcggctgcataagcttaactgcgcagagctatactgctttttgaaatactaacttgcaagttcagcaacagctaagaaaacaatcctagacttggaaattgaaagattggaagagaagtggagggattcctttggaaccctttacgtacgtatgtgtaaggaattgtaggtaagtgggagggtctctcttgagcagtattttgctgtgatcactagtgggcacagagtctaaaatgttccttcattatggagaagagggagaaaggctatggagaaggaagagcctctactaacttggatttctatgtggatttcagagcagagcctactctaaggatttgcttcagggaggctgcaatgcaaagaaatgctgtctttttgtgggattttaatttagagcttgcaatatgttatacttatgagatacaatcc

SEQ ID NO: 92525 - DNA, 1035 bp, Homo sapiens
tgccaggcaggtctgcagcaagattgagtgacagtctgagatgctgctgtacttctttgttcaactgtcaaactttgggagataactttcctcctagctacaaaagggagattatataacttcttatgctaacccccacttaccctctttaactgcacatggcttcgtgtgtttatcacttattttttcctttttagaataatttttcaggtggattgggtggaacggaaatagccccggggggtttgttccttgagctaattgctgtttcttggagtggggctgtgggattggaagattccccttgacaatccttttccttttttggttccctctcttccaggcctctctggcacataaaccatcttaccttagagatttactgtttcgtacacatgtttcgcaggaccatagctaacaaggctgccagctgtgtctcagggttgtgttccaccctgggggtgcagtgcatcccaaggagtccaaggactgcggttctgttcctgagccacgtccaggcccaaactcccagagaaaaggacctacagaggcttgcatctggcaaagcagaagatccgcagggaagagtttaattctttgctagaaaggtgcatgccctctaacagtgggggtaatagttataataatggtagacaccagcaccagtgaagcccaagagatggtcacgtttatggtttgaagagtaggattctggagccaggttgactctgtttgaagctaggctcttgacatttactaactttgtgacgttggacaagttggggaactttaaagcctctattttcttatctatgaaatggggatgaatatgcctgcttcacagtttactgaagggattaaatgaggcaatatacaactaatgcaggttcagatggtgccttagtaactggagctagtgttaagtgttggcgatttgcctacgtggttgagtgtccgagctggggttcaaactcagtggcttctgatcccagaagatgcacacttttcagtataggatgttgtgtctaatattag

SEQ ID NO: 92526 - DNA, 1144 bp, Homo sapiens
accggcccacctgggacctggccctcgacccgctggtgtcttgcaagctctgtcttggggagtacccagtggagcagatgacaaccatagcccagtgccaatgcatcttctgtactctggttggtctttttggataaaatatatgttacagtgattttaggatgagctttttgctttcatttgcagagacactaggcaaacctttggactacattttgcctgacagtggagtcttcttgttgaggccttcacacagttcttggaagaattattctgttagtcaggcaggctcccagagtggaagatttccattacagttgcttgtggtgcaaaagcaatcggttaaacagaattttagaagctcgtgataacaattcacgaaacttatcatagcgcatgttctccttgctacacagcaaaagcttccacaccttatatcaaatgtattttaatagtcacatgtctgaggttatggcagtgctaacctagtgattgtgtgtagctagaatattcagtcctcagtgtcatctctcactggcttagtgctaaactagaatatagatattttaaaatcacatttaatatttgttatgatgtagccaacattcttttggggccagatgatccttcggggcttaatgaatatggggacttctaagtcaagaatctggggtttgggtcaaactcaaatcccaaattttatctatcggaaaagataaatgagtgtgtgaggtttacttttagttaatctcattgaattttacttgttttttctgtccattcaaggaatgaaaaaagaaaatgagtgcatagaagccggaagtaggacggtagtttcccggggtctgcagggaatggggagatgtaggtcaaagggtatgaagttgcagttatacaggttgaataagttctagagacctaatgtacagcatgataattatagttaatcatactgttttgtatacttgaaattttctgtgaggatagatcttaagtattctcaccacacacacacaaattggtaactctgtgagatgatggatatttaattagcttgatggatttatgatgtatacacgtatacaaaaaatgaatatcaaaacttcacattgttcacttgaagtataaaatggacagtctttat

SEQ ID NO: 92527 - DNA, 1048 bp, Homo sapiens
tcattttaaaaagtacagaaaagaaaaatgaaaaactgtcttcaaaaaaaaaaaagtgtcttctgaatttaactgctgttgtatgtggatggtgtagacggcttccctgtgggtttttcgaatgcctggattataatctgtcactcgaacagtctctcccaccctgtacactgatgcattcatctttcttgcatagctttcagactgtatttcatttgcacctcatgatgtccttggtatgtaggcacagcaaatattttatctttgttttatagataaggagagggagctttacaaacatttacatctgtgtcttctgtttcttgtttatgctagattcagcctttcttaagggcagaaggatttctggcccattctgtatccacctagcacctagtttagtgcaggacccagaagagctaatcagtaaaatctcacagattgaaatgaagtgtattgatctcaatactgtagttgccatccaagaaatgtgcctcattaaagcaccaggaagacagctccaacctagaggaaaggaagttgcttttgacattgttctgagatggagaaggataggagggagattgatctccatcctgttaacaccgtgaatggggcttattgtcatttctagatgagttaggatggtagaacccgtcaagatggattcaataactagccttatgcaaaatcacctcctcttacttgaaaggacatcttcccaactgatcgaatggctccccctctgccaaaaatgccttgtggggggtgggggcggggggcatttgcagtctctgcagtcgcctgcctgctgtcagaggccatagcttgtgttcttacccttgaaatagttcattctccctggcttttttgctgaggccttcatttttgttattgttgtcttagttttctatttctagagaattgtagtaaaaacaaataagccactcaaattgagaccaaaagcctaaccaaagtcagtggatgtgaaggaagaagctagcactgtgttctccgaaagaggctgctggaaacaccaaaaaaacag

SEQ ID NO: 92528 - DNA, 1615 bp, Homo sapiens
gtttatagacacttctctgtttttctttcagtgcctgaaacagtatgttgagctcttgatcaaagaaggattagaaactgcaattagctgcccagatgctgcctgccctaaacagggccacctacaggagaacgaggcatgtgcaattgaacagactgggctgtttgatgtgcacaggcgtgcactgctgaacttgtcagaataacgtgggttttgtttgggtgtgcgttgcattatattctagccctcagcttgttatcattcctgtttgcatttttttttcccttagattgagtgcatggttgcagctgaaattatgcaaagatataaaaagctacaatttgaaagaggtaggtgcctggtatatctgccggttatgattcctgtaatgtgtgaatgtggataattttgtggggagttcttttggtagatatggttatacagcatttgataggagttaaaaagttgatgtaaaataaacttctgaaattaaactgacattctggattctctgaacagctcacagtttgaagaccttgtctagtgatctatttggtagcaggaagaatttatggaacacaatttgtttataaggattgaggctcctgggggaggcttaaagttgatggctctcttgaggtattatatttcagccagcttaaggctgagtttgagggctaaactcttggactggcccagaagttaaaagatgcagagtcatggagggaagtcgtgagggtaggcatagcagaaattacagtaacccccgtcctaacaacagtccgatggtaggtgtcctgtctgcgcttactcaccactggacacagacctagatagtaggtggtgaatgaataatcaagtcccttatcccagtaagtgtcacaacaactctgcaaagctaatttgtcattatctaataaacggatccccagagaggctaactgacttgccctgatttctaaatatagtgggtgctttgggaccacatcccatgacccttcatcgtgagccctccactgggccctgaatagtccttctggctggagcaggcctgatgcagacccaggggtcctctgggagagcagtgtggcaggtgcacacagagcagaacatgattctcaggataatattgcaaagcattaagccatgtggaatgtccaggagaggtctttagctctgctctctgaaatactccggggtcatacaatgaaactgtaaagagtctgtggactctctttggctttgttttcatatctattctgggccccaggcttgtctggtaaagagcagagtgacagatgtgtgcaggcgacactccatatgcagaacatcattgtgtggaccttgcaggcggattctgagtttggattgctggcatctgctctccctctccctgcactgattctcgggttcttgacctgagcagggtctcaccactgagacacagccctggagggtgggcttacatgaaaacatggccggatggggagtggacggcagaggagaccagaggacaatatccagagactcccagtttagctgcatgcagagacctgttgtttgtatatttttgctttctaaaagaaatgctagagatagctgggcccagtggcat

SEQ ID NO: 92529 - DNA, 1105 bp, Homo sapiens
tgcatttttaagcagggagttcttaagagacctgcttcattaatctgccatgaatacgcctctgggagagaagagttaacattagtttcctctagtgtgccaaaaagcatatcatttgctttgtttgaaaatatgtctcatacacacacgtgtgtagattggggaggataatgcagaatgttaatagacatctacgcctcagcctggggccatgttcacagggtgtgacatgccccggcagcacaggaaggacatttgcagtctgcagtcagagcggccgtttgtccctgaccttttcgatagggaatctctccatgtgaggacaggcagtgccgtgtcacagctatatgaggacaaaactaataagatttaaatcgttcccatggaaaccttagccaggtctcccctgtgtgctatcctggggggccttttgtgatggggatgcttaatagcatcccccactgttgagccaggagggtggacaggaggtggtgcatgacaaatcacgtgcatgaagagaccgagacccagctttgggatgtctgctccttgctgatgtcagaagctcctactgcacaggagaggtggggacagcagtgagacggaagggtccctagcaggcagcgctgcccttctggatctagcctcagagctatatcgggaggagagcaaagagcgggtgaggatttctcttcccgcgcagcgtgttgtttagtgcacacagcacttgcaccctcccgcagggctgggcagacatgggcctcctatctcatcagggacaaagctgggctcaccccacagcactcacagagggcaggcagagagttgtcggaggcatcgcggggacgggatgggagcatgacccaggccagctgcctttagcctttggcgtttcctcctcactgctcagcgtggcgctcagtgccccaggctggcatgtgcaccccctccttgctttgctgtgactgtcagctcaggggagccccaggcatctgcccccacacatgtgacccacagacaacaactgcgttttctcaaaaagccattttgtcagacctgacagctaggaacattcttagaaaagcaaatgtggaaactatcaaca

SEQ ID NO: 92530 - DNA, 1852 bp, Homo sapiens
gcagccaataatttaaagaaatgcaatttttggacaaggatgtgaagaaatagatgtgtcaaagtgtcttgtttttagaaataaactttgtggctaattccattaaattgggcttcttagaaatgtgtgctgtgatttggagagaaaatctggcccttgaaggattggtttcactccgtagttaactcgtggcttggatttgagaaggggaggccatcttaggcaggtgaaccatttggttagaagaacaatccagccatcttccttccctcttcctctcggtcttctagcagcattttcctggtgctggctgtatgcccaacatggggccatcaggggtccagcttcagaaaactgtcccctaggggaggcagatgagctagcgccatgtgcattgctcagagaaacccgacaggcaggtgggccaagctttccaggatgtggaggcctttgagctgtgagctgagtgtcagaggcaagcagggctgacccagggctccaagggcattccaggggcaggagcagcattcctgagggatgtctgggtgtctggaggtctgttgcatgaagggagaagttgggaagagctacagcggaggtggaggtggaagggtggcttgggcggtgcttcggttggggctggtggtgctggctgtattacctggacatgttcctccctgtccgtgcactgaggggctccttcctctgaagcccacatgaccctctggcttaagtttgatttgtccattttgtctcactgtaccagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccaggtaccctttgtacacaagctgccaccaaaggcatggctgtgggccaggagaagcaggcatgctttcttcctaaaagtgctgttacagtgtaagtggctgtggctcagtcaaccctaacacacactgtacctcttgagcctcactcaagcctgtcattatttgtatgtctatttatttttgagaactgactatgtaccaggcactgtgtgaggccctggaaatagaaaggtgtgtgagaaccacacttaacacggcttggctggaatgacaaatgcatgcgtggtttgttacttttaaaggttgcaagtcctgcagtacctgaagtttctgcaagacttcactgtgttgaaggtgatctgaaatgggggtacagaaacaagaacaggagtagggtgcactggtcataaatactgtctggagggggatggggagacactccctggtggcggcctcccctgcagccatagtcgggctgtttgcccaggagaatgctgccgcaccacgctctgtactttgacatttcgtaggttgatgcataggaaattcatcatatccaggtctttttctcctacaaaatctacaaggtcacgtggttctgctggacacttgcccctgctcctgttgagtccaggatcctcatagaggagctgccactctacccaccaccctccccagggtgtgctcaccagctgctccctgtgcgccccttttcccattccaccgtccccagctcctgttcctttccgtgtgacccctgtgccctgttctagcccccgaccctctcagggtccctgccacacacccctggtctccttccgggcgaacctctcttcccgtgtctggagtgccctgctctgccctcctcctttccctggggg

SEQ ID NO: 92531 - DNA, 1056 bp, Homo sapiens
cctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgtattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaa

SEQ ID NO: 92532 - DNA, 1063 bp, Homo sapiens
caattgtgtgtattgctgctgagattgccaagtggcgctaagcacagcactgcaggtgaacctgataaatcctgttaagttctcaatgcagctactgcccacttgttatgcggggtgatttttcatgggctggagatatatatcaggatgcaaggtgctcaatttgggccagctgtgttcataaccagacagcactgtgatgaatgctcccagaaggaaaccaaagaagctactgtgatggaggacagagaacacgaagcactgtgcagaaaatataggaaaagggaggcttaacccaagggccctcacttagtaactggtgagtttcgccaaggttacgctctgtgattcttctggtgaatgcgccactgaagtacacggtcccttaagaaagtgcatgaggttcccgcacatgcccacctgccgccgccctcaacgccttctggcaatgtcccctggccttccagcagcatggcgacgtcttcacagtaccgccagctgctcagtgactacgggtcaccgtccctaggctacacccagggaactgggaacagccaggtgccccagagcaaatacgcggagctgctggcatcatcgaagagctggggagggagatcagaaccacgtacgcggggagcgagagctccatggagaggatgcagcgcggcgtgattcacgctggaggactggtgcgggagtgcttagcagaaacgcaacggaatgccagatcctagctgccttgttggttttgaaggatttccatctttttacaagataagaagtcacagttaatctcccccattcagatgaaacccttgttttcaaaatggttacagtttggtttttcctcccgtggttcacgtggctctgaagctaccgtctcaaagattgagaaaagattttgcagttaattaggatttgcatttcaaataggaactgctcaggtttctgtttgtttgtttgttgtttttaagcactgacttaaaagatgcacctaaagttatcttacagcaaactgtagtttgcctccaagacaccattgtctctttaatcttctcttttg

SEQ ID NO: 92533 - DNA, 1052 bp, Homo sapiens
cctctgacaaaggcgcttgggaggagcgtgtggagcaggagaagagtgcctgggagcaggggtcagcagggacaggggccaggtctacgcagaggatgctatggtggccaaggggaagggctgggagggggctttgcagacttggagaagctttaaggtggtgggtacagaggcatgaccagagaggtcggcccaggttcctggtgctcctgcttgtatttaattcctggcaccctggggtctcctagctccaggggaggtgagtgatgtgctctggccaatgggctgtgaactgtgctgattggatccccgctgtcctgcctgccccagaagatgggaagccacgtgcccacaagtctgggtcccaccatggcgcagccccccatgggcccaggccctcagcctgtggggacacgtgcagtgggagagggtggtctggatttattcagccacagagactcctcggcaacttcttatcccagctccatcagcctgtcgaggaggattaactaggcttagaagtagcccatggccttgggaaggacgcattgtatggggttgggaaacacaaaagcacgatgagttaatgtttatgggaggggaggtggggagacccaggtaacaatcgcgggtggtagtccaagatcctgcggtgaccaccagggcagagccgggtggggcagtggccacggaggggcaaacgctgcgtggggggaaactcttaacttcttgcttccaaacgaaagggtcccagtttgaagaacttcccccgaccccctgcccccccgcccctcagtttcaagtgtgtgttttatccattttcttgggaaccatattcctgaacccctaagcacctgaaccctaactaatttactctgaacccacctaatttacctaacttaccctgaacccctaagcacctacaggttttagaatgatgaataatccattttggataaaggcaatcatacctggattcagccagaataggaacttttctaagcagattttttggaaaataaaattttgggacttttaagttgagaaatcag

SEQ ID NO: 92534 - DNA, 1055 bp, Homo sapiens
cacgttcgcgcgccggcccctccgcagcgagccaagtccatgacttcagtgaggaggaacccgcctgcctcgcaccacgtgcgctcccagctggggcagccgccctgtgagccctgtcccggtccctgggacgggctagggcctggccgggacgcgcttgtcctgggcacaggacaagggctttggggcacagccctttctcggccggggaggcaggcgaaccgatcgcccgggcactggtgttacccaggcggcgccagcgcgagttggctggtggacaggtttttcaatagtttgaactccttcttccccttgccgcatctttaaggcgtttactcccagattcagccctctcctcataataatgacagtttgcagacttttcctttccagttagagtgcgtgcgcgggtcctgcaagatcccagccgcgcgtcaccgcgaaccattctgcgggaggggcaggacctaaggctgcatctccaggagggaacgtggagacaccgcgggcggaggggacctggaggagttcctggaggagcagtcctaggcacggggcgaaggatttgcgctctagctggtggagcgcacatcgccctggttagctctgcggtgggtcctgggctcatcccggcctcttcctgcctccgctgacatcagggcctctcctgtttagtcctaggcctgcccttcatcaggactccgcagaaaaggatgggtaaattaaggcatacatttaattttaaccatcatgcctgactttctaggattctgtgtgaagaatacagagacagacgttccatttcaaagaaaaaagagcaacacgaaggccctctttaaggagagagtaaacattcactttaggtaaaaaatagtcttttacacgcctgtgcacggcacacctcttttgctgttcaccttgagcccaagagtttggaaaggctgcccccatttcagagaggaagaaacgcaggcacacgtgaatgacagactcctctgtggtggcctagactccagccaacacttcctaggacagcctgccattgtgcaaaggtg

SEQ ID NO: 92535 - DNA, 1024 bp, Homo sapiens
aagcttggttctgtgcctcagggctgagtttaaagccaagaatgagttgagtctgggagtgtggaagcactacctgtctgagtgggcgttaagacgcttctctggagtaaatgaaagttaatcaggagaagaaaagaggctgtacagaattcagaacatgatttcaggtttaagggaaggcagaaacacccgagggttactgtttgcacagggaactaagctgtcacctggccccgggctcctgaggcctccttggcttcgcctgcgtccacacctgtagcccccccgccacaccccacccacctccgggcctccggagacggggctgggccgggcgcattttcccggacttttcgatcgccctcagccttgactgccgccctggactggaaggaagaggcagcgggcagaagcctttcccagccaaagaccgcgggtggccacgtgctcaagactggtctgcgttttcagtcccggggcgcgaggtgggctgggaggctctggaaggcgggtcccaggtggacgcgaaccgggggaggaagggatccgggcggggcagcagctcacctggggcggaacaggtgttcgggcggcgccaccgaggagtccgcgcgtctccccgccctgacccccgatcgctccccgcgggcgctggcgctggaggagggcgggggccgtggagccgcggccgcccggatcgccctgcggacccgcgccggggactgggctctgccggggccagcgcggggcggtcgtgtggttgatcatcatacccggaggaagccctgagggccgtaggggcgtcttccccgtcgcaggctacccgcggacctggcccccaggtccccgccacctgtcgccagccgcggccccggccgacctctgcgcggcggggagggaagcgcgctctggtcccaacccgacccccgcctcgcctccgggagaggcgcagacgccggccgcacgctcgccccccagccacggggacccgcgcgtagtccgctcggacggccctggggagcgt

SEQ ID NO: 92536 - DNA, 1468 bp, Homo sapiens
gaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgtttgttttgtcacatgtctgaagtttgttaaagactttcaggttcatgtacagtcatgcagttggcagaagtgttctgaactgctcc

SEQ ID NO: 92537 - DNA, 1050 bp, Homo sapiens
ctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaacttttt

SEQ ID NO: 92538 - DNA, 1032 bp, Homo sapiens
agtgggtgggcattcttcatatctgtatctaatataacggataaacaagtttgccaggcctacttcatttagaacgttgttagtgaccaacacgcttatgagaacagatgtctttgtcccctcccagcagcttgtgttcatgttcatattttctaagattagaaaacaaaaactaacagttttgttgttgctcatgacagcataggtagttttggaaataggagggttagttcttcggttggtcccagaaaatgcctaagacatttgggaaaatatgaagtggctgatgttgttcaaattcagcttgtttattgtattattatatgggatgataaccttttttttggtcagcctttctggtctctagagacttatttaaaactaaatataagcatacttggcaatcactagtaattcagaatatttcacattctgtctttatacccataattgttttaatttttactcaggcaaacataaatggccgtgtgttagctcagtgtaacattgatgagctgaagaaagagatgaatatgaattttggagactggcaccttttcagaagcacagtaagatatttgtaacattgtgatgtttacaacattattttatgataacattcaaaattatttataacattgtagaaaaccagtatcaataagtactggcctaaactggtatttttttcatatttttttaaatttaaaaactgcttcttacacttatgtgcaatcctgtgttgtggaaaatacacacagcagcacttggcagcctttgcctttttgggcatttcactcagagatttggggaagaggccgcctgccggttcttcatgctttcacctgccttaactctcatcaggctcctcaaagccttcgaggccttgaccttcagcattcatccttatagggcttgcattgcccaggtttagcaagaatcctgttaagtcagtttacatgtgtgatcaccctcagtatttgatcaaacgcctcactaacccccccacccccaggtgatgtcggctcaccctgg

SEQ ID NO: 92539 - DNA, 1303 bp, Homo sapiens
ttgcttaattgtctagtataggtactttaaaattattttgtaggtttattttttgtattcatataatattggcatcagtagttttccatctttttgcgtgtgtgttttttttaacctctcttcttcctcttattaagcacggcacccttctctcttgagattaggcagtaaacatttgagaagttgacctaggctttgttcatgaaatgttctgttttcttagaaaaaatggttttgaccaggctgtatcagctgtaataaaagctactcattaggttataacagtaactaaatctgttccctaatggtatttccttaccatgctaaacatatttgtttttttttactttacttcatggtataacttaatgagtttttctctgtcacatgacctcattatagatggcattaaatgcttattcatacctgtatttttccttgacttctctaggggtcaggcccagccccaggcccagtggtattactgaattcactgaatgtggatgcagtatgtgagaagctgaaacaaatagaagggctggaccagagtatgctgcctcagtattgtaccacgatcaaaaaggtgaggcagccacttacacacggaccagagacagcgctgggggcggaagacaggactgtgtgggtcgtgtaaactttatgtatagcttcccaaacatgcattccctgttaaaatgggaaagctctaaatggaaaacataattcttactagtttgtattctaaaattgccctgttttctcttattttataaatggataaaataaaataaagtagctgtcttaccatgttcttttttaaatgacgtaatacaagtaaagaatgccttgatgagaaagagaaagctctgagggattcccattgggataaacagaactcatctttccagtgtggaaccgaaaacctttgtgttacatttttttctaattgtaatatttgttagtgtgatttagtgattatcaaagtaagccacacttgcctcattttctccaaattctcattttcatgtcatgtaggacttaggatcatgtcacatttgatgaaaccacataggtttgggtttgcaaggttaatgcatttgcatagtttttttttcttctaagatcctattgcaattctagcagctatcaggaagttggctagagatgcctgagatttgggggaaggttttaacgaagtctttatagtaggtatttcactaaggtatactttttatatcagagtactgtgtaataaagtagaacgttaataaccagcctctaatatttatatacttgaaagaat

SEQ ID NO: 92540 - DNA, 1053 bp, Homo sapiens
aaaatataattttttttaggagtataattgtaagatgaccaagcacatgtgaatggaatgcagctactgtggttgggggtgtgtgtgcatgcatgtgtgctccttgctgtgtgctgttgtccgtggtccgttcagagtgaggaggaaataggaatgatgaagctctgcctgtgtatgttagacatttatagttgtgcatcggatgtgttactttatgctcttgtccttcactgtgttttattccttccttaaagctgtgtgactctgggtttaacaaacagagacaggtacagaaactctcaatgaaatcttacttttcttattagactactagaagcaatcattggcaacttcatgctgggctgtctataaatctgtgctcactaaggtgcgttcggtttattagttgcttccagccattgcatggcactcatttctggctaatcagttttgtgcttatttaataaatttaccaaagatgataatgtgtcagagtgtagttctaatctacttacaatacacagtgatatagttacctcagggtaatttcagtattttgatagctttacttttacctggagaaattctgatctgtgtaaattttgtagtttatttttaacagtttaaacacactaatatcttctgcattcagctttctgattcataaaaaaattttaacaaattctgatgttaaaatcaatacgctaaaatggtctcttcttgacttagataatttcaataagaatgcatgataaacattaaagtattatttgaactagtctgtgtattctcaaagtaatatgcttattttctagtaagaatttacctactgaattattgaatatgctttttgccctttccttatcatttttgcactctttctcctcccttttatgagatttccacccccaaattattattttggttataagattcatgtggtttcaaaataattttcttatgtatgattattttagaaaaggtctagcaggtaattaccatttcttctttattcaaagaagcatattataacatattttcattaattgataa

SEQ ID NO: 92541 - DNA, 1055 bp, Homo sapiens
aatactccaatcagtttagattcatgcagcctttttatctgttgatgcttcttagccctaaagttgttaatcggtttgttttcttagaatttagaggaatttctaggttatttgaatactttagatactttaaaattttgaaagctttccagggatgttttcactggtgcctttaccttctttgagtccagttcccactaggaaatggcagcattcacatgattctgtgaccccagtgaagcaaaggacctagtattgaggccctgtgtctggccaggtctcctcagtggcatgttgttctgtcatctcaaagagttgctctcgaagctctgtagtttggcttaatttaaggtatgctgctcctggtggtaactgtgtttcattgaaaagcacattttcaaaggagcaataaagcatttcttcatcctttcatttttccctgaattattttacattgagtaccaccgatgcttgtgtgatcagcgattagttcaacgaatatttattgagtgtaagaggcgctattctagtgggacacagcagtgaagaaaactgatgaaaatcttgcttcacagagtgtggacctgaaggccaccgagggaattatcggttttatgaagtcattctttcttgacctcctcagctacagggtttactcgttacctttggacagctttatttagatcacttttataacttgttgaaaaagcatgacaataattagcacaaagtttaatcataaagaatttcagaactgcaaaggcagtgttaacacagctccagtgtgctgttacctttacctttagatgttgatgaaaactattgaatgaagatattaaaactgaaagtcttggttttcattaaacagggtccagtcagtggagtgaccaagtaaaaagtgaaaacaagtccccatgggatggcccatgcagtaagcctgcacttaggaaggctgaggcaggaggatgacttgagcccacaagttcaagaccagcctaggcaacatagcaagaccatttctttaaaaaaaaaaaaaaaaattagccaggcagggc

SEQ ID NO: 92542 - DNA, 1051 bp, Homo sapiens
ttgctaccaaaacttttaaaactaagcctttacatttggtaatttctaatatcttcttaaagaacatgtgtatacagtacctttatagtatgtaaatattagcaccatgatataaaaaatagaggatgtattgaaggaagaacatttcaatcaaatggcaggaattaaacaagataagggaaattcttccaatgaactattgaatctaagaaagacatttgtgcccaaaatattagaggttcctgatgataaaagtaatagtttaaaaaaagaaactctctattaatatgtttttataaatcaggaggcaaaaacataaactgttgagtttcagtgttgtatattattttaccatcatgttcatttgtcttcacagtttggctccccccttccccttttcacccacactctcctgttttgtgttgttaggaagttatcaaggaggatgctgctgaggggctttcttcacccacagactcctcgagggtaatggagtagtcctgtggtgtggatcgctggcatctcattgcttctgcctcagtaatgactgtcttaattgtgatgatagcagctcactaactctgcgtttgtggtgtgatgagcagctagtgtagagtagctgaatgctaataattatggttcctgaattaattaaaaagcggatgtttaacttcacccattatttcctcctgcttttcccctttttcaatacatgggatggggtttttttttattcttcaataaggaagggctttttctatcagctgtcaggggtgttccgttggtagtatttgctcctcagtgtgagctctagctttgcctttgactgtttttgttaagcctgtggttgctattacacatgtggaatattttagaaaagtatccagtatcacccttgagactacaaaaagacacataagctagatggtgtagactaaaaatgcatctttaataactcaatctaggtgtctacatttagttaagtcttagtctgagttttagtgcagtgttataatacttttctttgtctatatatttgttaaaataaatt

SEQ ID NO: 92543 - DNA, 1062 bp, Homo sapiens
ttgtttgtttataaacaaatgttctatttgttatatcttgtataatagtttatattggcatttaaaacaatgataaacttaaattcctatagtagtttagtaaacctatacttaatatacctttgtcttttaaatgtgagataataatgggaaagtactgctgtggaactcagatgtttttccaaataatagcactgtagcccatttttagagtcttatgtcaagttatcttcagtcatctacaattttttagttaatataaataggataatttcccagatgaaaagatgaaatgcaactaattatcagtggtattcaggccctgtcaagtttagtaggcccaagctatattctcactttaatgacctcaaacactaatatttcctgtaggaaaatggagcatgaacctggggttacactttctggaactgttctcttaaggtgcattgcaatttcttatttttgctatctccctctttagtctaattcgagaaaacataggacctagttagtcatagaagcctagtgcctaaactgcctgtgtaaatacatctcatatgagctgggaagaaagagaatttaggataaatgtgacaaagaaaggattctagaatttaaactttcagtttttgaaaaatggtggccatataagtaattaggtactgtttaaagagtcccgagaaatgttactccgtttttctatttggacaaggagacaaaggtggaataatagcattttatcatgtattccatcttttaaaatttaactgtgtggtaggcagtgtgaaatgcaggtttttatttaccagtcttaaaatctgctgtgtaagtttgcataaaatagctccgttgataccaactgaaaatttgaaactgagaagcttattttaaaaaatgaaagattaccttaccatctagcctgaaatactatgttcactaatttcatgaataacaataatgtaatcatgctttttaatagtattttatcatttttaaaaacatttacagttttctcttgtttttaaatctagctactttttgctgtagttatttgagattttt

SEQ ID NO: 92544 - DNA, 1089 bp, Homo sapiens
ttttgccttttcacagatggcagtgggtgtataaatggactccattttttctttgtttctgactttttggctgcaatgccaagtggctgttttctgtctgtgtgttctgtctgtctcccagaatctccaaagtgttctgttcatggatggtatttaataaatggacattcactggtagaaagtatttgagagtctattagaagttaaatttgtttcaaggcaataaaattctaaggcatttaagagttttctctgtttaaatttttaaacaaattgtgtcttattttttaacatcctactaaataatgacattattaggcagctacttttagataaaatgtgataaataatactttcttcataaattctgctctaagaatctgtttatattttgatttaaaatagaaatcttttatgtaatttaaaacctcattttgaatggaagtgatatgaatagtttatgcaatttctgccaaggaattaatatggactttgtataaaccactgtcatttataatcaaaatgcttttaacttacattgatgttggcattaacaagtattgctagattggtagcatagaaggaaattgcatttagacttactaggagctcattgatgcctgaggttttataatgctttctttgggccatttaactgctggcaactttaattcacatgattcataatgctggaaattcaaattcactcttaactgaaaagtgaagttacttaaattctttaaatgctaacctttggaaaaatatctgaaaaataaaggcacatatgattttgatggcccactgccaaaagattatcatttacataaatatctctttcagcagaagagtttaatgtattgagctcagaaggttagaatagagacttcaatctggaagccagcagtagcctgttggcttgtgaacagcagcattgttcatcatactgagaacactgttgcattcaggcagaagcagagctggcattaaaatgcagttaatttgtttcatgtgacttgtcagctgtgtgtttttatctaaatctttctagcttctctttttagtattttgtgttcaactcctgcaatagat

SEQ ID NO: 92545 - DNA, 1042 bp, Homo sapiens
ggaacattaagatgacacactgttcattcaagatggttttaattggtacaattattgtaattttcttgcaattatgtgttgagttgaaagcttttgtctggatcatttgagagttttttttttttttaacatacatttagtaagaaagggagtaaaataaaaactaaaaattttttgtctagtttttattgcagcattttagacaaccattgaaatattttaatctaaaactttatttctggcatttaaagcagaatgatagtggtttttaaaaaaatgaatttaagtagttttcatgaagatagtgctttaaatttctgttttgacactgctcagtcaatcttttacccaggccatgatatggtcagaataagtttgtgataaggataacaacattctttattttggtactttattttgatgtttaaagaacagttgaataagttctaagggtgcttcagaatagtagccattttccatttcattgaagtagcaatttgctgtacagacaatatggacatctaatttatgactttaatagacctgttatttttaaattattcaagtaatgttatttctatacattatttaggacattctcataataaaacatcatattttatgataacctctcctgatattcacccaaagctttcataagcttcattttatcacatgtagtcatctcatacctcttgtagctctcactaacctgcttgctctctccatcattttctgggtgatgatcagctctccttccctctcttccccgccatcatttggcctggattattgcacaagcttgtttcttttgcatgtggacttaagttatgaatgtggatagcatgaaaaatttaacattagttagtttagaggaagttgttgcttcacctcctttgtagtacaaagtccatcctttgtactgataatttttctctttagtttttgagatactagcaatatttattccaaaaactgtttaatgcatgctattttggtgttttttatatatagcttagaatcttcatgaaattctttgttt

SEQ ID NO: 92546 - DNA, 1061 bp, Homo sapiens
tggttgtacctgttcccccttttatgagatggaattcctttagcccacccaccctgaagagtgccttttgttcatgtggcgatgtgaggatagttagagaggctgtcccttagttttcacatactttaaaataacctaaacatcaggccaggtgcagtgctcatgcttgtaatcctagcactttgggaggattaagtggaaggatcacttgagaccaggagttcaagaccagcccgggcaacatagtgacaccctctacataaaatagaaataaacacattagctggatgtggtggtgcatgcctgtagtcccagctactcagaaggctgaggtgggaggattgcccaagcccagaacatccaggttgcagcgagctatgattgccttactgtactccagcctgggtggcagagagagaccctgtctaacaataataataacctaaaaatcaaaatgctgaatccttaaaaccagacaagggcttatttgctttattacttaagggtttctataaatagccagaccccatggagtttgaatatcattctctttacacaattctgcctacttataatcttaaaagcattgagcttcctctaactgtaccactgtaacttaaaatgcatctgaagctaaaccatagcatttcatgcagttgctgtgaatatgactttacaattgctttacgaagattctacctcacagataataatttattactgtatgatattcctctttgactaaaactttggattttttttttgttataaacatttattaacatctcaaaaagccttaagttcttagactggacgcgtgggttccttctcactgacgacgtgctgtttcaggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggtgacttttgtctcttattgtctatgatagttaataagctttagcattcacaaaaccatttaat

SEQ ID NO: 92547 - DNA, 1712 bp, Homo sapiens
tttgcatccagatctgaatcttttcacattcagagcctctaatcttggcaagttagtcactcaacccagtttgttctttttagaacagatatggtagtgtctatcccacagtgtcattctgaggatcagctgctgtaatttatgtgtagtcacttggtaaattgtgaagcactcgctcttattttaagtggaagcacaactggcagcaaggactttgaatgtcttctgttcctattagatgactttctatcacgctttctaagaaatatgtttaagcttcttggatcttccttcagtgctttctataccttcctttgcaatacaggttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtacgtttgcgccacctcaaaagccaccattgttatgttgtggcacttgagagaatgtttgacttcacaaatatctaaaaatagaacggaattggtttttgtttgagtagttcctattttgtgatttttcttttgtaaaaacaaccattctttatacagaaatgtagcaagaataaatgtttagtcacaaagatatttaaataattttagcttagtggcactgtgagaaaaatgaatagagcatctgtattcatgaatgtttctcatgtgcattgatttacctctttagcagactgtaaatgtctgaaagaaggacaatattaattttctttgcaggttttatctatgtcagatgacaacaaacctagattgagctgtcagtaaaatttgcttttgtgcagagtaagttttgatgaaaagaaatagtagtttagaaatattgtcaccaaaaggtagcacatattttgaagagatgccttattcttttggacaatttaaaatgtatgtcacaactgtacatttcttctgccacaggtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacaggtaaagctcaggctcctaaagtactttgagtttgaaatagttttgtagtttctttatggcgactctcctttttaccttgaaaaatattgttgttgtttcacatttctttaaatatcatatacaacagaattttggtgtaagtgatgctgtcttgataaattatttaagggatacaggaagatgctgacagaagagtttcacagaacagccttggggagatgacaaaacttggtagcaagacagccctcaatagacgggtaagatgccattggcttcgagctgtatgtttgtattgctattcaatttaatacaaataaagatgatgccacttaaataatactttgtaaatattgcattaaacgcttcaaataaacattatcattgaatttcctttcagcttcatgtgtttcagggaatgtctgcacctagaaccctaacaactgtacttcgtataggggtcccaacctg

SEQ ID NO: 92548 - DNA, 1148 bp, Homo sapiens
gagacaaaaagaaaataaagggtaagtgatgcaaagatgacatacattgaagttatttgttactttagataataaagtaatgtttgatttgttcttttcttcaaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaggatttccttccttccttctttgtgtgtaagggatgggggtgggatagatgttcagtttattttcatgaaaacacaccttgaacattagactcatcaggtattgtgactataatgttaggattttctagatccttgatatgttaattattaaaaccatttgttgcattacaggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagtaagcactcattggttattagaaaaaattgtaatgcgaatatgttgccactgccatgctcatttgggctttaggaagtacactctctaaatgttaaagtgttgcatttattttagtttaatttgttcattcattcattcgttcattcaagactataatttaaggtagttttaagttcacggtaaaatttagagggaagtgcaaagatatcccatatacccacttcccccacacatacacagcctccccaattggcacgattacccaccagagcagtacatttgttacaattgatgaacttaggctgacacatcataatcacccagcatccatagtttacagtagggttcactcttggtgtggtacattctgtgggcttggacaaatgtataacatgtatccaccattatagtcttatacagagta

SEQ ID NO: 92549 - DNA, 1019 bp, Homo sapiens
cttgggaggctgaagtgggaggactgcttaagcttcgggggttgagggtacagtgagccaagatcacgccaccgcactgcagcctaggtgacaaagtgagaccctgctcaaaaaaaaaaagcattaaaagatgaaaattttttagttataagaaaaaataagtgtaatttaagatgaaaataaataagccaaaccaggtaaaatattaaaactgagtataagagaaaaataaaggtaaaaacttttaagtaactagcatagagaattaagtattaagaaaaggatttaaaagtgaaaaagttaaaaggaaaacagaataaaataattgggggaatatttttacagaaaataaggaaaccagtctaaattaatgaggtggtatttttttttttcagttagaacaattaaagtagcatcgtcaagaccacacagtatattacagattgtattctgagagcaatgcttatctactggactgagatgagagtttaatttagagatggaagggagaaaggaactaacagaaataataatgattcagagactctgaatacaaataattcacttaattttgaagatcaattgtgaagagaatattttacaactatttctcaatccctggtagacgtggaagctataaataaaataagccatgctaaaacttgagtttttaaatggtattactgggcttgaaattctttaatgactgtaattaatattttttcagggttagagtctctttcgttggtgttagaaaactttcttgtgcaactcttggtggccacatcatgacacgtgtgtcaccttttaaccactatgtcgtgagatctgttggggtgtcttgatactccacatctaagttctggcgtaactttcccccgcctgtccttagtcagaattactttatatggccctgcacatttcacttttgttactgttttttcctaagaaaagtatgtaagattttagaagtggaagctacctaattacaaattcttttccctccttggaatttaaaa

SEQ ID NO: 92550 - DNA, 1095 bp, Homo sapiens
ttctcaatctgccattgactcatctgacactggtcccccaatttgcgatacagaaccaccagactgtatccttcaaggttccatatagccttgttaattatataatatgctatcttaagtaattgctttatactcattaataagtttcctgaaggcctctgccttggtattcttttgtgtgttgctgtgcccagagtcagcacatgatacttgttgacaaatacacatgatagttgcaacagttgttcattcatgaacacattcttactgaggacgggtaaagtgctatcctgctagaatttgggatacaaacttttaaaagtcttgaacctggatcttcatagagaatttcataaaaacaattttaaaagtgacgattaatgttatttttaccttgcccgtcactgctctctgattattttcagcctgtcagcaaagtatgctaatatcctccctgcatttataggaattttgtatctggcagaaatgctgctgctactgttttgtcttctcacaggtctggggatgagaattggaattgagatgggaaaataagatgaaattgggtttggatatgtttagtttgagggctgataagacattcaggagcctgtggccagtagacattgggaaatctagtactggaatctgggcaagaaatcaaggctggtgatggaaatttggcaattagttactaggatagagagttgcatgggagcgactaagatgatcggtgtgaagaaagatgaaagctgaagtcaaaatggactcttatgctgtgtgtcatactgcagtttttaaattgtgcatgtttatccagtctcttcctattacgacataagctacttaaggtcagcaactattttgtcttacatctttatatcctccaaagtacgaagcacagagccttacatatagtgagtctggtgcatagttatgctaccacattttttaggacatgagaggagagtctagaagatgaaaagttcaagataaggtcgtgccttggaagccacaggaagaatgtgtaggtcattttcatttagtgtcctggagatcagtgtggatgagaactgagaatttaatttgtcaagg

SEQ ID NO: 92551 - DNA, 1054 bp, Homo sapiens
gaggttttctgaaggcatactgcttgtttcaaatggtttcactgagaattgaagtgatgttggtatacatttctgaaaaactctggacactggcttacctggacgttgacaggctgggctgtgggttggtcggtggggagaacgggaagtagcctctggaggggagctgccccaggtcagtggtagaacctggggtagggcagaagcagccactgctgccggctgtagcttacgagcagctggggcaggtcccacacctggctacgtgatttacagtcactttgatacaaatgagtgggtgtaaaggaaaagcatttttttgttgttagcttttatgttttcttgagagggttttaaatataggctgttaccagagtcagatatttcttgacatgtgcatttgtatgacataaacacaggagtcaagctattaatctggcaaatgttcttatttgtgcccacaggatggtgaaacgccacttataaaggctaccaagatgagaaacattgaagtggtggagctgctgctagataaaggtgctaaagtgtctgctgtagataaggtaaaacatctgtgcggagagaacactgtatggaaagctgttggtcgactgacctctatatggagtggatttaatggggatctgattttaggttgtgtggggagagatgacttgctggggatgtctgtgtgggctttggatcccacacagtagtgtgctgaggagtgggtgggctcagtgtgctattaacgcagctgcttccgactttccttctacggctcacagcagctgtggggcactgccattgactaccacatcaggaggaggctctgccttcatcagggtagagcttgctgcagataaacaggaggaaagaatgcacaggggctggaggaggccgatgctcagagcagacggtgttaatgttcactgacaggagtcaatgtgtttgttctgccgcgtgtccttgctataatcctttcagaggaatttttatattttctataataagtttagctctaagtggcttcatacttcatatagatttgatt

SEQ ID NO: 92552 - DNA, 1039 bp, Homo sapiens
actttctcccttaattgaatgtggctgtagattcactgatagttttagctttatagctccgtttttttagaattcatggctttcgtcatatagcattattccaagatatttttactatatgattttaaaatgttcatttggttcattgacagccacaacgtcattgtatttaatttacatttgtaataggcggttaccttcaaagagaatagattattgttctgggtaactggtctttctaaactttgtttaggaatttcagagtcctcattttggggcataaagtcctctgtcccttactctgatatctgttaatatcagatattcatattagttaagtaacatttttctcttatttagaggtagactttttccaagaaatttttagaaaaaaatatgaaaacatgattaactgtaacttaaaaagagtgcttatttgttgtcaatttaccttgtttttgtttttattttctgtcttcttagagtggggatactgtgttgattggcgctgtcagaggtggtcatgttgaaattgttcgagcgcttctccaaaaatatgctgatatagacattagaggacaggtatgtgtgattacagtgcagttgctatcttagagtataattgcatgtaagtgttgactgatcataatgttattcttcccactttcctatggagataaacttgtaaaccctagtacatttaacagacgtatattattactaagtttcactgccattattgtaaaatttctatattaatgtcgagttaaatgtagatagaggtaaaccaaaaaagctcatgtttttagaatatactgtccttactaatgggtatatatagattcaatcctcagaactataatgagtagttagtgatactgagagagtcggtgacactttgaatatctggtacttatttattttttttagtgttttctccctgttttgtcttcttcctccatctgctgttcttctactgttgttgttttattttcttctcccttttccccactgtgcctgcctttcctaggaccacttg

SEQ ID NO: 92553 - DNA, 1194 bp, Homo sapiens
cagtatattacacttttcttgaaatagctcatggctattaattcattgtttactttagtgttttttatgggttttattataaagaattcttgaagtctgattcacctgactttggattatttaatttagaatgtgtttatatataaacacattctatataggtgttaaaatagtcaccctgccaactattttatccttcattactgagttagtttattgtaaatgagtccaatttcagattatcatttaaataactgaacttcataatagctctaatgactgaagatcattaatgtattttcaaaaacaaaagatacctcctagccatttttggtatgtttcttgctatttattttggcattttactattggaaatgacaataataggccacctatttgaaaacattagttttatgattatggcataaatcatatattttctagaatacattaatttcttgggcttgcgttttgttttgtttttgttgttgttgtttttagaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacagggtaggtcatctatttcacatttgtctcctagtggtgaagtggatgaaaggtgaccttagtgtcttattacctttcaagattctcatgcatgacataaacttgttttaaaataagtttatttctgcctttgaaactagtaagttaaaaactgttcaatagttctgaaaaatgtcctttttaatttttgtcaaataatgttgttattgaaaatgtcacatgtgctattagtctgtgactgaccttgatgtgtcactgtaggtgtgctttcttgtgccctaacttctttgagctcacacttactgatccacctctacctgaacgctccacttgaatgtctaattggcctcttaaacttacaataaaacagatgccttgcttttttcaccccaaacctgctttccctcattctccatctcagcaagtggtaccatcattcagcctcttgttgaagccccaaatcctgtgcattagccttgatttctctcttttcctcat

SEQ ID NO: 92554 - DNA, 1070 bp, Homo sapiens
cagcacttggggaggctgaggtaggcagatcacttgaggtcaggagttcaagaccagcctggccaacatggcaaaacccgtctctactgaaaatacgaaaaaatgagccatttgtggtggtgcatacctgtaattccagctactcaggaggctgaggcaggagaattgcttgagccgggaggcagagattgcagtgagccaagattgcactactgcattccagcctgggtgacagagtgagactctgtctcaagaaaaggttaaataaggttggttaaaagacatttcatggactggttaatctactcaggagaaataaaatgggagaaataggatttatctaagattacaattacgataaatgtatacagttttatgagaatgataaaaagtaagatttttattaaaattcatgttaagagctagtttctttgagtatactttttataataattttaaatttattgtttgttttaatagtatggaaccacccctttagtttgggctgcacgaaagggtcatttggaatgtgtgaaacatttattggccatgggagctgatgtggatcaagaaggagctgtaagtatcttatattttaatgcttggcaatagaaacatgttttttattttaagagagagaatttatttctttagtgtatgcctagagaaatttccctctagttctaaaatgatagtaacaggaaaacaagcatttcctgttactctaagaatgttatattataaacatatatactataaatagatgcttttaaggatctgttgctaatgcacacacaactggggaggctaaaagtataaagaatagctttcagtgatcctagtgtgatatatagagagttatgtgtcgcttaatgacagggatacgttctaagaaatgtgtcatcggtgattttgccattgtgggaacatcatagagtgcacttacacacatctggctggtatagcctactccgttcctaggctctatggtatggcctgttgcttctaggcctgtgcagtgtgttaccgtactgaatactgcaggcagttgggagacaatggtatttctt

SEQ ID NO: 92555 - DNA, 1093 bp, Homo sapiens
atgcctgtaatcccagcactttgggaggccgaggcaggtggatcacctgaggtcaggagttcaaaaccaccctggccaacatggtaaaaccccatctctactaaaaatacaaaaattagctgggcatggtggtgggtgcctgtaatcccagctacttgggaggctaaagcgggagaatcacttgagcccaggaggtgtggagattgcagtgagctgagattgtgccactgcactccagtctgggcagcagagtgagactccctctcaaagaaaaaaacaaacaaacaaacaaaccaaaaaaagatacatagatctggagtttaggtaactatttgggtgacctctgaaatggtggttttgtaatgtttatagcagaaactagttttttaggggggtttggtaaggggttataaattatcttgaaaagcttaaaagaaagaacagtgattatcttcagagggtagcctgttggaaaaatttgttagaacaggagagacccacatgagaaggacctcattcagagacctattaggaagagggaataagaagaaaagactgatgatgtggcaggagattattgagtaagggcctgggtgaaagaggaccatagggtcaggaatacacataaagggattagattgagaagggatagagaccagaatttgagagatgagagacttattgaggtagttcagactgtggctgcagagctgttttgaagcagacagcatgcaaggtgagggaaggtcttgctggatgtcaggaattctttgtaatgttgaaagtgggactgtctccctaatgggagtgggtaaggactagccggctcatgtgctgaggcaggggaaggagcagaaatcatagcatataatcgtggatagttcagttgcatcagaagggcagaaatccaatacaatagatattcaaaggatgagaactcagttacaataagtatatttttaaaaggctttatgaagggtgattttctatgtgtattatgtttgaagatatctaagatattgatattgtaaagttaggaaaggcattttagccagagtaagtattatccgcaaaagaggaggctagaaaagag

SEQ ID NO: 92556 - DNA, 1927 bp, Homo sapiens
ggttctcctgcctcagcctcccgaatagttgggactacaggcacacgccaccatgcctggctaatttttgtattcttttagtagagatggggtttcaccatattggccaggctggtctcgaactcctgagctcatgatctgcctgccttggcctcccacagtgctgggattacaggcatgagccaccgcacccagcctgaagaaatatttttggacagccaaaataaatcttagaagtttggaagagttcataatgaatgttctctaattcaggtttcataatatattataaactttggactaaccatttgtggatgcaagagatttgacttatttcatgtactattgtatttggggagcctgggaatttagaactatataatactaccatcatgaaacaatgatttataaagatatttactaaagaaatttcattagtgacattttttatactcagagatgatttaaagtttgattcccttacccctacattttttgtttagggaggatggacagctcttatgtgggcatgttacaaaggccgtactgacgtagtagagttgcttctttctcatggtgccaatccaagtgtcactggtctggtaagcattaacaaaaaaatttgtttgtattataagtggtaagttttcttagggaatacttaaggttgattatatttggcttcgtggtgggtagaaatattctttatcttattaaacgtaacatagaatatgatttcaaaacacagtaatgataatttttttctaaagctaagtatttctcaattgttgtcagcaaaaaggcagctcttagagcttaaatgttaattataactatataacattgcaaaaggagattttgagatctttagtcatcttcctcttttctgtgtgtgaatccttaatctgaacttaaagaaaagaaacatttacaaaataatcatactgtttttctatacattctgttatatatatttacattcctcttattttgctttcttcttactagtattgcctgttggccagataaccacattttaatgtgttgaatttataaaaataaatgtgttcataatatatgtttacttaagatttattatatcttagttgccaattatgtattatgagtattttgtctatttttaaagtggagaatggtttgtaatctgatttaaaaaaaacattactttgtgttacttcctttgatgtttactttacttagcaaatgtgtgttgtaaatatctacctaaaagattttatttctccttccctccctccctccttcctttctttctttccttccttcctacttatctacctacctaccaaccaatctatcctagcagtacagtgtttacccaatcatttgggcagcagggagaggccatgcagatatagttcatcttttactgcaaaatggtgctaaagtcaactgctctgataaggtaggtcagcagcatcttttcaggttccagtccatgttatgtccactcagtgtctaagttataaacatttttatatgatttcatgaggcttctctaatgtattttatatttttgtatattaatgtattttatatagatatatatctcatagatggattccctgggtgtattatgtagtaagtatccttctgatgttttcttatgtcacattcatcattcccaagaaaactgaccgggataacagagtccctgtcttcattgtttgaagttttctattgtaactctccttcctacattcagtcctatctgctttctctgtattgttgtgtgagagatctttctgaaattgaagtttggttatgtttctcttgtgcttaaattcctgaagaccatctctggtatgatgggtgaagatgggccttgccttcctttttccccttctcttactgcttgtccgccatggttccttgcatgccagccact

SEQ ID NO: 92557 - DNA, 1076 bp, Homo sapiens
tgaatgatcatttgaattatattacagttaggaattaaaaaataaaagagaatagttctttatcacatggtttctaaacacatcatatgagatctctgtagtctgctaacctgtgaatgtgcttttaaatctgattacagtctctttaattccaatttatattacagtaatggtggctagccatgaggattagctttgaggttttgatgatcatcttttctcgtttttaaaaagcgcagtatatgattagaagttcagtgagtagactgaacaagcagttgtaaagccatgtttaccccattcttagtgatgcaagtggacagatagaatcttaagagagcttcagtatgactttagagtagtttagttagcatgggtcacaccatgtcaacttggtatgatcatttggtatgtaagttcaaatgtagttttccttactttgacgtgttatttttggtttgaaaatgataacttttaaaatatatgttcaaggataattggacagcacttatatctgcatcgaaagaagggcatgtgcacatcgtagaggaactactgaaatgtggggttaacttggagcaccgtgatatggtatggacatttttatatgttcttaattagctgaaatcttatttataatcatagatatgtgtgaaatattttatttttatgtgtgaaatgatattataataatgtttttagaatttgggattgggcattgaaatgaccctcaagaatgttttaaaacccaggtgttgtaatatacctcttagaatattcttagtcatcatttttcatttattttggagtttaaaattctgacatattgttacaaataactcattactctttaatatatcaatgttttggaacttctgagacagttgtttcctttaggtaggactttaggagggacagcgtatggttttaaaactattatcaggtgtttgaagttatacttttcagaataatatttttagatttatttttaaaaatgtgattattttcagacatgctatctgtgcatgacagaagtttaacaagatgtgatccttaattattacttagctcttact

SEQ ID NO: 92558 - DNA, 1456 bp, Homo sapiens
ttttgtatttttagtagagacagggtttcaccatgttggtcaggcttgtcttgaactcctggcctcatgtgatccgtccaccttggcctcccaaagtgctgggattacaggcttgagccactgcgctcggcctaacctggtatttgccgatctgtttcctgtcatggcacttacagaaaatgataacttttgtactgcacttgcagtagatgaggcttgctgttaggggtgacttgtctaggcacccagctgcctgagccctgccctcatctccagggctgagggagcatcgtctctgtactcctgtgactcattcttaacacaaaggctgggacactgatttcagcagtaggagctttatttagtttaatgaactaagtttctaagagaaggctttaaaaaactacatatgtgtattatacatagcacctggttgtttttatttattattttacttttcttcttctcgtcctatttcagacaaaacatatatataattaaaaacacattttagatcatattctacctgtattgttagagaatttggctaccataagtattctgaaattttatgtatatttcagtaattgcattccaaatcctagtgttattcatatttacttactttaaatgaatttgcagtgccaaaaacagattattaatactgtgggaagaaaaattatgttttattttttctttgacttttaaattattagtaaactgaaacttaaagttcaaagctgtttctaaattaaatatagtaaacacaactaaacaatgcttaacatacattcatgaaaatgtgtggtatatttaactgtgatgttttagtaaaagtgcagtaacttgataagttccctttgtcttttatattctctagtgtggccagactccactgatgatagctgccgaacaaggcaatctggaaatagtgaaggaattaattaagaatggagctaactgcaatctggaagatttggtatatattaaaataatttactcatcatttactcacttttttcttagctatttttttgtttttcagaagtgattcaaaagtagtaattaaaacttttacatatatttcaactttgcctagtgggctatatcagttttttttaaaaggagtaatacaggagagaaatttttactttcaatgaaggatctcagctctttggtttttttatatggatgagactggctgaatagagagcatgtgtacatatagttaaatatctacctagaagatatccacatacgagtcatgttaagtaactccccataatggtaacttattataaataatatcattacatgcgataatggccaggaatatatggtcccttctgatatcacttgtgaggggtaaatcaacattccacacggttacatttcctctgattctccctgtatttttggaattgcttttgagggtcacacagctacatctattttg

SEQ ID NO: 92559 - DNA, 1026 bp, Homo sapiens
acgactcagaattctaaacataacttttaaggccatctgcttaataactagcagtacgtgcatagcttttcagagtgatgattatcataaaagttataatcagcttgaatgttgagaagataaattttttcaccgagaaaatctatttatgtgtaatacgtcattccctaatgaccctggttggatgacatgtggctaccacgtataatttagcatccatccttacataggaatgtctatatttaacgtgaccgatacttgaactttaaaccagcgttcgtgtttaaatccttacttgtattattcttataatagcatctgttgtattttggtaatcattataactatttgcttatttggatgttgtgcctaatagatttttaaattctttgagactttgctcactcgtttactcagcaaatatttgggtacctgtgtggcagccactgtccctcacactgggtatatagttttaaacccataagcaaaacagacatgtttcccggcgtttaggggagacagacaataatcagttgttaatcacacaatgaaaatgtggttacaaacaaggattagtataggaaaagtaaattataggggatcagtaaggaggtgggaatgagcaggaggacacgttgaggccgggggtggcacagactgggtcgagggccaggcatgccctgctccgcgtcactcagggtttgtgtcagcttgggtaaggatgtcggttcttatccagaagaactatgggaaaacattgaagggtttgaagcagaggaataatgtcaggtgggcatttaaaagaatcatagattttccctccatactaatatacatgtagtaagtaggtgtttaagtgtttgcataattaaacttaatttttggtgtacatttttctcatatgccttagtgtgtcttagtacctttagtatcatcactctttaacctggtacttccttttttgaaaaattttaatttaaatttttttttgagacaagtcttgctctgtcacccaggctggagtgc

SEQ ID NO: 92560 - DNA, 1084 bp, Homo sapiens
tagtcagatgtgaaatgtattttacaggtagagccaaaagcatttgctaatagattgagtgtagggtgtaagaggaagaggtaagtcatgaacaatttcaatgcttttggccttggaagaatggacctggagctgccgtttactggcatggtgacagcaggaggagcaggggagcattttggagtggtgatgaggagggtttggggatggatgtggagtttggtgtttggataagttaagatggaggtgagtgtgaacctaagagacatcacggcagctttttgacacctgagctatggaagccgtgggaagtcgtatcttcacttctgccactggaggtgtccttgcatgaggttaatgttaagaaggatattgtatttaatagtaacttaattttttctaattataaattatgtgtattttgtctaatttaacaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgaggtaagaccaagtttgcaaaattacattctttcacaaatatttgttgactgcctgctatgtataggatagaagtgtgtaagaaataggtagttctaacccttagtaatactgcactgtacttatgatagaatgtcttatagttaaaagtacttcaaatttcatgtttttggagtacattttaacttatataaatgactgttgaatttagatttattgttttttttcccctgatggaataattaatattcaggaagcttgattactgaaatcaagtacttctgtgaaactttacagatcatctggacctgatcttgattaaccagacaaaatcagggattgttgaaatactttcttttttatttttatttttattttttgagatggagtttcactcttgttgcccaggctggagtgcaatggcacgatctcagctcaccaaaacctccgcctcccaggttcaagtgattctcctgcctcagcctccctagtagctgggattatag

SEQ ID NO: 92561 - DNA, 1090 bp, Homo sapiens
atctgctccaacttagagttagggaatgggcatgggatatcagttatagacagtcctgttcaagggtggaggaaaaggaaggcaaagaggattcaccagtcccaaataatttcattttcataacagccaaagttttcaattttgacgaactctggtttatcagttttctttttttatgcaccatgcttttagtgttatatcaaatctttcttaatctaaggtcactgaagtcatctatattttcttctagaagttttgtactttcagacattatatttaggtcaattttgagttagcacctgtatgtggtacaaagtatggattgaggtttatttatttgcatttggatgtccagttgaatataataaaatttctactcttttagaacttatagttatggtagacagacaataagtgaacaatatgtcattttttggatggtggcaagtggtgtggagagcagtgaaagcaggacaaagggttgagagtgcagggtgacagtgaagcctgtgtggggtcggtaccctgacatcccacatccggtgagactttgtaaccaggtgacctgacggggtcagggggtaagccgtgtgcatgtcctgtggaagagaattttaggcagacagaaaagtagcacagaggcctggcgaggtgggacggtgctcagtgtggccatgcagccaggagggtgagagggggtggtaggagctacagtcacaggtgtcacacaggtgagaggcttgccactgaagagttatcttggccaaggtaaaaacatttgattttactttgagcaccccgagaagcccttagagggctttgaataaaagaggccatgctctgacttagtactgctcacattgtggttcttcctcagtgttgtcagtgtcacagggagctggataaagatgcagagtcaggggccccactcagacctgctgagtcagaatctctgacggtggggcccaggaatctgctttaaaagctcttcaggtgattctgatatatgttaaagttttaaaaaaagtaatgtaattttaattgacaaattatatatatttaggggtacaatgtgatgttttgatacatg

SEQ ID NO: 92562 - DNA, 1655 bp, Homo sapiens
ttagtttgtatattcatgaacaaatctggacatttatactttttttgtttccttatcaactgttcacaattattagttaattggtcttaacagttctacattataattgaaagaaaaattacttgagaaaataattgtttcagaatagtgcctactatatctgtgtcagctaaaaatttgtccagagttttagatataagctagtattttgtggagttttatccaggcgttaatagttcttcctggctgaaatttaatataggtgcagaatcctaaataacactgtgagatgtaatcttaactgccctcaataccttataaaactgctgcatttaacccagtgtgcatttaatgagtggctggtcgttgatacactcatcttagatgctgaaatttctgttttctccagcccttgtaaaagtgggtttcttgatgaacgcgtgctcccaatgctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagaccc

SEQ ID NO: 92563 - DNA, 1674 bp, Homo sapiens
cagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaaaaaaagaaaaaagaaattatgccagctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttttttttggttcagcctatctagccacctacaaataatcacatttctgttacctgaatttatttctcagcctgtaaaccttagtcactgttacctgtttcttgctcagtgaatatgatcttggcactgtcatctagaaagcaagatatttgattggttttctggttccttcgaagataataattccatatccagtttgactgattttcatacccctgaatcaactagttattttcatgaaatggtttttggatatctctcctctagtttggagaagtaataatcacaaagattaatattttgcttctagtacttacagtagaagaattttaaactggtacgtctactcctgttaaatagaaaggggattcgttgtattatgtgcttgcttttttttaatcaatagaataagattcaatgcatatttatgttttatattttccactattcaggtatcatgaaatcactctagagatgatcaatcaacatcatatttatacttttggttaattatatactactcagggaaaaaatgaacaaaaataactactcatccttcaatttcattttcttgaaacagtaagagtataatttggtatgcctcagctgtca

SEQ ID NO: 92564 - DNA, 1146 bp, Homo sapiens
caagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaa

SEQ ID NO: 92565 - DNA, 2287 bp, Homo sapiens
ccacttgaactgttaaaaaggctgagtacatctctcttacaaggtagaccctctttccttggtcgtggtcagtattgtcctttccactagaagcgaggtgtgtactgcgtgcatgtttgctgagcgctcaccacgggctaggctccatgcccagttcctgtgaggagaaaacacgtttctatgtgcccggcaggtaggaggcactcacaaaatgttactttgtctttacagaattttctgaaggagagataaaaactgagttaaataaagatgatcagaatgggtaggtttattttagaaatgtttcctgaaagctgtaacctttgagtcctctctcagatgaagactaggctgtgcgaggccaagacagtggatgagccacactggaagaggacacagttctttagagtatttgcctagacagaacatagagtaatattttggggaaacaattgagaaattaggttggtgacatgaaagaaataaggagaaggataatttagggtaagcccttgaaaaccagttagaggaaagtgacgtgacaaaaaccatgtttgaacaagctggtaatggcacttacaggtaagagggcttcatttaacaaactagcagatatttactgtattccattttgaggaactttggggatatatgagggaaatttcaagaagtattaactaagggtagcttccagtagtttgtagtctaatttgggataaggtgtatatgtgtgtacataccttatgcatgtgtgtgtgtgcataagacagattctgtgggtgttataaatactaagtagcataggtgtttagagatggaagaagtctctttgggttgggttaattagagatggccccattaggaaggtgtttggatctggactttgagagatgaaagttatttcaatagtgagtgaagtataatggggaagaaaatgacattctaagcatcggaaggacattagcaaaacccataattcttagtggctaggctctgctatctcttgcctagctcaccaccatggcagtcacctgctcttgattccatcctgttcaccaatgacaaatccatttgtcctgaggtacgggcttttggcattccattcttgcgcttaaaaactgtacctaactccctcccatagcagacagaataggataggcttcttccctacctggtgttcaagttctaccactgccctcctcccttcccccatttacctctctagaattaccaggtatctatgcatacatgaattctctgcttccattagatttacttgtcattccccaaatacaccatgcacttgcatattagcaaagccaagtttgtctttcacaaatgcagaggttaaataagagttaaggatgaaggtaaaccaaactttatttatatactatattttaccaaatatgatttaaggatctctaggcagtgttgtcttaaacttttcttttttttttggaaacttttattttaatacagaatctaatctacagaaaagttgcaaagaacttctatatgccctttacccagactcaccagtcatttatgttttccctgttacttcctcatctcccctctctctgtcttttatacacagtgtgtacaatgtgtattcgcttttttagaacgaactttatccatagtagcagtgtacattcccactagcaacttaggagagtttcagttactctactccacatccttccaacagttgatatcaccagtgtaactgcataagtaatgttaatttaaagatacagcaaatgtttttgtttctttatttcagatgagaaataactttagacattatttcattgaaccttcccaactgaaattattttatgatgttataacatggatagtaactcaagtagcaataagttacacagttgtgccatttgtgcttctttctataaaaccatcactcacgttttacaggtaagtgttactcttaaaactttgtcagtgggaataactctattttcaaaagaaagtttcttgctattggatagaatagaaaaacagtaccatagccacatttcctgctgataaatgcattatcagttactttttaattctgaaccaagcaagtctcagcgtttctctgtggaatgactcatactgctcaaccctcagatgagtgatttagacagagaaatatcagccaggtaaccactgcctcaaacctctcctaaatttaacaaaaaacttgttagcttaattgtcctgaacttctttggggaaaaaaccagctaacctctcctaaatttaacaaaaaacttgt

SEQ ID NO: 92566 - DNA, 1469 bp, Homo sapiens
cttatttgaggcagaaattttttttgcagcttaagcatgtacataaagcaaaaataactaattgagcattgtggtgaaaaggattagaaaacaaattctgggtcgggtgcggtagctcttgcctgaaatgccagcacttagggaggccaaggtgggaagatggcctgaggccaggagttcgagaccaccttggcaacatagtgggacccccatctctacaaaaaaaaaaaaaaaaaaataggcatgatgatgtgcacctgcagtcccagctactcaggaggctgagacaggaggattgcttgagcccaagagttcaaggctgcagtgagctataatcctgccactccagcctgggcagtgacacagggagaccctgtctctattttttaaaaattctagagacatatacacagagtaggttctggtgaaccaagaaagaaaaaaaatggaaggaaaatattatgcctcacttatatattattgtttataggacacttcaaatatatgattaaaaagaacatggtgctcccagagcaaaaacatccccttagcaacttcttggcagctggttgagcgtactctgctgtgttccagtggcacagctaatgttggggagcgtttcctgttcgagtcttcaccttcacctattggtcctcagcagcttttaaactctacccgcccccaactcatgcatgatgtctcatgtattactgactaaccaaattgtcctagatatgttattttcattgtatgcgatgttgtttctgacttaaaaatcagaataaatctacttttactgtttaagaataaaagatataataacacataccttctgggagaatatggtaaattgttatggagattcttaatacttttttctaatgttgttttctatagctgatgccattaataatgctgcaggctttggtttcagagggtatgacgaaaatggagcagctcgctgggacttaatttccaatttgagaattcaacaaatagaggtgagtcaatctttaagaagttagttactatatactttaagtaccatagtttgctttcataagttatggtgtgatgtcctaggagtggtattgaaggttttttaatattaacactcattctttcatttaaccaatacatattggtcgtcaactatgtgccctgggcactggagacaaggaataagataggtgcaattcaggccctcatggagctttagtttcctagaggttacagaataaggtaaaacaggtggtgatcagagaggggtaaggcatgtgggtattcatgaaataggaatccaggttagttgaggtgtttgggggaagagagtcctaaagaaaatgatgcttaagctgagtcccaaagaagtaagagacaaccggacactccaagtagagggagcagcctgggagccgagagctgtgcagctcatgttgcttcatagtttagggagtcatgaaggatga

SEQ ID NO: 92567 - DNA, 1082 bp, Homo sapiens
cactgttacccataggtaccatgtatcatttggacagacctctaaggagtggaattgacttgactcccttttctcctccacctcacagccaatccctccgcagccttcaggctccactgccaggatacgtgcagagcatctgccccctcctccagccattgtcacctcctgcctggagaccgcaggagccccacacatgggctggagtgacgcattgagacagatcttttaaacccctgctgtgttttttcatttcagtcagaataaaatctgaagttcctgccatggcttgtaaggcaagccccatctgatctcacctcagctgtcttccctgctcccacctcttcccccgggtccactctgctccagccccacggctgccttgctgccagccgtgcccagctcaggggtcttcacgcatcattccctctgcctggaacccctgtcaccaacatccacacaactcctctcacttcttcctggtctctgctcaactgtcaccttaccagagaggccttctctgacttcttaatagaataaaagagttccttctttttgtaacacttagcacttctgaaaatatgttttataaattttattattgttttctgcaaccagtatgcaagctctgtggatgcaggattgtcctctcctttgtttactgccgtatccaggccctgcagcaggtggggcacacagtgcacagcacgtgtttgttagaagagcaaatgattgcctaggaggagacagcactttgcagatagtgcgtccatctttgatttgtctcatcgtgagaaatctaagttgaaaccttcatatttgctcataaggatctgtatagaaactcttattcagacatacttttgagcatgactatgttctgatccttaaaattcttattgtatgggtacaaatgaaaatgaaagcttgttttactttggaaatggagagcagtgaggtggatcgttattctatcagatgttctgaagcttatgctgcatctcactggttgcatgtcttttcattgcaggcgcatgccaagcttactggagtatttgagttacaactgtaacttcatgggg

SEQ ID NO: 92568 - DNA, 1843 bp, Homo sapiens
ttcccttctggccatcaccccattactgcatgttcctttagaggagcacttcttgaaggctttgtcgacattcagtgtctcccctcattctcccctcagccccctgcattcaggtttttgtgcccactcttggtctgaactcattctttcaagattgcccttaatcttggccgatttcactgtcagcctttttacatgatgctgaacctcgcagcattggccagttggccactcttctgaaataccttcttcacttccttccaggacactcccttctttcaatttttctcctccttcactggctctttctctctgtctcttctgctgcatcctctgcccctgcttctgccttaccactagcctggcctcagccctggacttcgttttctccaggtggtcacatccattggcttgaaaggccatcttcgtgtttgaaggctccttaatttatattcccgcccaatccactcccctcggctccagcctcatttatccaactgccatttcaaggtctttgtatggatagtgacaggcagctcgaacagaacatgttcaaaacagaacttctgatttgtctccctcctccttcctcctcccgcatctgttcctccaccattttcacccagttagctaatagcagtaccattatcactggtggcttggggggacttccattttcttacagcaaatccatttcaccagcaagtcaagttagcccttcctttaaaattaatctctaatctgactgattttcacctcttccacccgtcacatcccagtacaaaccctcattttctgcttggtctgctgtggtagctttccttcctggcttccctattttctcccatgccctgtgcagcctacttttcagctagcagccagggaagcttttaatgtgcattggattatattactcctgtcccctgatgaaaatcctccagtggcttcccctataatttagaatagaattacaaacccctgaccacagcattataaggcccaggaagagcccagagctcgaccacgcttcctcactcaattcattcttaactgtgcagctcactctatcaaaaatacccctcccttcctgccatcactttccgtccctttgctccgctttgttttcctcatagtaggtattactgtctgatgttatacaagacatttgttttaattgtccctctccctgcccctgtcactgaggacaggaactttgtctcatttattgtccccatcatccaaaccgtggtcattatttggagtgatttcgcctccaagagtcagctgacaatgtctagacacttttggttgttactgctgaggcgggtggtgctactggcgtccggtgggtagcgcctaggggtgctgctaaacaccctgcactgcacaggggaccccaccacagagaatcatgggcccaaagtgtcaataattctgtacacgagaagcccaagcttgagacaacacatagttgatatgaaatagcaatggaatgaatgaatgagtcttttgtttgatattatacattacaattagacttaagttctcattttataaataaatacagttacttacttcggtacctaaaatgacttgttgtttgatatgacagttgagccaaaaattacttaagccagtttcatggtttagaactatctcctgtccttgctaacggtgatacatagtttgacttggtgttaaaataattggtattgagaatggagctctgctgctagagtacaaggagttcttttgtaaccttgtgactgcagggtacttaccctggtctttgatacagtgagaaagcatgctgtttcatcattaaatagaaagaactgaaaga

SEQ ID NO: 92569 - DNA, 1022 bp, Homo sapiens
tatatcctcctctttgaagagaaacgtaaatagatggatgaagatgatgtatttgagtttggttttcatgcattggagtcatggaggagtaaggaaattgctctttgctttaggttgatcttctagtttatagtactcatgtgtagtcatttaagtcatcccataatagaaaaattgtaatgccccttttcgaaaagtcatagcatttacgattaaggataataacattataatttttaaagtgccagcatttgggaattctttaattataactccccttagagtggagtcagatacccaaccatgtgttattttatagagacttttcacatgatcgaggctgtgttgccatgagaaggaaaggaacagtcattatatcaaaattaggaatataatagcatgaatttcaaatgaggaaagtaatgaaagtgtgcatgggcaaaaatgccattttggggagaaatcttaattgatgagtacctatttttgtttctcagggatgtttcggaaggatgaagaactgacttcctcacagagggatttagctgtaaggtacgtgcctttgcatcctattctgccatgcttcctgcgcccctgcctaggacccacgttccttctgtggctgaggctgactagtccttctagaggtacttacttctgaaaatcaagcctcactctctccatgcacttccctcctgccaaagcctgctgggcaggcctgggcatcccttctagggctcctgtagcaccctgcctctgcgattgtacatttgcgcctcctatgggccacgaggttagctgctaaagttttcatccctatgagactctgagttccttgaagacaggaggatagtattgtcttcatgtctgccatgtagtaattactggtaataatagcagctaccatttacaggccaataacttgatggcaggtactgggctaagatataatacattaatatagcacatcgatgccatattttgaaataataaagaaccagtcagataattctcattattat

SEQ ID NO: 92570 - DNA, 1042 bp, Homo sapiens
accagtgagctaaactatgaaaagaattaggcagtgtgagaaaaatgattctctcccccagggaaatggaaattatagggcatttttatcattttcaagggcttgaagggtatctatcttgcaaagcagaaatagcaatcgggtgttccaagccacctgggggattaggttggttgaagcatgatttcctgaggagtgagtatgtaaatgtaagaactgactttttaagggaacctaagagaaatctcctcccttaagcacttccagtttaagaacatttgtcattgatgagaccttcccgttagttgaggagaatgagctgtagcttctcaagggcccaggtctgtgaatcaaatttccagtggtaggaatgtttaaagcaaacccttgctgccgtttgctgaccttgtgagaaagacacctctgtttgcgagaggcagcagttcgagcttctgcactgagcggtgtggactgctggaagagagcaggtcagaactagacccacgggggtctaagcctccctaggctggggtcctctcccctcctggcccctttccttggcagtgcatggggtgatgctgcgtgcgccacactgtcctcaggattccgtgaaacatgttctcctctgcatgtgtatagagcacagtctaccttgaggcaaaacacaattttctgggtttattatattattgtttcaaaaaattaaataacttctggtcaattgttcttcagtatagtttgtaagctaatgtaataaaggataaaagccttcctggtggttttatttattcttattttattttatttatttttatagagatggagtcttgctgtgttgaccagggtggtctcagactcctgggctcaagcgattctcccgcctcagcctcccaaagtgctgagattacaggcatgagccaccgtgcccagccttaactgttttttaatactgtctgtaagctaatgtcatctttaaaggttaagatgcatcctggtggttttcttatgtggatgtgttttttcctttctaagttattcattc

SEQ ID NO: 92571 - DNA, 1044 bp, Homo sapiens
agcacatggagaaacagaaagacagaagacaaaattatcatagggaactatgcaggagtatgttatggatgaaaataagaaaggattataggaaaagttcagtaagggatgagcagattaaagagagctcagaaatgcaaattggagggcaaaacagacatatgagtccaacgcagcaggtatatggctgggagacaagaaagactgatgggaaagggcatatctcacccttccgcagcaggaacgactgtgcaggaagcatttacaacaaaaacagtgcaatggtgcacagggaggtaactgcagtgggctttcttaacagcatattttgttcataaatctctggttcaggacaattagggtgattcacacaactatttcacttacatctttactgacattttaactattaaatatctgttgactttgtattaatggagcttcagtatctaaccacttcctgggccctaggaaagtctgggataccttgacacgaattggaaagaacctcctgtttccctaggatggaaatgggaagctgaagaaggtaggagaggcagaaggctttggaacttccagagtgaggtcagggcctcaggatggagcttccgtttccttctataggacaacattagtatatttaagtggtattaccgaaatttccttccagtgatactctgctaagaatgtgggaaaatatgaaatataactgtccaaagtaatacttcaactgatgtaacagtttcagctaatattaaaaaattcagctgaagtaaaaactccagactttctgaaataaaacaaaggatgaaaaagttaaaaaatatattcacacacttttttctctacaaagaacaagaatagtaggatttggttctattacacagtaaaactcaaatgtagttaaacattacaagataatgaatgctaaaaatgaacaattactttcatgattgttccattatctctgggagaccactaagcttaagggaagtctgtatattaatgctacaaatcaactaaaagcatctactaggtaacagc

SEQ ID NO: 92572 - DNA, 1002 bp, Homo sapiens
tgcacgatctgcacatgtatcccagaacttagagtattaaaaaaaaaaatgcagtgttttcctgaggctgagaagctggtgacaggcctgcagggcctccttgatgtgtgccctctcacctgttctttcttcttcagttctgctgcttatcccagtgtctctccttggaacatccttccagccatatctgcatgtccaaacttctgcagtcttaaaggcccaaactaaatgactcttgtttgaaatgcattccctcagctctctctgtgcagaccttcaaatagctcactgggcagtggatactttgttatgtagtttattcacatacctttcatttcctgttctcaagagaaagcttctccaggaacagcacttcccttttgattattaggtcccttcagcgccactggcttcttagcagttctggcagttactatgcaaaggtgtgaatgggagaagggacccagctcctattaaacatctgctgtgtctcagatactattgaatttaatccacacagtggcattattatcacttgtgttttataggtaaccgttttgagaaaagttaaataacttccttgttttccacagctgatgtggggtcaggattaagtgttctgactcttatgtccagctgcctatgtaccctgctgtctagggcctcttgtgccaagcgtgcctgaagctgcagtgctgttttcccttctcagtcagctttctcctcctagttagttaccctggtcaaaaaccttggtggttccaggtatgaaaccccacattggatacattatcgaatcccattgactttcctttcagaatagatctagaggtgacttcagacctcctgtgctgttaccctggtctgagccaccatctccccctgcccacctcccctgcctcctcccccaccccctccccctgcctcctcccccaccccctccccctgcctctggtgcccccacagtcttttttcaacctagagtcagaatatattctttta

SEQ ID NO: 92573 - DNA, 1072 bp, Homo sapiens
tttttttaatactctaagttctgggatacatgtgcagatcgtgcaggtttgttacataggtatacatgtgccatggtggtatgctgcacccatcaacccctcatctacattaggtatttctcctaatgctaaccctcccctagcccccacccgccgacagaacccgatacgtgatattcccctccctgtgtccacgtgttctcatggttcaactcccacttatgagtgagaacaacactgcatgtttctgacgaaccttgtaccacactgctttgtgaacacacatacattcagggagaaaggcttggttcggtagggtggggaacagacaaagcaaaccataaatagatccatctctgtttactcctggtaacttgaattacattagtggcagctaaacggaatgtttcctgtaatcaaacgtaggtcaagggctgggagacactcccacagaatgggccaggataaaggcccactacttgcaggcagttgaatgattcatatcgaccctatttacaacacagttgctgggcgccatgtgcggggaagataatgaagggccaaggggggccttccatgactcatttcagagaacacagaaacacatctacaattagactctgaacgtgaataatactttctaaaaaggagtgatggacatgacaagcacacctgtggctatcagattgtgtgcagaactggtgggttcttggtctcgctgacttcaagaatgaagccacagaccctcacggtgacagttcttaaagatggtgtgtccggagtttgttccttctgatgttcagacgtgtccagaatttcttccttctggtgggttcgtggtcttgctgacttcaggagtgaagctgcagaccttcacggtgagtgttacagctcttaaaggcggcacgtctggagttgttcgttcctcccagtgggttcgtggtctccccgacttcaggagtgaagctgcagaccttcgtggtgttacagttcataaaggcggcacgtccggagttgttcattcctcccagtgggttcgtggtcttgctgacttcaggagtaaagctgcaga

SEQ ID NO: 92574 - DNA, 1270 bp, Homo sapiens
ttccctgataatttgcattgcagccttcatcctattcaatgttaaatattctggagtctgtttctgggtttctgttctctcctgttgatatataagttctttttcccatgctatgtttttaattgtaactatattccaagcatcttaagtttatagaaatcagtaagtgttcatggctatgaaatgtgtgtaaatgccacccgactcatacttagaaggtatgcttttagactatcgaggacaggtttttttcaaaattctattaagaatttgttgaatgtataccttagccaaatatttttgtgctaacttttgtgtcctagaaaggaggaataaatggaacacatactaaccacaggtttatgcttgtgatcctgatttcaaatatgtaaagtggtgtgtgtatgtctctcagaaggaaatgaataaaatgaatttaccattgaaggtgatagtcaagtaaactgaagtggatactagaaaagagttttcataatttattaaagaagggtgtttgtagagtagatctagtaatatttaatttctgaaccatatcatttagctaataaattactttaaaatgtactctttaacaaaatgagtcttattttcattaatgtagcttatttttgttttgcagttactgctttgtgtttgctctgggatacctcacagtgtgccaagttactcgagtctatatctttgactatggacaatattctgctgatttttcagggtaagatgaaaactttgattcagtagcctgttttatccattccaacaaggtggttaaaggacaaaatatatttgcatttagtagttcaagtgaaaagctattattaaacattttagttgaaaatttctttctaaatttagaatttctctcttgtaagtagtctttttagtactatctaagtcagtaagagccttgttctgcttcttcctgcctaatggaacttcctttggttcttaggtccttgggctaggtcagtctgagtttcctagagaaggcgctcaagagtgcgttttacttctatgcatttcacctattttcagtgttctccattcaacaccagtattcagttgagtagtggaaataatttctggcatttgttccttcaaaggggatgtattttcttcctggtactagatgaatctttttgtcctgtaacaaaactgattatatgtctgttgtgaaataaatgcacaagctcttacgaagtaacttgctttccatctttataaagtgacatctgctaacactttggta

SEQ ID NO: 92575 - DNA, 1069 bp, Homo sapiens
ggtacatagtaaacagtcttggaaaatataaacagaggggaaggcagaatagagataaaaaagttagtattcaaatgtgcaagccttttatgcagttgggctacaaccaaagccgtctaagcctgagaaccttggagtaaaccgtttaatttgatttcatcgtgttaaaacaaacactcatttgttagtttttgttttcattcccatcaggattttgaaccttttggtgacatcacctgtttttccttttttgagaagaattcgtttttagttctcttcagcagttctagttcattaattcccatagttgctgctacatgggaattagcaatttccctgagcaatttccactctatatccaacacgtaagtgaacagatattttagatgtggtttcaccttttgaaatgaggcagcaattcaacagttcttatgcaatgaataagaaaatgttccgttctagaactctacagaagctgttgattttattttgatattagtaataatcatatctgaattcttttggctgtgaagagcagaaatcccaatttatagtagtatctgaatggtgtaaacagcagagaaagttacctctcgaagctggaagtcacgagacaaggcacctcattttcattaattcaacagctcagtgttgatgagggcgtcaaaacaccaagttctgttttttattttgccatctcagcatattgactttgtcctcaggctagctccttgtaagctaaagatggaccctgcacatgtagacgtgccaacagcaagtgtcacactaagagtaagaaaggcctttccaaaagctctgtgtcatgcttcatcaaccagacctaagttttctgcctcccataaaccagtcagttgcaaggagggtgagatgacagtgatggggataccatagccaggatccctggaatagtacgtccaccttttagaagtgagagaaccaggatgcagaaggatagtcactttctaaggtcacacaggtaggaataataaaaagtgattgggactgttatttaaatccagtccaggtcggtctggattttatttgcatg

SEQ ID NO: 92576 - DNA, 1052 bp, Homo sapiens
tggccaaagcatcagtgaacttaagggtatatcaaaggtattagccaatctgaagaaaaaaggtataaaaaatattgaagaaaaataaacagagcttcagagacctaagggataatatcccatgcatcaacaacgtttaacgcgagttccaaaagagaggggagagagaaagggacagaaaaagcttttgaggaagtgatggccattgatatcccaaatttgatgtaaaacattaatctgtggatccaagaagctcaacagacctcaagtaggataaacacaaacagatcttcactaagtcctactgctgaaagacaaagacgaggagaacatcttgaaagcagtgagagaaaaacaactcattatggagagagcaatgataaaattcttatcagaacagtggaggccagaaggaaatagagtgacatattcaaaatgctgaaggaaaaatttgcaactacaagttctagatccagcaaaattatccttcaagaatgaaggtttagtaaagacattcccagataaacaaagacttgctttataagaaattccaaaggaagtccttaaggtcgaaaggaagtccataggaaggaatgagaagctccagaaatggtaaataggtgggtaaatatggaagtctatatacatgtctcttttcttaatttttaaaggacctaagagtgtttaaagcaataattataatactgtattatttggtattgtaaaatatgtagatgccatatatatgatagtaatagctcaaaggatgacagagaaaatgaagctgaattggagcaagctggccaaattttatcagaattaagtcagtattaatctgaaatagattgtgatgaaatgagacacatagtaattcctagagcaatcactaaataaataaaaagtatacattgaaagaatcaacagaggaattaaaatagttcactaccaaatatttgtttaatacaaaagaaggcactaaaggaggaacaaaaaaggcctgagacatagctaaaacaaatagcaaaatggcaggttaaatctgaccgtataaa

SEQ ID NO: 92577 - DNA, 1020 bp, Homo sapiens
accgttattttatgtaccactaaaaaggtttacatgccatcagttatgaagaggattcttgatttcagagatgttaaaatgtgaaaacacacatgcatcatattcagtggagtggccacgtgtgaatgagccagtacacatttgcctttgcctcctgtactggacttcaaactcaggatggggactgtgagtcttgttcaatattgtgtcctcagaaccctgccagacaattttagatgattaacatgtatattctaacagaactgataacagactctgctcacatgctaaccgttttctcctgtctgcagtcaaagagcagactagagagtgtaccttttcttctagggcctcatttctaagaggctatgacagctcatcttttgctcaaccatggtggtgtcttcatccttttcccacttactggttcagttgtcttatgaaccaaaatatgggatgtaaagaactgtaacccacatagtcttgttgcccttgcttttaagtgcttttcagaattatttgaattactttttttcttttcctactttccacctaaaggttttttctcccaaagtcgaatagaagaatgatgagtgatcttgtgtgcaggcaggtggggagatctggacagtagcaccctttattaaaatatggcccctgaggaacagtcagtgataggttctaatcttggtgtaaaaaccaagatcttggcattggggtgtgagaggggtgatatgaagtcttttccaaacattttttttcaaagtcctggttttattagtgactagaataggctgaaatctggatgtgtttttgtggatgatcatctttctcagttgctccacgattctgccattacattggtagtttttcatgttattaaaaagctttgaatgtttttttatatgtacttattgagatactaggagagcttgaattggggactgttaatcaggtgatatgctgaaggtcttaaatcttcatgtaaactacaatattattcgttgtattttgaaagat

SEQ ID NO: 92578 - DNA, 1282 bp, Homo sapiens
ttggaagaaggagatgggggttgatggtctgcaggtgtccctgggcagagaatgttcctgccccgtgtctcgccctgctcatttctgctcccaccccagcatacctaacaccacactcatcttggcctcagatctcttccttgcttatgctttctctctctaaggtgcccaggtaactggaataaatcatcccttcttccttctcacctccacatctagccatcactaagacctgtctgtgctttggtttcctattgagttgttttgaggacttgagatttgtaaagcatttagagcagcccggggcatgtagtaagcactaagtgggtggtggtgaccttagctcttgttaccccccaacccatgtcaaatccactgttggtcttcagctctacccatttctgctgtttaccatctggtacctgcatctcacattactctgccagccagtccctctggcctctggtctgtgctgtgctttgctgcccagatgatttttacagtatctgtctgaccatgcctcttttctgcttcagactctgttagcttggcagcttcgcagcacccgttgtgactgcccctgccttcctttccactctcagttcacagcactcgctcctcgactgagccaggcccggccataatgaaccgtttgtagtagtgcacacatgctctactgtttaacacttggttcctttgtatttgcagggagccccctgcccccaacatgaattctggctggtctttcagagccttgttgacctgtgacctctgtggcgaggccttttcccccttttcttaataaatcagccttgtactctatgttgagttttctacctagagtcgtactttactttgtacatcttgtatacttcacatattgcactgtattacttatacttgtattcaggtggtttaacacttcaagtggtcagtgtgtggtgctgtgtgcctgtagtcccagctatgtagaaggctgaggtaggggaatcgcttgagcccaggaggtcaaggcttcagtgagccatgatcacaccactgtactccagcctgggtgacaagacagattgagactctgtctcaaatcagacaaaacaaaacaaacaaacaaacaaagaacaaaagaaacctgttgctaagacccagacttcagagccacactgccttctcacccttgctctcctgcccagtagctttgtcacattatccaagttacttaccctctctacactcctcttttgtaaattggagtaataacacttacttcgtaagattgtagtga

SEQ ID NO: 92579 - DNA, 2406 bp, Homo sapiens
gtgtgtgtgtgtgtgtgtgtgtgtgtgtgtgtcagtcaaacagatagactgacctattctgtacagtgggtcaaataagtttctcctacaggcctgccttggagactattactggtttataatatttctatggaaaaatgtgttcaaaattttgcataacttttccacattggaggtgcctgttattccataaagattaaaagttatttgaatcataggttaacacccttagtagtagtttaaactagatttagaggttcaagaaaaaaaataaagtactttaaattgtgcctgatgattcgaaaattttattttaaattgttcattcccccaaaggggaaagaaagtggagagagtgtgtgtgcatgcacggacatgcataaattagggatagttttgattgattttagtcacagacatcctaatcatgttttgcctgaattttgtgaaatgagtaaattatctaatttaatggtggatttcaagaatattggaatattagaaaataccatgtcatgggctggccacggtggctcatgcccgtagtcccagtactttgggaggctgaggtgggcagatcacgaggtcaggagttcaagaccagcctggccaacatagtgaaaccctgtctttaccaaaaatacaaaaaattagctgggtgtggtggtgggcacctgtaatcccagctactcgggaggctgaggcaggagaatcacttgaacctgggaggcagaggttgcagtgagctgagatcgcgccactgtactccagcccaggcaacagtgtgagactccacctcaaaaaaagaaaagactgtcatgttagccaggatgtttgtagatacgttacagcaaattaaaattaatgaatttgatttatataaggaagtttatttgacttgagccatcatgtattgagaagagtatacgcttttcttttgtaaattctaatatttagcactttttgttgttttgtcagtcatattgttaaaaaggtaaaggcagagtacaaagttggtactggagaaactagtttggggaaacaaccgatgttctgtcaggacgatcctgaaattcatattaattactttttaaaataattgtgccttgagttatgaagaaagctataatcctgagccatgtaatcccacacggcttccatgcagccaggagacatggagtgctgggcactgggcatggctttaggccttgttttttccccccagctcttctggagcctgtggtatgggactctctctttagggtgtccacaggattttaagctcctgaagtttcattccttatttttttttctgggaatactgtgttatgcataagtattttttagcttaattcacttcagcttgatgtttgtgacttggcatccctcttctaatagtgctcttactttttataggtatgccttacactttcttgtacaaagtggaatttcctactgtatcatgatcatcataggagtggagaacatgcacaagtaagtattcactttgttcacatgaaaatatatatttcacttgaatagaactgcatcaaaatagaattttatttattacattaaaagtaattatgaattgtgataattttttaaagaagaattgtcataaatacaaaaataaaatcattggtatgcatcattcttctttttacttaaagcaccgttgacattttgggatggatgattcattgacattcagtactaacctgtgccttctaggatgttaggcagcattcctggcttttaccacctagatgccagtagcaccccttgagctgtgacgaccataaatgtttccagatattttcacatgtctcttggagaagcgaaattgcctgctgtgaagaaccactggcttagtctgtaggtgatagcagtggagagatgcagtgaactgagtagactggagagagagttagaaggaccggtaggaaataaggtgtcaaggatgacttccgtgtttccagcttgaggagtagagtagatggaagcactgtcttctgaggtggggagtcctgaaagtggggagcatgtagaaggtggcataggcatttcaagtgggtatatattcagcccctaaacgtgtttggtatatagtaaacactcaatgaagttttgctgtgtaagtgaatgatgactttaagatatctgtaagacatataagaggagattggtaactaagacatgtagtaggagctgggtagctgggctagagatggaaatttgggaatacagatggataaaatgtacttgattgaaaacccaggggcagagtctattagcagatcctgctgggtgttctgcaatgtctgagctatgatgtatgacctaggtaccatatttctgaattctgaatcacatatgtctgcaagaactttgtataaagaatca

SEQ ID NO: 92580 - DNA, 1050 bp, Homo sapiens
gccgcagtagattcccctttactcctattgccatagactgtcctgcatcccaccagatcctccaggccctggtgcccttatagtctcagggaacttggggacattgacccctcccagagcttttgcgaagaaatttagtgctcctctttttcacgggttacagggttccctcagtcattaaaacacgtttctcttccctttaaccgataggtgccctgggctttttgtttctgtgtctgcagaccagtgtcaatcagatttttccaggtgtccttctacacctctccccacgtggccacacctgtctcctgccaggtctagcagagacagtattggtgggcattggcccatcacttggaacttgaggctcatccttgggatttccctcaatttttgtttttgttttgttaacttggaaggtcaatttttgtgtaaccttggtgtttttgtcctgagaatttcaatgtaacatgatatgaaaaattcaggtctgtgttgctaatacaaaattttaatttttctttacaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtaagtaattattttgatccttttaaaatgaagactatttggatgtatttgagaattgagtgtgtggaaagatacattatgtagggttttgttcttatatttacttaaaaagttttttctccaggccaactttcatatttttatttttgaaacaaaaaataacgaatgggaaatgggcttgctctctctttagtcttagaggaaaatttactatttataatttgtggaaagacagatgaagaggatataaaggcatttgattctgtcatgagtagttctttacacctattttgcaaatcttttatactgacagaaaagccatttaaatgtgtttttgtttgcctgttttttctctgggcaagtagcttttaagagc

SEQ ID NO: 92581 - DNA, 1658 bp, Homo sapiens
ggtggccattgtccaattttctttaaagagctgccccaagttacagtcagattaacagtgtagagcaccagctttctcatgtccccagcagcactgagaggcggaagatagtgcctcactgatggtttatttcacacttcgttacttatggttgagagagaatatttttcagattttattggacattgatatttgtaaattgttcattccttttgcccagttttctattgagtggttcatagtttctcatgggtatccaagagttctggatatgtagaggtggagggtcaatctcatcacttccttgttttaaaaatcttccatggttttgtcatcactatgggctcaaacgccgtggtgtggcatacaaagccctcacttctgaaccaccctgcttccagcctcatctcccatgatccctggccacgcggtgcgtttgcgctttcatgtccaagtgcttccttcatgttgttttcttccttacaatgccctttcccttattgtccaacagagtgcttctcacaccttgaggatcataagaacctgtgtttccattttattttttatacatatttttgggcctatctccccaaagactttgattcagtgtccagtgtgaggcctgatctcattttctttatctgaacgatgacaatgttgaaaagagatgatttcaaagattctgtaaaatcctgtatgtgtgtggtccttgacatactctttcttggaaggaatcatactttgtcttgtaatgtatgaatagactgatatggaatgggggaagggaagctgccccctcctatggttgtggagatcagcgggattgggaaatgctgcccgccctgcttacccctcacatcctttgtggcaggcaccccttcaggcgtgctcttctgtggtgtcttgaaggatgttctatataaccattaaaaagactctgatgttgggttgacgttccttctgtatatgtttatgttttccattaggttctaaagtcatcctgagctaggactgggactcatgcatgtttagatttcccatgtttgcccatagtagatgctcagtaaatttttgttataataattaaattaggagctatctgaaaaagaaagaaataagagatacttgaaacaaagttttaaactgtaagaagccatgtagatgtgagtagttaatatgaagaacacaaatttttccattctattcactttttgcttaattaaaaaaaatgccattagaaccctttagaaggcaggaagtattagaaccttttggaaagacattttgcttttattgagtctgttttaaagaacaattgtttcttagacagtgtacaacaacgttctactgtttttctccttgatatgtgagaaagagaacatacttgtctgtgtctttaggcagagatatttctatgggtctatggaaatagctacatgtagatagtgtgatttgttcacaatttaggtgcctgaaacactgattgttttgttatgtattttttttgcaggttcctaatgtcaatggattttttcctttatttatagactttaaggcctattattcctaagattctatgagaatatgtttcataagggagaaatggagattttggccaggtgtgattgttcatgcctattatcccagcactttgggag

SEQ ID NO: 92582 - DNA, 1877 bp, Homo sapiens
cagggtatctgctttggacagttttgtgaacctctgtttcattagagccattacatattttttgtgtctatttattacagtacatagtgttactgttaataatacataaggtttaataaaaaactaaaagtcagtatctgtgtaaccaccctgggcaaaaagtagaaacattaccagcccacaaaatcccttgttgtctgtcactattataacccgttctctcccttcatacgtaaacacttcagtgacttcagtgattgtcattttcatgtcaattatgtaggcattcccagacagtatggtttattgcttgctttttggaactttttgtgaagtacatttatatgttgtatatatattcctctgaattgacttgagatgtatggattcttctagaaattatagtttcttcatcttcgttgttctgtgtgatttcccattgtacagataaaccagaatatatttagccattttgctgttaaaggttttatttttccttggcatttggctattatgaacaacattgtattgaacattcttgtacatgcctctcctagtccccatgttagacacatgggtattggagtgctctgtcatgggtaggactattttcaatcctgtaagaaaatactgaatttttttctaaagcacttgttgaccacgtatgagaaatcccattgctctacattgtagtctgcatttggtattgtgacactaaacttttggcaatctggtggatgtgtaatgatgtcgtatttggctttgttttatctcataaagatgtaaaaaatggttctttcctttgcctttgggccctatcatctttacttaactggctgcgaggttggttgatgaggactcttgttttccaaacgtagctgcacgtaagttttgcctgggaaattaaaaacaaaaaaaataattcaaggtctcatttcagactggggaataaaaagttacggagctagaatccaataatctgtttctaactagctgtcagatgatttttacacagctaaacttccacagataagattccagcacagggcgcttgaaactgaaggttgttctgtctgtctatactatgtcttcttagtctggtgagtatttggcagtcaagacacacctcaatttggaataaccacatataagtgctcatagccacatggggccagtgactattgcattgaacaatgcagatctgttcagaaaattgctcagcaataagtgtatagtttgttacgcattttgaactttgatatacactttgatctttcacatcaggttgtatacttcacgcctcctcactcccctttccatcaatgcagggtctcacaaagactggctgttcaccttgggagggactggttaagaatatgttatcaaaaatccgttaatgttatttttaaaaattagaacatattttgtattccatcagtagagatgtggatgtaacaattgattttttggggctgtttttattgatttgttgaagattgtaatcactttgcgctatattgaaatttaaggtttttttactccaaaattattataggttaatttttggcttagtgtagaatgcttaattctgatgtggagataattaacaagcttttgttgggcacgtgtggcagttgatgggcgtgtggctagtggctatcatatttgaacagtgcagatcttttcagaagattgctcaattacatataagtgtatggtttgatatgcattttaaataccctagaaactcctttctcgtgttctagtaagagggaggaaatttaaagcatataaagctggagaaaatatacatataaagctggagaaaatatacaatcttttgtggagacagaatgtaaatttgtggataacatttt

SEQ ID NO: 92583 - DNA, 1051 bp, Homo sapiens
taagcagttgtggatgcagttaatctagtaccttttaatttcataggagagtgtaaataaattccttctcagttcataggaattttttatagttggttaagacagagatcaaaatgagacaagcactcattattagcctggtaggtaggtgcctacctttaatctctgtggtgccttgattaaatcgctcgctttctgcttctgtttccatgcatttgggaaaactcactgctttttggtttgtatgatggtctgagaatatatttagggatttgtgagttaatcaacctttgggagtctggctgtttttaacaacatatggatgtctgggctgtagattggcagttctctgtgctgttgtctggggaggaagaggagaggatgttgtgtctgatgtacaggcttgtcctgcagaacagggcttcttgctggctgaacccagtgtatttggtgtaggtggaattagaatgggcagtggccatataattcaggagataagaaagagtcttaagagaggcatgccaaataaatctctctactttgtgttctcatgatgctatttctctgcctaacataagacttagtggccatcgtttttttttttttttttgtattgttcatttaattgtcctcttttactggcctgtaagttttgtgagtgcggggacaaccatggctgtggtgttcatccattgtacctatacaagaagtgtttacagaatgttgatagaatgtgtccttacgcttcatgtatttattttacatttgtggttataaagtttctagttgtagcaattaatgtttccctttaggaaagatggaagataaatatgagctgttgtattagtctgctccccttgattttaagcaaactcttgaggcatgattcttgcccccacgtgctcatccccattttcctttcagtgaatgaaaggcacagatagagccaggccttccactcagggattggtagtaatgcatagatgaataaaatttgttcccaagccatcagaagctcacaatcaaaaaggaaagtcagactcacaggcca

SEQ ID NO: 92584 - DNA, 1028 bp, Homo sapiens
gaagatagagctaaggaactgaagcatggattccttgtggagggcaggagatgagcagtcagaggttgattgcaaggttttggttgaagtgtgatggtgcagttactcacatgggtcaacttggaggagaagttggtggtgaggggaatcagcagttcccttgtggccacagtaaattttagatactcattagatagtcaagtgagatagtttaatggacagccgaataaatgtctgaagttcatcagagaggtcaagactaaaatgacagaggaaggtgtcagcaacatagagctcacttcagagccatataggactggatgaactccccattagggagtgggctctgcagtttacttccttaaactgagaaagttggacaggatggtctttaaggtcctcctttccaaaaattagatgttcatcgagttctaagagcctttgtaagaaacttgaagtgatgagaattttctctaaaatgctctagcttcttttaagccattgaaaggatgaatggggaagaaatacagacatttcagtattccacatctgtattcattccacaattgcttgtccacaaagtgtgatatgtaacttcaatgaaatacccttctgagagggaaagtaatctcaatcacattgcaaggttttcagttgaacccagtggtggtcaatgtgaacttatttttattaaaaaaaaatttaaacagctttattgaggtataagtgacaccaaagctgtacatagtaaaagtgtaaaatttggtgttttgacataggtatccacccataaggctgttaccagaataaagatgatagacatatctgacaccccaacagtttccttgtgcccttcagtaccgtctccctcctgcctctccctggcctccatccccaggcaaccactgataagctttttgtcactatagattagtttgggttttctagaaattcatctaaatagaatcatatagtaggcactcttctctctttctggcttcttggactccacataattattttgagat

SEQ ID NO: 92585 - DNA, 3320 bp, Homo sapiens
aacaatacatgttttagatactccagttttctttaacacttcccttttttcttcatatactttattttattgtgtatgattcattatggatattattatgcatgagtttaggattttttttctccttgcaatattgagatgtcagagctaattgttctccttttaattcattctcacaggatgtgtagaattcacaaatagagctttttcatgaaaaaggctgtttttcattatttgaatggaactaaataactcaaaatcaaatacagctcctaagggttattttgtttaatgttggcatactaaacaagcttacaaataatatattatgaaataatcgaatctcttaatgacttcttaaaaaatttggctcaaaggatataatgttctttcaaaagttgtcatataatgaatcctttctcaatactcacattaactcatttgtttccctagtctcagttatagtattgtatttttgtaataaaacatatttaaactgatacaatagtaatatataaatcatataaagtcatttattctttacaccccaaggtaactgtagagtgtttatacatatttgaaagttgatgttcatatagtaacaataaatatgaatgacatgcattgtttgtatttttgatgttactttgcttatcagaaatggtggtagtttaggctatcagatggtcactgacctccaccaatttaaggatgctacaaatgaccagcaagtagatattaggccaagacccaaaccaaagcaaaatagtggggatttgggcttaaccaaggacaaagccaaagttcagttcatctgtaccttaaaaagggaggtgaaatgaggtacttcataatgtttttgctgtttgagagctaattcttcttttatgacatgcaaatatgtttaacatttttgcatttctaatttcatttgtgttttcagtaatgtgttatatactctagtagggaactgaatttagtttgtatatttctcatctgattgagaaagtaatacatctttatcatatgaaacttataaaataaaaaagtataaatagaaaatttaaaaatcacccattacccttcagtccagagacaacttttgttaatatatttttattagagtgtgtgtgtatgttcaaacaaaattgggctcatactgaacataaaatttttgtaacgcagccaccacgttgtgaggaatcccagggcatataaagatgccttgtgtaggtgtttgaacctacaggtccagctaaagtccagatgacagccagcatccactgtctgacatgtgagtgagcaagcctttagataattccagtctctgatgccaaatagagaaacaatgaggtgtccatgctgaaccttgcccaaattccagattccagagcaaaagaaatgtgagtgttttcagctgccaaattcaagggtactttttaggtcatcagagttttcatttggcaatcatatatttttaaaaaattttaatcgaatgtaacttaaatatggtgaaatgcatagatcttaattgtgcagtttgaccaattttgacaaatgtgtacacttgtgtaactcataacctgtgtaacccttgtaaaggtgaacatagtaggccagagtgagcaaggtgtaagtgttagatgctgagtagaaaagactgggaggactttggtcataatataaatatgatgggaagccatgagatttttgaaaatatacttttaattttagaatagttttaaatttgtggaaagttgtgaagatagtacagctagtttccacataccccacatccggtttttcctcttgtttacatgtttcattagtatggtcatttgtcacagctggtgaagcagtattgataattattattgactaaactctatactttatttgatagatttctttagtttttacttaaggttaaggtctgtattagttagctgtcataacaaaaaccatagactgtgtggattaaacaacagaaatttattttctcgcagatccagaggctgtaagtctgagatccaggtgccagcatggttgggttctggtgagggctctcttcctgccttgcagacagccaccacttgggggtgtgctcgcgtggtcttttctagatgcgttcttggcgaaagagagagcaagccctctgtgtctctttttataagggcactaatccagtcaggccagggccctacctaccttcacaacctcatggaatccaaattaccttccaaaggccccatctccaaatgccatcacattggggtaagggcttcaacatatgaattttggggggaaacagacattcagtctatagagtccttttgtgttcctggatcttatgcaggctaccgtattacttttttttttttaaagacagaatctcgccctgtctcccccagcctagagtgcagtcatgtgatcacggctcactgcagacttgacctcttgggcttaagtgatcctcccacctcagtctcctgagtagctgggactacaggcatgcgccaccaggcacggctaattttgtattttttggagagaggggatttcactatgttgcccaggctggtctcgcaagtgatcagcctgcctcagcctcccaaagtgctgggattatagatatgagccaccatgcctggcccatattacatttagtcattgtgtctccttagcttcctccagactgaggcagtttcttagactttacttttttttttttttttttttggtgaccttgtctgctttgaggataactggtcatggattttgtagaatctctccagtgggatttattgaatgtttttctcatgagtctgtgcttatgggtgtttgagaggaagaccacaaagatgaagtgttgttttcatcacatcattccaagggtatgtactttgagtgtgactgatcactcttgatgttaatttgatcacctggctgaggcagtgtctgtcagatttctccactgtaaagtttctctttttactcccactttccatattgcattctttggaagaagccattctgagcagcctatgcataggggtaagctgtggatgctttgaatagaggaattagctactctggtttacctctgaagaagctctcattactgtgtggagggcaagagttgaatcagggaggggagttggcttgtggtcacagtagtctaggctcggtgatggtggtcatggcgggtgtggtgcagagtggcctcatttggcatatacttgaaggtagaactgatatgacttactggtggattgaatgtggttatgagaaaaagagaagactgaaggatgacgcttcct

SEQ ID NO: 92586 - DNA, 1843 bp, Homo sapiens
atccttaaattggctgaaagagtttcaaattttatctgactagttcttttcatttggagaagatcacatcttggaaataatcttgaaagttaataccccattacagtggaaggttggaatttcacactactatcattttattctttttgcagatccagtattactattattaattggtttacattgtcaaggctattttatggtatgtgacattaaaataaatgtctagctggaggggaataaagtaatacttggaaaggtcttgataagtccctgtcagtttttcgtttttctagaaagtgtatattgatttttggccaaaatgttttattttgtgataactctggagttatcagctttggagtttaggtttaatctgtagtgtgcttcactgtgagtgtcagcatgccttttctaatactaggactgacacagctgttcttattacctatatcccaagaatagcagtgacagagatttttggtttgcaagtagagccaagaagatgaaggtagaggacaggggagaggtttgttgaactagtacttagtatctttggagatagttaaggggtccttagtataagcttataattttgggtgctgtaattatagcccttgtgtatttcttgtacgatgagactagttatgtcttcaccttttgttcttggaaaatacttttaaagccacatagtaaaggaaaattttggtaaacttggcatcaaacattgagcctcagctgtctattagacctggatggaaattctgatatgttaatcaaaattaattctaagtattgttgcaatttttatgtgaattgaaggaattcatttctaaggattcaagtttctttttaaggtgtaagaaatataaattaatggagaaatattccaagaaggtttttggcatatactcagagttttactttataggattataaagtgatctattaaataatttttaaatgaatatttcattgggtaggaaatgcttcagtagattaaaaaattcttagaaattaatagtaaaatagtatattaaagataaaaggatgttagtaccatgtcagcaaagactataatgccagaggctggacttggattgctttcctttttgtattttattgaaagcaggaaccactagaaaataatataaaaatattaaactacttttcctattttgtctctatctccagatttgataaatgtgtgatattggagtttagcccttgtgaaatgaaggagaaagtataaattttctcagaatcctggagcaaaggtgcaacttctagttaaggaaactgcagtgtaaagaagggacagcctagctcattcagtatttattgattgccaggctttttcctaggcctcaaatttcagagagcagagggtcgagttggcagggtttgatgatatagcaaatgaaaaaacaaacgtgtttcatacatttagattatagtgactaagatcgtggattgaggagtcaacctgtgttccagttgtggttctgcaacgtagcatcccttacaagctgtgtgagtttatctgtgtgcacaagagtgtagtgtgtaatgagtactctataaatggcagccatggctgccattgcaccttttgtgcaaactgcttgtgtgaaataaagttttatcaggtgttggttatctggattgtatttgaacacttcttctggtgcagcgcttgttccctttgttagggcagccagtttcatttctagatagttgtagttgctagagagtttgtcatttacatgcttgcaaactttctggagtaacccagaagtggtctgaataagtccacttcttcgtggttacctttcagagaatt

SEQ ID NO: 92587 - DNA, 4207 bp, Homo sapiens
tttttctttaagccgtggtttccttatctgtaaaataaggataataataagtagtagtacctatttgtaggttattgtgaagattgaaaccataatctttgtaaaatgccaggcctctagtagatgtttgatgcacagttccttcctctttacaaattatcaaatttctggaatttatttatgtttttattttgagacgttaacatctgttcatatgtatttcatttttaatctttaggacttgctttttaggaagggaaatacaaggcttgggttcggtcgtatgcccacacagtgattaaactaggattaaaatctagttttgaatttggagtcaaaagtggtttttctgcttcctcactgcttcaagagctctttgtctccctgctttaaaaatgcttcctatgttgttactgcctctgtaggtacaaacagccttcatctccttcaactcggtttattgggtccatcagggccaactttccagggaaataaaaacaactcacactcagcttttggctccagttggtttaacaggtgggactctacaatgatagcacttggtaagattcctttaaaataaaagcagccataaatacgaccctcagcagagtggtcttttaatgatttttatgcgtgctatgggtgattgaagcaggcttttctcagtatgtagtgtgtggcaactggggcagctgatgggtggaaaggtaggctcaggattcaggagatcggaacaggcactggtgacgtgcctcttctaccatggcttcccaatcctaaccgtccttcctgtatccactgcaccttgcacacgaatctttttctgaatcccatctgatgtgactgcttccttatttgagccacgagagtattttggatttggcattgttctggcatttacattctgcttaatgttatacgtatcattcagggttctgctaagagatacagattgaagtaggtaactaaggcaaccaggtaacttaaagagctatttacaaagatgtgggcaggtcttgggaaatcagcaaggaatagcgaagttcccgagccagctgcactagatgtggagggtcaagagggaaggaaggagcagaaccccaagatagtggctgtggagcaggggctgcttcacagcaggggaggaagagctatggcctccagttgaaggacgcagccagcctacagcgaacctgagtgagggctgcggccgggagagcatgcccctgcctctcgcttctcccatcctctcatctcctgctggggtctacttcagaggacaagttggtgctttgggggcacagaatagagaggagagtggatctggaggggcatttaaatacaatccaggacgttagggttgcttcaatatgacttacttctctacccgatgaatacaaataaaaaacctgttgtcagactcctttatgcacattgttattttgtctctttcttctcagtcatacattttgaaagaatagttgatttcctaattccagttcacttttaaaaccactataatcaggcttccgtctctgatactcagaatgaaatccagtggcaaatgttgagacatgcagcactcatcagttacttccttgcttaaaactcttaacagcttccagctgccgagccattgcggtgcatttttaaagtgtggctctgagaccacctgtgtcaaagatcactttggattgttattaaaagtgtacattcccaggctctactcagggtatacccaatgagggccagggagtctgcattttcgacagggcccctgcttccccccacctcccaccaccatcacagataacagacttgggccaaagtttttaggctgttcatattattaaaagtttattaaaatggaatgtaggccgggcgcgatggctcacgcctgtaatcccagcactttgggaggccgaggcgggcggatcacaaggtcaggagatcgagaccattctggctaacacggtgaaaccccgtctctactaaaactacaaaaaattaggccgggcatggtggcgggtgcccgtggtcccagctacttgggaggctgaggcaggagaatggcgcgaacccgggaggcagagcttgcagtgagccaagatcgtgccactacactccagcctgggtgacagagcgagactccgtctcaaaaaaaaaaaaaaaaaatggaatgtatttttaaaaaatgtttatatttaacacattaacatgtactcgccaaaacgtaaggcagtgtaattgtgctattgacaatatagtcacaagggaaaaataaaattcactgtgtactctactctaggcaatttggccctgaaacaagacaatattaaagttggatggtgtacacatctcccttcagtcctgtcactgcatctctggtgactgtatgtataatctcatatgtagaaaatgttgaacgtctacatttggggtccttccggaatgggaggcctgagccaagtgtcccttttggcctactctgtgagagagcctgctccatgtgatttttttttctctcctttaaaaattgtattgattgattgattgagataggctggagtgcagtggctcaatctcggctcactgcaaccagtagtgagattgccggattatgtggcagttctgttcttactgtgagcttacctttgaaagtctctgtctgatggggtaggcttggaccctcagaaggatggcttattcaacccccgacccctgacaaactctcacactctttccacacatgccgagtaaattgcttagagcaacgtatgtggcgagctggaatttaaatcctggctttctgctgcttaaagtacttgcatactcaattacttaaaatgctcctcaatacattttctctcttttaactccttgcctttgattaagctgtttcctcttgaaatccctgctacactttttggcttggcagatccgtatttttcaatagtcagctaaagcctatgcctccttgatgaagcgttttaagatttgccccatcctttcctccctttttgggtatcttgcatgcatgatatgttcgtgcatgctacacctacatgccctaagtatttgtaattcttctgcctcaggctgcaggcattccaggtggacccatgacttgggacctcttcacacagctgtctcgcatcccatgcagcatttatgtcatgaggccagtgttctggagaaggaccgagagaagagaggcccctggtattcctgatctgcctctctcctttgctctggactaaccagcctgtcctgtttctgtacagcagaagcccagtgtcatccagttctttcttaggaaggagttaatggcaagatcccatgcggggtcctcgcccctctccactgccttcttgtcatatgtgagtacccctccaactccaggaagcagtgctgcgagagaatgcctgggctgccctgttggttagggccctccgaacagtcccatcatgccccgctttcactgtattctactctgataacacctggagcattgattttttttttgtttgctttacaagtctccctcccaaactaaattccttaagaataaggacctccacttactcatctttgtgtcccgtctgcctaggaccattcttggcacggagcatgtttagagtccgcagggctggtgtgatgaaagcatagactggctcagcttctgactgtcccttgttagctgtgtgctcttggcaaggtgctgatcttttatttgcttcagtttcctcatctataaagtagttcacgtagtgggtgtctccctacggagttgtggttagcactgaggagacaatgcacacggagtcagaacctggcgttttgggtgttactgactttaagtgcttttccaggggctggagagggcaccatgctgtttaaggctttactttcttcagagcctaggagagtgttctctgtcatccattttgcaaggagtgaagtgtctcatgtatgccaggtggtgaacaagacacagggtacagcggaggtactgcagttgaatgcagtgattttcagacataaaacaccgcagctccttggagcacttcctggtagagagggccaggtcctgctgaggaagttaggaaggccaggttctgagggatgcggtctagtgggtctagtggggtcatgctgggtgttcccaggggacttttcctgggaactgtgcacttttcctgtc

SEQ ID NO: 92588 - DNA, 1388 bp, Homo sapiens
catctctttcttgcctttttaaccattttctgtccttatttctcatgatgctgtaattactgctatgaaactagagtaaatttccctagtgatgtgatatccaggatggcatacttggcagaaggccagttagggatgaagctggcctgtataaagtcattgaacagccatgtttagggacaggggtcattcattgttttacagataatatgctgaattccgggcagggaaaggggcaagatggagactcaggatcttttgaaaggtttggacggggaaggggaaggaggaatggttatatgttactaatcctgcaaagtcagataataattataatgtctaacacttaatacagttttcaaagctgtttcacacagattatattatttaatcaaatcctcacaacacctggtgaagtcagataaagttcaagacctgaagtatttagcttcacgggtgtgtgtgtgcgtgcacgtatgtatttaccatttgaataaaaaaggtcaggtttagtttatggtcttaataatatgtggcaaatatttttggtagatcattgttttagatcatatttttggagggaaaggaggagagcaactgaaggtccctgaagtcgacactgaaggactaggggttgtggttgacacagagaaaatgatgatgtgtaagggagagaaagcattgtgggcttacgagatccttgtttcctttttggacagttcattgactgatcttttctatatattcccaacccccgccccccgctcttcccctgcaccgtgcagataaccagtgaagtgaagttgatgttatggaaaagggtagttgaaaacattcacttctttaatcttcctgcaggtctgtactatgatgaattccattttatagatgaagaaacaggtgaagttctcagtattgagccttcttaagagtatgacttttaggaagagaaggtgaatggcaacaaaacaagcagatcaaagatttattttcaacttgccatttgaatgctctaggtttagaacataaatatttaactcatttctctctcctgtctacttttacactcataatgagcattagtcttcatcatgagaacactgaaaacccggagagtctgctgtgaacgattccttttcatcaggaaggcatatgggactgagaatcttgaatctgtgttttagctcctgtcagttaacggttttagatatgttactatacatgaatgagtttcctcctctatgtgtgttgggcttagttttaaaattccatgattctctgtttgtcttattaactgataaagctgcccaaattctttttggaccaaattggagagaaaataaataaaaacttagaggaggaaagtgaactactaaattttgaagatg

SEQ ID NO: 92589 - DNA, 1119 bp, Homo sapiens
ccctcagcaacgccgtgcagctgcccatcgaccaggtaccccgaggcgccctggcgccgggcgtcgcgccctcgccgcccctccccgccgcggtgccacccgaccgggggcccgggaggagggtgggggctggggccgggcgcccggtgcccccctacccgccgctccctggaagggagggggcaacaagccggttattgtcccagagccccctccctcctgggtgcgcccccagcccgccatccccgggccgagcgggaggtgggccgggcgttgttgccggcgacagcccccggggagggtggtcgtatgggcgtgcgggtgtgcatgcggtccctgcccttcgcggcagcggcgctcggatccggtggtcgggtcccggagcagcccccggtgcgcatggaccgggttgtggaaagggtgcggaaggctgcgctttggggagcctggcgtggtgctgcctgccccgcgcgcgcctctgagcgacccccggagaggctgatgcatgggtctgggtgtgctgggtgccttagagacggcgtcgatgggtgctaggggcccggagaggcttaagcgctactgcactttggggacagtttgcgttggattgtggcttaagagagacagaggcaacagtttgtgggaaggcagacaggttatgaagaaaagtcggagttaatcccaggattcttgctgacaaagtggcaaccttgtagattgatgcagccactttacctccttgcccagccctcagaaaagctcttgacagtgtctagggaagggtggtatttaaatgaggccaatcgagtttgatggtttaaagggcctaacgattactgagaaataaacagcattgtgatgggaaaagcagcgccatttttactgagaaaagaaagtttggaagtattttgttgtgacagtgagatttagggaagttgttaatgaggcgggggctggggggcgggggtgtatagttaggtgattgctctagccccaggctaaaggtagttaactttggaaattttgcttacagttatttcaagtgtacttaacctggaagtgtttggacttcacacgggatactggttcactgtcttgaacttgaaggtgctgctgtca

SEQ ID NO: 92590 - DNA, 1047 bp, Homo sapiens
actgttgaagtccgccaggtttacataccctggcgggtcacgtgtatatataatccccccaacttcgtaaaagtaagccatttgagttcctttaaaatgcaaacgtcaacttctgttcagaagactttaaaagaggagaaatgccacagcagttatgaggacaaatcaagactcaaggatttggcagtttaactttggtagaaataactaatgtttactgagagtttaaccacagctttaatacttttggtatttaatcctcacaataaccgtgtgaaatagacacttttacacaccctccttcaaggaagttgagtcacagaagaggtaacttgcccaggggcacacagctggtaagtagattggaatccaagtaaatctacatttagagccgaccttatcactaggccttcatctctctcacacttaacacccattccagaaactcccgtcagctatcagttataccattgggttgatgactagcttagagtcttgaataagaaggcagcacagataaaaatacacctgccttagtaatcagtctgtgggcttacgtttgtctctctgaaaaggaggcagtggaactcatcagtgcaatcccgtcttgcctagaatcctttcactggtcgactcaatcctagtttggtggattctcagctgaaatggaatagaggataaaaggaagagtaaaaagaacaggaccttcattcccccaggggagtgttccagtgggatttgtaatcaattagagagctgcttattacagtatattaatccaaaaacccagacctattaatattatattagaaagaaaccatttttttttccttttcttcactttagaaaagtagaggaagcgcacaggtggctgagcatacaaactgaagaaaaaattgaaatgccattttaaaaacttgaaaggtgggtgttgggaacatattgcaacctaaagtaagcagcatggagatacaatctcagagctagaacaaataatgtctgcagaaaggagtttccttaagctaaatttttattttagtcagacat

SEQ ID NO: 92591 - DNA, 1018 bp, Homo sapiens
gacggatggatgggtggaaggatggatggatgatggatgggtaggtgggtggatgcgtgaatgggtgggtgggtggaggaatgggtgttttggtgtatgggtgggtggatgggtgaatgggtggatgggtggaggaatgggtgtttgggtgtatgggtgtgtagatgggtggcagagacttgcaaaagtgccacagtgccttagaggagtgatacagtatcaccacactctctacctattaggataatcgtaccttcctgagcacttctagaaatatataaagctccttccacttggcaaagataagatgtaccaggggaaattcttagctcaagatatcaaagcaagaagagttgaactagattttcctgcaaaggcatgatgggacagaaagaccctgttagttcagattacaccaaataaaaactgtatttcctttgcacatctcagttgtagcctgagtgggtactgaagctccacctgggcctcagtaccttggccttccttcccctgggagctgagaactaagtactggaagtttccatccagcagcccacatgccctgcagacttgaccctcctctatgtcttacagacccaggcaggatcaaagtgctcatgggaattcaaaggagagcacaatccgacagaaggagcgggtcccatatttcacagaggagctggctttgaaggatggtaagagcttccaggcagagagaaccacctgagtaagcgtctctggcagaaaggaaatgtgatgtttaggggaagtgaggggcctggcccaggtggggtgaatgaggttgtttggggctagactggcatgggaggggaggggctgacagtcaacatgaaacacactgacaagacagaaaaacgagtacaccgatttaaccaataaataactgaataatctggaagatttcagggatgtgagattagaagaacgaagacaagcgactacttctcactcatgaaatacaagcatcctttgagcctttggtgctgtctacgactgt

SEQ ID NO: 92592 - DNA, 1822 bp, Homo sapiens
aaacagattctaaggaatcgacaagaataaactgtgcctatagttttagataaagatgcaatgttgctcttttgtggttaaaagtggtagctttggcttcgtttattattttctcagccatcttattcctggaaagtcctcatccttcccgcacagccactaagccgatgattttacggacctgggctttctctctgggcacaatgtccacctggttacctggctattccagccagcagtcagatgacagctggccacatgatagcactgacctcaccttgaccagcacgtctctcctcctattcaagtgacttctcagggatccatctgtctggtcttgttctctgcaagctgagagggaccagtctcgttgccaacatggcaggaagaaacggttttggaaccaagtgattgaaagactcttccgtaggaaaccatggtctgtcttctctagggccgtttcctggttctcactgcaggtgttctcctatcctaaagtcatgtcacttcaagaacacttctggccgggcgcggtggctcacgcctgtaatcccagcactttgggaggccaaggcggacggatcacgaagtcaggagatcaagaccatcctggctaacatggtgaaacccatctctaccaaaaatacaaaaaaattagccaagcgtggtggcaggcgtctgtagtcccagctactcaggaggccgaggcaggagaatggcgtgaacccgggaggtggagcttgcagtaagcctagattgtgccactgcactccagcctgggagacagagtgagactccgtctcaaaacaaacaaacaaacaaacaaaccaaaaaacacttcctgggtcaggtgtggtggttcacgtctataatcccctataatcccagcactttgggaggccaaggtgggtggatcgcttgaggtcgagagttcaagaccagtctggccaacatagcaagacctcatctctactaaagaaaaaatttaaaaaattagctgggcatggtggtgcacacctgtagtcccagttactcaggaggctgaagcacaagaatcgcttgaacccgggaggtggaggtggcagttagccgagatcacaccactgcactctagcctgagtgacagagcaagactctgtctaaaaaaataaaaaaagaaagctgctttctgaagacagaggagcttccacaactgtctttttccagcatttaaaaatcttccactaaaccatctggtctctcttagcccacaccttctccagaccgaagcaaaactgttagcactttttataagaactatcaagcataagaggttatttaccttgaagggataatcatcaggatatagtcagtgatcgtttattcacatatcaaactaaattcaacagatagctatgaaatataggctgggcacggtgactcaggcctgtaaacccagcactttgggaggccgaggtgggcagatcacctgaggtcaagagttcaagaccagcctggacaacatggcaaaaccccatctctactaaaaaatacaaaaattagccaggcatgatggcattcatctgtaatcccagccactcaggaggctgaggcaggagaattgcttgaacccgggaggcggaggttgcagcaagccgagatcgcgccactgcactctagcctgggcaacggagtgagactccatctcaaaaaaaaaaaaaaaaaaaaaagaataaaatataaagcaatcttaggtgagaagtatttttgaaagtgtgataaatttgaattacaggccggatatgggggctcatgcctataatcccagtactttgagaggctg

SEQ ID NO: 92593 - DNA, 1029 bp, Homo sapiens
atatgggaagctacacgtggttcgacctgttccccaaaccgcagccagagagagattttgagaaggcgaatctgcctgaaatggttctgcggctctccactagcttgggtaaagtctagcttaggtgaagctctctctcccctttgactctgcacacactgtctctcaccaccaacttccagctcatagtcatcagggatcccttgttcatctggatcagagccctccctggactcaggcaaggcaatagcccccacgtgttcacccactgaacttgaacttaattgtaccttcttgttagagtctgctctcactctggattgctggctctaggggctcagggactgtggctctcttgctcatccctggattctcagagctagcacaggatctgatgcataacaggaattgagaatgaatgaatgaatgtgttaggcatgactgtatctgtgggtatattcgacatttgttgagaaattaggctgaaccgttaagcagtctggactgcaaagggccttatatagcacactgaggaattgggatttcattcacagactgcggggagccattgaaagatttttaagcgagtgccatactagatttgcatttttgaataatcactttttgaaagataattatggcacccacgtaaacaggatggattggagagttgtctaggctggagataagaagatttgttgtgccgctgtattcacaaaaaaagagtgagggcctgaattgatgagggatgaggggagaatcaagggcagggagcagctctgtgggtactatgtaagtagaatcatcaggacctggtgactgactagatttgcaggatgagggaggagaaggacttcaggatggtgccaaggtttctggttggacaactagatgaggaagaagagcaaattaaatcacagaagcatgctgcaaatgatcagttgactttgggttggcactcgctggggtctcaatcaaagaaaaccatgttttctacttcttctggttagcctttttgagcaaagaagc

SEQ ID NO: 92594 - DNA, 1035 bp, Homo sapiens
ggggcacaaagggggcattgatttgctggcaatcctgccatggaatcccttggtcacggcttttccatgccctgtctccagcatactcagactgatccagtgtgcccaaccagccgtttccacaggtctggcccggccagggaccttcttgccacattctgggctctgcccactggagagttcaggacaggacccgggtgcagaccggaggcccaggcgcagagttgttatgctcagggccatatggaaaatgtgaacagggcctgaacaaactgcacagctcacttcttggcatttgcaagtgggactcaccaagatgcaatgcagaggcggccagtgaggtcaactttggctgagaaccccgaacagactgggagagtccaggagagaaaggaagggacactggagcaaacataacggggtgtagccctgttttaaaaacaccaacagagaaagcaacctttggaggaaaagtgcatggctccaaatcccaggggggcccactcttgtcgggggtctgatatctgacccctgggctgcccagaagcattcactaaatgctgctctccaaccaagttaaaagaaaacaactcccaaactctttgcaaagagagtcacacacatggccttgcagactttgggaattccgcagaactgagaaaatgaagtctctgtttcgagccatgactaggtctcttatatgactaagggttattacttctgcttagaggcaggaaacatccacagctccaaatcctacaggccaaccaaccactctctgtgtggcggttaggcaagcactttcagagtgaatgttgggcacttacagatcccttgggaactttttgctctctgatcacaactctgcaagtggttccccagagatgtgaaagagcaagtgctctaagaaggcgcctgctcacttacaaacccactcacctctaagattcgccccacacattcacagacctggaaagaaattcaaagtccttttttttttttttttttttgagacagagtcttgctctgtcgccc

SEQ ID NO: 92595 - DNA, 1029 bp, Homo sapiens
ggaaaccactggacattctttagcccagggagaacatatccagataagacacaagtggacttctgcaccaactaagagggggccttgcaaaattaagaatgggtcttcgtggaggcggaagagactgagttgactcaagaagataaattattgcatgcactttaaaagctttagagaaacttatttacatacagagtgcttattaaactcttttttgctctttcattaaaacaaaccacaccctctgtcggtactgggttgtgttgttctgagtacttgaaaacaacacatggcattttcttaataactcaaagacaaatactttttattaacacaagttcctttgctcatatagtccaatttactgagattttatcctgtatgtgttttaagtccataagagtgactcagagctggaagttccaatgccctgactctggacaaggatgatacaattatactcagaagtgggctggtcaatgttcaacaatctactctctgaaaaggtgtatgtgtgaacataagtaaatacgtttattttaacttttactgatttaaaaaatgtgtagcacacaatttatgagtaattacaaattacacactactctttagtgtaaattccatatagttaattgattctcacagaatggtttcattgattttggccaaatgctttcattcatagccaatctgtgtctgcaattcaaccacaatttgacaaaataagactataaataaatgcttgattattgcccagctcagcaaagttgctcatgtcattaacaaatgagtgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcggcgcctgtagtcccagctactcgggaggctgaggcaggagaatggcgtgaacccgggaagcggagcttgcagtgagccgagat

SEQ ID NO: 92596 - DNA, 8073 bp, Homo sapiens
cggctgtggtccccgcagggtgcccgccggcggagcgcatcctccggcagggggcgagctccgcaccccgctttcctcatgggccggcgcggcccgccgttcaagtggggagcccagaggtgctccgcgccgtgggcggggggcggttggcgcgcacaaggccggactccggcggggcgcacctccacacgcaccctcgcgggcagcgggtcggagtcggggcctcgggccggctgggggcggggcatgggcgcggcgcgcggggcccggaacgccgagacaatgcggcgcgcggcggccaggaacggctcggcgggccggggcgcgcgccgccttccttcctgcgggatccgcttcccggcggcgcggcagcggcgagcgcgccgattggcggcccggtcctcccgccgccccgccccacgcccggccggccgccgcccccggcccggacccgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggtgaggcggcctgcgcggcggctccggccgcaggtatcccgcgccccagccccgcccgccgctcccgcatccgcatcccgagaaaactttctttgctccgaagccggacgcggccgggccaaccctgcccgagacagaagccctttgttcccgcctaggtggctcggaggagatgggtgatggccaccttgggcctctttaagacctcccctctctcggcctcgtggccctcgcggggttccgcggcctggtcttttccccgcagcgcggccaactttgtccagagtcggggtccgcggcgagcgggggatcccgctgcccgccgccgcccgccgccgcccggggtctttggtacccggtgcggaccttatcaacttgttcttgaagtggaccggcgggggcagctccgcgctccgagctccccgccgcagcccccgagcgccgcagggcccccaccctcgggtccgcgggtccggggcatcccgggctgcccgggaaggcgtgcccgcctcagccagggcggcctggctgcgctccacccgtgcccggagaaggaactgcgggcaaggtgtgtgagagtcggcgcttctgggtccaagaagcctccaggagccgctccccggttacctgggtctcacctgcttgaacccggaatgccgcccttccccctcaacctggaaaaggcctggttttagtaaagtgctctcaaggtgcaaagtcatcacgcctagctgctaagcagtacgctctccaggtcctggggagaggaacacgtaggaacgaagaagcttggttgaaaattaaagccgtggggaaaggggcagagtctgtgagtccaggggccaccgttggctgtggtttgaggcacatcctcacctgcagtcctccttttccttacccatcaaacgggattagtaatgcatcctttccaggatcagagactgtgtgaagtgcttagcactctgctcggctcagaataggtttacaagtcacacgtgtggcaatagtgaatctgtgattaaatgtctctgggccaggatgtcaggttacagttttaaaattgggtattgcaggtgttttagcagaagacgcctgggctagcaggagtgtgtgtgtgggtgggggggtgggtgtcaccaaagagctttaaatgaagcaatggcgttattttttttttctggtttttttttttttttcccatttgaacaaagcatctgctattaggaattgcttgaaaaaaaatccagaatgttttcccttaatggaaaaattttttctttgtagctgtaaacagtcaataaaagggagtcaaaagtaacattcagcattctgaatcctgttaatataacttgggtagccttccttctctccatttaatttggcggaagagagctgcatgtaaacctttcctatgaattcggtgattccccagatcacttaattctacttttagcagcaaggcttacagatgatgccttcaaatgaggcagatggggatgggtgaatgaaattttttcctaagtgccagttaaaaagcacggtgttttgagaatacaccattaataatgtttatggaatgattgcaaccaaaaaggtagctgaatatttcttaagggaaggaagcattgtgcatgatgtctttctttagaaagcttgattatgtttaaagttctgttgcttttccccactgcagtttgtcagttaaatattattaacactggcagatgttggaaagccaagcaaacaagaattgctattaaaattggcatacctttctctgattaattttagtttacagtgtataattccaaagctctttttgtatgctgtgcaggagattaccctagagctcagttactgagcagattacaaagagactggatttggtcatttcattaaattgcaagcttgcttcatgctgccgtctaagcccaagaattggttcaagtctcaaaatggaaaaattaaaatcatttcaggtttatttcactttaagcaaatctacatacatgctatgatgatggtatgtgtgagcttggttttataactaaatttgaaagttgttcactttctgaggtaaatcaatgtggatttctttaaataatgctctttcccaggtgtctaatgttcgtgtctattaccaaaacttgttctatgtatggtttaataacaattgatgtgtacagtattttggttttaaacaaaaatcttctcatactgagacgaaacatgagagggtatcatgacataaagttactcatttaacaaataaataaaatttgcaagctcttggtcttatgtttaaacaaatgaatcacggaactagcaaactaattttatatttatttatttatttgttacggagttttgctcttgttgcccaggctggagtgcaatggcacaatcttggctcactgcatcctctgcctcccaggttcaagcgattctcctgcctcagcctcccaagtagctgggattacaggcatgcgccaccatgcacagctaattttttgtatttagtagagatggggtttcaccatgttggtcaggctggtctcgaactcctgacctcaggtgatccacctgcctcagcctcccacagtgctgggattacaggcgtgagccaccacacccggccagcaaactaattttaaactgattaacctttttgaatctgttatttccaatgtaggttctatctgccaaagaatcattttacaattaaaatgtgctgttttgatttgcatacttgttgctggaatattattatagtaactgttgggcccttatcctgtactatgaaactcacaggtattgaattcagtccttatctctgctttataggcgaggaaattgaggctcagagaggttaagtaatttgccaaaggttatagagctctgaagtggactttgaacttggctcctgctgttttcagaaaccatgctgcttcctgttacttttcttaatgccgaattctctaaattactcctttgtcagattgacctgggttcaagttcaggctctacagcttgccagctgagtgaacttgagtgagatgcctaacattttcttattttcctcagctttaaagtctggttaataatacctatcaacttcagaggattgtggtgagggtttaggaagatagtacatagcacagaagctgccagacaattagttaccagattatatagttagtgagtccacaggccccagtgagggcttttggagtgaggatgggatttacatggggggaagtgtcagggaaatggatgaatggctgaatgggtgagtgaatgaaacactaccgtgtatctgttaacccatgtgtttttttttttgagatggagtctcgctctgtcgcccaggctggagtgcagtggctcgatccccactcactgcaagccccgcctcccaggttcatgccattctcctgcctcagcctcccgagtagctgggactacaggtgcccgccaccatgcccggctaattttctgtatttttagtagagatggggtttcaccgtgttagccaggatggtcgatggtctagatctcctgaccttgtgatccgcccgccttggcctcccaaagtgctgggattacaggtgacccatgtgtattttttaaaagtttgttgtcaggccaggtgcggtggctcacgcctgtaatcccagcagtttgggaggccaaggcgggcagatcacttggggtcaggagttcgaaaccagcctgaccaacatggagaaaccctgtctctactaaaaatacaaaattagctgggtgtggtggcgcatgcctgtaatcccagctacttgggaggctgaggcaggagaatcacttgaacccaagaggtagaggttgcggtgagtcgagatcgtgccattgcactccagcctgggcaacaagagtgaaactgcgtctcaaaaaaaaaaaaaaaagtttgttgtcctggcagctggtgagagcatacctgtattttataatttttcacttgaccaccttctctggttcaagtcatcattttgtacaattttagcaaacttagcaaagtctggtgctgcaaccagagtctgccctgtgcttttggaaataatggaaaaaataagcagttgtggcagaaatttgaaaagtaagggttttttgttccttttttttcttctttttttttcgtttcttcgagcctctgggcactttgaaatattctcaaaatagggaaaaattgtatacatatttggaatattcatgtttttagttagaccctcctttatagcaccatccattctgccttacgtatttggcattgatgtagttttaaaaataaatttgatgttgacttgtaagtattaaaatttaatctacttccttccggggccataattctctactttgttgtccttggttaccttggcaatcccattgctgtcataagcacagggttctaactgcaggggtggggtgagcatctgggcctgcaggctcccaggggccctgccgtccatgggaccagacccctcctagcagcaacagtgggaaccagggctacgtgctttttggcaagaatgtgattctgaatgttagccctttgtgacttgtttgaaaaacagttcctccaagtccccagaacagattattgctgtcttcagaaggacatcaccttcttgcccagagcattcatgtttttggaagtgagccttgatgggtcaaacagggccaccttttaaactgtgttctgaaatttgaatttcagaaaattttgaatcacttaaggaagcagccattttctcttcatatgtgagccttcctccctgccccctggtgaatgctgaattcagtttctttcttaggctcaagagtagaagtactgatgccactcctcacgggttccaggtcctgccatgcactcaggattcctgagtccttcagtgtgctgggctgtgtgtgaggtggcaggaatagaacaccaagaagaatatgtcctctctttggagggacctacagtccagcaagaggaacagaatcctgtaaacaaatcagtgcagtaaaatctgaggaccacatctgtaggaatgcttggagtcctgtggatgtgcaagggtgcaggtggtcccagggcgtggggctgtggtgagggagggccttatatgatgtcgtaccgttgagtcttgaagtccaggcagttacctgtgggttaccaaatgctaaggcactaagctggttcattctggtcttctgtacctgcctccctgccttaggtaaatattgatctactcctgaggtggtggccagctcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatgaggcagcctaagacaaatccagctctcagccgccacattgcaagtactcagtagccacacgtggctggtggctaccatattggctcagcaaccaccgggagagccatcacctggaaacttgctgaaatgcagagccccgggttccacccaggacaatttttacagcatctccacgtacaccacaggcacgtgagagcttgcgaagcactgttcgagacggaaccccggctgcacactggagttgcttgggcgtttgtgaagcagagctgcctggctccactccctaaaattctgacttaaattagtctgggtggggcttcgagccttggcattttttaaagcctcctcccaaatagggttgataatcactgataaacagacagttacgtaacaaccttaggcagttgatacgtgctgtaaaggaaagtcatgcataacatggggatagaaagtggttctggagatcaggaaaccgaaatcaggaaaagcctctctgcagaggtgacatttgagcaggctggaatgcagagaggaagccagccacagaagatgtgggaatagaacagcttgggaaaaggccctgaaatgccaatgggcgggatcatggaaggactgaaggaaggtcagggtgtgtggggaggagtgggcgaggaagagaaggatgagagacgggcagaggggtgggcagtgccaggtcacagagggccttgtccatcttggggaaggaatttggattttgttctagtgtgatgggaagctgttgaagggttttgagcagggaataacatggtccgatatccattttaaagacttcactgtggttctagggaaaacagactagcagggcatgaaaggaaagagggagaccagttgtggggtgaggggctattgcagtcatctaggcaagaggtcttggatgaggaggtagcagggggggtggtggtaagtggcctgattgaggtccattgtacaagaagaggggtccaaacctactgatggattgtcattattgtgtgctagtggcatagaggtagacccaatagaactcctgccccaaacagggcaacagccaagctcagttcatccaagccccctgaacagaccttccagcatccccatggtgaagctgttgctgtctagagctacttagtgtcagaatccaggccagctctgtgctgcttgatgtgactggttataggacttgtgttgggaccagttccagggtcaatcaaggaaagattgaagcatagctgcatagactggggcccagggaaagagagaagcatggctgcatagactgagactgagggatctgctcatgcgaccctctgctgtttctatgcagactacagcaggtgatacttatgggcattgtcagatgcctgggatgctatccccatttcagctccccaaacactcctctttctttccctactaaagagaggtgacgttccgtgatatgaacctacctcctttgcttacgccttttctgtgtaatgtggcctccaagtggattgctagggcccttccaggtactttttttcttttctttttcttttttattttgtttgaggtggagtcttgctcggttacccaggctggagtgcagtggtgcgatctcggttcactgcaacctctgcctctcgagttcaagggggattctcctgcctcagcctcctgagcagctgggattacaggtg

SEQ ID NO: 92597 - DNA, 1431 bp, Homo sapiens
ttatgtgtggtatttgtgtatctaaacatagaaaagacagtaaaaatccctcttataatcttatgagaggtcgtctgtgtggttcattgttgactgaaatgtcactatgtggagcacgactgtatattgaaattcagttaggagaatattttaaaaatttttaccatgctcataatgcttctttactaaagcatttaataacaagatttactggtgggtctaacaaataccttaattttgaggtattgatgaatataaacaatacgagatatttctaataaagataatgtaatgttcatatcttttattgcaagtattgataatattaccatgtgttgcttacatttgtaattgaaagatacgataaatttcagttagaccctaatgaaaatacagataattttttttttccaatccaagtttatggaccccctggattcagacagagaattccaggcttgatggtaagatttgtttagctagttttttttttttttttggagtgatggattctttaaccactctgtttgttaaatataattattatatttcataattattatactgtccttgccatgaattggttctaagagtctagctgagaagagttgcaccctaggccagtgttagaattatgaggcgctaaaggtgtttagaagcgctcttggcggggagccatccactgtggttttacatccgtggggtgccctctgttctttcagggttatggcttggcagcttctcatctgatcccacaggtcagttcatatacttgtgcatgcctcaagagttcagcagagctgcacattggaccttctgagtcctgtaattaggattctgagctgggtaggtcctacaacccagctctcctatttgtgcctttcttgtttgtgtcacacggcatgtactgcctttgactctgcagggcaagttccattgtgaagcaccagaagattcatgggcaccacctacccagaattttaagggagactttgcagtgtgtgttattttcagtgagggtatggatttgaaatgctgctgctgttgcaagagtgtgttggggatatccagagtgtgggtgaagtcaatgtcagttcatattttttttttttttttttttctgagacagggtctggctctgttgcccaggcttgagtgcagtggtgtgatcttggctcaccacagccttgacctcctgggctcaagcgatcctcctgcctcagcctcctgtgtagctgggactacaggtgtgccccaccatgcctgtttaatttttttttttttttttttttttttgagacggtgtctcactctgtcacccaggctggactgcagtggtgccatctcagctcactgcaatctctgcctcccaggttcaagtgattcttgtgcctcagcctcctgagtagctgggattacaggtgccaacca

SEQ ID NO: 92598 - DNA, 1294 bp, Homo sapiens
attccatagttctttgtattcatatatactggatgtgaaaagtccctggaataaattacaggaacaaaaatcagccaggaatggctagttgatagtcctgaaaagacaacatcattgctgaatcatatcttcaagttgaattatttatttttgaaaaaacctttctatagcatcctgagaaacttatttcttattgttgttgcttttttaaaaaaaaattgagatagaattcacataccatagaattcacttaccataaaattcaccattttaaagtgtccaactaagaggtttttagtgtactcacaaagttgtgtagccatcaccactatttaattccagatcattttcatcaccaaaaagaaaccccatacccattaggagtcattccctagtcacctgtacccgagtccttggcagtcactcatctactttctgtctctatggatttgcctattctggttgtttcatatatggaatcaaacaatatgtggccttttgtgtctggcttcctttatgtagcctaatgtttttaagattcatccaaatcataacatggatttgtactttatttctttttatggctgaataatattctatcaaatgtgtatgatacattttgtttattcattcatcagttgatggacatttgggttgcctccacttttaggctattatgaataatcctgtgaatattcttgtataaatttttgtgtagacatatgttttcacttctcttgggtatatacctaggagtggaattgctaagtcactttaactttttaaacttaaactttttaaagtcagtttaactttttgaggagctgccaaactgtttgccaaagaggctgcaccacttgacattcttaccagccatgtgtaagggttctgatttctccacatccttgacaacacttgttatgtttgtcttttttattacacccatcttagtgggtgtgaagtggtgggtttgatttgtgtttctctgatggatgactaatgattttgagtgttgttttatatgcccatggctgtgtgtatcttctttggagaactatctattcaaatcctttgccatgtttatattggattatttgtctttttattgttgagttgtaatctgaacattagacccagatcagatatataatttgcaagtaataatttccattttgtagattgttttttcactcatttgatggtgtccttcaaaggacaaattttttaattttgatgacatccagaatagtcatttttcctttggttgcataatacagtcacaaagatttacacc

SEQ ID NO: 92599 - DNA, 1993 bp, Homo sapiens
cctcagcctcccgagtagctgggactacaggtgcccgccaccacgcctggctaatttttttttttttgtatttttagcagagatggggtttcaccatggtcttgatctcctgatctcgtgatctgcccgcctcggcctcccaaagtgctgggattagaggcgtgagccaccgcgctggcctattgctttttcttatctgattgctggatcagttcttaatcatctttaaattcccaatgatttgcacagaataggtgctcagtaactttattgatgaacttcggtattaaaaatcagtttttatgtaagctgcagtttcttgtatttaatttgttttattctttatttggcctctgggcatgttgagaaaataggaagatttgcttgcttggtctttagttgcaaaggaagttagtggaaatgtttttgcatttgtaaatgggttttagatatttgccttgtctggccacggtgcttggtagtcactcaggaggcttagagccaggcctcgtgtgttctctgcaaccgcaaaccctttccaagctgctgtttctgctggtgagtgtggctggtgttttggttgctttctatcaacattgccttgatttggtccccacaggagactgctcacttcttgacaaaaggtaattattgagattcctggttttcttctcaccttgtaaattctcttgtttttgttttttggcaaataggaatgaggtgtgtttactactggagcatcgggctgtcagaacccgtagctttggtttgccttggtcgcagcctgccaggttgcatacttttgatttggaagaggtgccggtgggtgtgttcgctagcaggaatcacccacagtaaaaatcatgggtaggagaaatggccgttcaccttttcccatcttccttccttccattgtctacactcctggtcccaccttttccttggggactgggatgcttatgctggaacctaatcagtgtccaaagcttaaaattctcctctcctcctcacttttttcctctttgttttctcttgactttcattgccttggtctatttccagaccctccaaggcctgtgttttctctttaaaagatcctgttccatccagaggagactcaagagtcccactttaatttgggattttaggcagaggccttcctgcatctctcaagtcacacttgcaagcgactgctttggtgatgacatttaaagttggcctcctttcctaccactctgactcccctcaattttctagaactgggtttattgttctatattttaaaattgatttattatcttctatagcaatgttggaaggagcttaattttggaagtgcacagttctctttatggtcaaagcgaagtaaaggagatttgattgatcttatgacaaaattgctttagtcatagctgataggaaatctcttaagggccctgttttatttgctcttttaatttatgaaccttcttggatccttcaagcatctgtatactaagccagtaaggccttatctggaacatgcaggcttcatttttgcccctaatatgccatgaaatgctatagggttctgatgctttgttagattttggtgtaaattagggagtaacagtgtcagcaaatgtgtatttcagaaatttgttaatttttttttccaaaggaaaatgtactattagctggaataacctggcagccatagggcgtacattagacctggaagtaaacaaaatgacccccaatgaagtagaaagtaagctactataaattatagcccattttgtttccctgtaggtcagggccatgtcatcctcaggcttccagaaaagaccatgttgtgaaataggaacaacagagacccagtgccctacagctaaggccaatgggagggaggggaagagaggagttagaccagcttagaagggtgggggcccccttctactctggaatccttgcaggtctcactaagccacagcagagcatgtttattgatgtt

SEQ ID NO: 92600 - DNA, 1132 bp, Homo sapiens
acggggctgggcacacagagcactggagggaattggttgagtaagtgatggagtagttgatagcaaagggagactggagagagcattctgcagggggacaaagtgcctgagcctaagagggggagacaggctgtctggagaacatgaagcaagtgcctggccctggaggtgtgtgcccctcctgtcccctgtaaattgtgggtgggccaggctgttgggggcatttgtgggcctggagtgatgctgatttctgcagccctggcggttgtcagtgtgggctggggtagagatgtgtgtttgtgtatggagcaaggaaggtcctagccttgctcaagaggtaaagaagctgctggttgagaacagcttcatgaattctgcaagaagagatgatgatgtttgcttcttttacatactgcattaaaggtcccagacactggggcatttgctgatgtcagtaaagagggagtcctggatttctaggcactcacagtttcagaataaacacatatgtaaacagctgattaccatatggtgtgataaatgtgtcaggatacagaggcagttgctattggcaacaccaaatcagtcataaccttcaggagtgaacagggcttgtttgctcagggtctggccagggacccagaggaccagtgttggggacccagaggggctgcgtgggcctgctgccactgcgagcctgtgttacaagactgagcagtgcagccgtgactctggcaggcgagtttcccaagccgaggtttctggaagccacagcctgagcccagggcctggaacctgcaggcaaaaactgtgctgagactgattccccagtggtcagccccacagctggactgcaagctgctttccctgggcagactcagcctcctgcaggaggggtgtgggagggaaggagcagtatctgtgtgcagacctgggttcccccagaactgagatgctggatgaggtgcctgcatcccctgagctgcttggcgaggaggacggtccatgttttccatcacagctgggagtaagagcagatatgtgcaaggcaaggacgttgtttcaccttttgaaggaaggttgttaggaaaacgcctgcattttctaatcactggagaagcccttttaagca

SEQ ID NO: 92601 - DNA, 1960 bp, Homo sapiens
ctcctgcacagcagcgggcctgtctgtctgcctggcccttgggtgtccctggcatctgcatgctgtgttcccatggtccttctgctagttggagcccttgtgccatgccttcctttggagactctcctctctgtgccgtctcgcatgccatccttgaggttttagctctgtcacctggcagcctggcccttccctgcagcaggtgaggactgagagctgggctgtgcccctcccacccacttgacccagcggacactttgggaagtggcaaccataagtctgcctggcttgctccagttgcccatcttgtcctgtgagtgaagctcctgcttccatctctcttgatctggccccttctctccattcctccagctgcagtgggtgcccctgtcatttgtcagccagagcattcaacagcctctgctcccactgaggtcatggtgattgtcttaaagatttgctctttagcttctcagctgaagacacgttggtggcttccctgaccttttggaaagtaaccagactctgggtccttctcctttgttgacctggcccctgcctccctcccaccccatctcatccatgcctgtcctctgtgtcaacacgcctcactgccctgcgcccgatccttttacacaggtggtccctctgtttgtagagtcgccctgctcttcgtatctccctgcctgttctgtgaagttcagcccagtgccccttccttggaggccacattagagggccctcctctgctggctttgtgcccccgtacccctttcgcagctgactgtccacattatactgtctgtatctgttatttactgtctgtctttgacaaactatgatcttggaagtgcagagaacttgtctgatttgtttaaccacctcacttagcacataacttgtcatatttttaatttattttctatctccccttctccccattagatcataagcttcctgggggcagggatttttgactcttacttagtgatgcatcctcagcacccagaattgcactggacacatcatatatgtttaatatgtgtttgttgaatgaataaaactgacaggcaactacagcttagattgcagggagtgagacatgctgttgccggagctctggtgtcattggttcatagaaagcttgtttctctggccatggggacttgattcttagagggtaatggttcgaaagttgaattagtgagtgtaaatccttaaaaaagtaaaaatatgtttgtgcccttgtacagaggggctgccttgcccttctggaagaaggaattccacgttagacgtgttcccagctgcagttttgttctgtatctattgccagcaggaatccaaggatttcctttattatttccaaattgctgcctcttaggaatggagaatgctgccagtctgtgctctgtgttttttttgctcagtgggaccaaagtagttttgtggtagagagatacagagatacggctttgagacagtttgagtcatctaattactgtccaggagggctgggaggttaaccctggtggttgctttggtgatagtgatcgatgtctgtgtgacaattataatgaaggctggtattatgccgggactttgaagagtctatcagatagtgaaggaattgcgaagccgtactatgttgaggtctccagaataaacatcctcagaatggaaggtccagatgagaaggttaccttgatgagaggcctttatgctttttgtgctattttcctttatgggctctggtagttctttagtgttttataatctcttttcagagaaagctttttgtaaattcttcagattttactttttaagtaacacttacaaaagttgtatggtggcttgggaccaatacactttgcaggaaatgcagagatggataagaaatggttcattcccttcaggacctctcgttatagcttagcctatgtagtgattagagcatctg

SEQ ID NO: 92602 - DNA, 1552 bp, Homo sapiens
tgtttcttcttttgatttgcagagcagttgtcttgaggaaaaccagtgagatgatcccatctcttcccatgattttgagagtatgatctctgtcccaattcagaagagccctgaggtgaggtaaagatgttagaggtgagtggcattctgtgtctgacctgtggctccagtgtgtggatccgtgggctggcgtgtctcacatgtgtggactggggtttccctcttccacagggaggtggtcagtgtgtgggaggagccatggctctggcctccgactgctggggtttgaatttagggtgagcacttactaacactgttagctgacccgctacctactgatcttcacacggatgagcttattgatggtgcacacagatgacaggtttagattgtatgctggttccttgtatttgttctgtttttaaaacctcagctcctctagtctttggtagacactcttatgttatatcttgggcaacttagttcctctttctggagcctcagtttccccatctgtaacaccagagagctggacttaggggaaccgcttgatatttgacaatactccaggcttttgtaaacaaattgtccacagctttgctgagctacagccacatccgcttgaaaaagcattgtcttaccagcctgtgcagaatccagatcactttcatccaccttcccatgggggctgctccatcccttgtcttactggaaatgtctttctcaagggtcttttctggtgtacaggtctccctggagatggaaaaccatagcactggtttaagtacagtgttttgtttgcatggggaggagaggctgaggcaacagcctgtgagttcaggagtaataaggtgtttgtttccctttttggccagtttttttttggtggcataatttacatacaatgaaatttaccctaagagtacactttgatgaatcttacaaatgtacagttgtgtaatccccaccattatgacctaaaacaccccgaaagcttccctcttgctaacctgactgacttggtggttctggtggcttttttgtagattgcctggcatttctacatagatgattttgtcttctgtgaacgctgtttgcctccttccttcctgatctgtttgcctgctcctgctttctcttgctgtactgtgttccctgggcctcccgcagcctggaggggtagagaaagagtggcctcctgcccatccctcccagcccctctctgtcccgtggcgttagcagcaagcgctttgtagctgcctgttagtgggttgccttctgttcctagtttgctggtttttttgtcatgaatgggtgtttaatttcatcagatgctttttccgcactgactgagatgaccatatggtttcccttttttagcttgttagtgtggtgaattacatttttaacactgcaactactctttggtgtggaagccttatgtgtggggtaagcacagatttggtgtcatcatgttgggatttgaggattagctgttctgcacttcataaggatatagtacattcagttattgacagcagctaggctgtgt

SEQ ID NO: 92603 - DNA, 1053 bp, Homo sapiens
ttcagttccttgctgacactgtcaggagctcttccatcacctagccttgtgccagcacactggtggtgcttggtaaatgtttgttgaataagtgcactaaggtttcactgtaacctctagtgatctgcttctagaagccttttcttctggtagggtcacacctagaggaattggatgctacaaactgtgatagacccagtaccatactctagctgctgtgtctagcttgacagggatgggcacttgcggtgccctcagcctggcttgaagttgacatcttgtattgggcggtgtgtgggctctgttccctgagtcttcatcctgaaactgctggggctgatagctggtcgcgggatcacctttcaaaggaacgcagtccagaggcctttgcttcctcaggatggattcaaggagagaatcctcagctgatcatcattttatcccattttttctgtttcctttactgttccaacttttctttcttttctcacctcctttatggaggaaaattgccgtctggggaagcatgatgctggggaagtaggttttgattgtccgatgattgtcaggtgagactattacacgtgttcagaccattgggtgtaagacattggtgcacattagctcctgctttgatataactgaggcccagtaacaacaaatttttgctcaaaaaaagaggcataagcagcgttgtgtgctttctttattttggcctaccctgcatgatggctttaagtattatcgggagaagaagcatacggattaacaaagatgtgtacttcactttccaagaacaggaatgttttgccctagtgagccttgaagattttttgttttgttttgttttgtttttttgagacggagtcttgctctgtcgcccaggctggagtgcagtggcacaacctcagctcactgcaagctccgcctcccgggttcacgccattctcctgcctcagcctcccaagtagctgggactacaggcacccgccaccacgcccagctaattttttgtatttttagtagagatggggtttcactgtgttagccagg

SEQ ID NO: 92604 - DNA, 1435 bp, Homo sapiens
gcaccactacccccagctaatttttggattttttttttttttttttttttttttagtagagacggggttttaccatgttggtcaggctggtctcgaactcctgaccccaagtgatctacccacctcagcctcccaaagtgctgggattacaggtttgagccaccgtccccggcctataaactaaactttatcagaggtatgtgtgtatagaaaaaaaaaacccagtatatacaggatttggtactgtctggtttcaggcatccactgggagtcttggaatgtattccctgaagataagcggtactacttgttatcagttcaccaagtgatgggcatttgggttctttccagtttttggctattatggataaagcttctatgaacatttgactacaagtctttgtgtaggtagacacgttttatattttgacttcgggaaatacctgagagtgcaattgccgtgttgtgtgctaagtgtgtgtttaactttatcaaatgctgccatcccattttccaaagtggctgcatcatttttcatttccactaaccacgtatgagagttccagttccttcacttcctcatcggtgcttggcattatcagccattttactgggtgtgtaatggaatcttattgtggtttaatttatatttccctggtaactaatgaaaccagaatcttggccattgtgtatcttctttgatgttatgtgtctatacttgtaccatgtaagttggttctcagatcatacaatgcatcatgagagtagagattctaatgagtattgaatgtctcttacctgaagggctgttcaggagaaatggactatttaagtaacaataatctgaaacaagattctgaaagatgtgctctgtggaataatattgcacatattcctagaagctgggataaatcattcacacagaaaaaactggaaggatctagcaatttacttaaattctcctatggaattttaaaaagatggcctcatattgccttgttactatggaatggttgatttgatgtaaatgcacactgcagcttaatgaagtagcctctctggttctgtgtgtccttgccgtggattcggcagatggtgtcgtcagagattatggagttcaagccacctagctttacagaggtgaagggaggtgcctgagttgatgaagggagtcgggggcagagctggtgccagcaccatgtggtgctccagaggttcttcaggggtctgcttgacctgtattgcttttatctttaaaatttccaacagttgttaaaaagttttctgaaaagatttatactctgatgtttgcatcacatagcagggaggtgatctcaccagaacattttgaagtcttggtaaacattgggctggggggcacaagatcgtctgatttatttgtatgcgtattggtaggtagcatgctaggcattga

SEQ ID NO: 92605 - DNA, 1115 bp, Homo sapiens
ggggagcacagctctggaagctgccttccgtcctccctccattggctggagctctcccagcatttcatcggttcaaagccaaacacatgattttggacaagtcacttaaactctttgagtcagtttcttctcctttaagctggggaaagaggtggtgatttcacaagtggttgtaaatattgcagtaaagataatggaagtaaaagtgctctgtggagtgtaaattgctgtatggtagttggagttgggccctaggtgtgattttagagtacacacctactgctgccttggtaacttaaaagtatttatctcaaatgctagtgagctgagctgagtggcacagtaggcctttctttccctgggagcactttgggagctttggaggttgcccagtgctgcccccaacctttaacagtgtggccgagtgtaggagggagggggcagagttccttctggctggactgccacatgcaggggagaggccccgctggtggtgtcccaggtgggagaggggcagacctggggttacctcagtcagggtaggtgaggaggggatgggtggacaccccggtggccactcctactcacccctgcacttaagacctggggtttcatgccctgctcctttaaccctcagtgttcaagagagaggccagttggaccagagcgcctcaccccaccatttgccatgtgcccctccccgtggggagtcagaaacacctgagcacaccaggaaaagttttgaaaaacaatgtttttagagacagggtgttgctacgttgcccaggctggactcaaactcctgggctcaagcgatcctcctgcctcagcctcctcagtagctgggaatgataggcgcgtgccatcatgcctgtatgaagttttgaaaaatttaaatgttgatggaaaaaaaaatgtattagtggaaatgaaaggctggtataagctgtaaagtctttttgttcttagagatttttttctcattctaaacattatcagacctgaaaagtatttgtcgtaatgactgagacggtcctggggtaacagcgtcttcttaacggccactttaattggcgtagtttacacctagcctctccgagaactggaggacactg

SEQ ID NO: 92606 - DNA, 1071 bp, Homo sapiens
ggtgggtggatcacttgaggccgggagttcgagaccaacctgcctaacatggtgaaacccccgtctctactaaaaatacagaaattagctgggcgtagtagtgcacacctgtagttccagctactcagaaggctgaggcctgagaatcgcttgaacccaggaggcagaggttgtagtgagtcgagaatgcaccactgtactccagcctgagcaacagagcaagactctatctcaaaaaaaaaaaaaaaaaaaaaaaaagaatgattataaagcctggttttggccagcactccaagcgcgccccgcaggcctgtcccatcgtaacgccctcagaagcttcccctgccctgactgcagccctcagcttgcctcagtttgtagtttgccaacaaggtgtatatccctaaacataaacaatttagtttggcctgtttttgaactttttatactgcatgtattcttttgctcaacatttttgtcaagttcacttgtgttgtggggtaagtttgttctcttccgttgctgtgtagcattctgttgtacgaatgtccatcatcagtttattcattttaccatcgacatttcggtttatccagttgggggctgttttgaggagtgttaggacagcctgtccatgtcttctgttgtggatgtatatttactctgagtaattttaattttttaagataataccaaaacacgcccttctcatctgtccttaggcacacactttcctcagctgtgacttagctcagacgtctatttgatcttaattcttagcgacacctgctattcttcaggcctggctttattcccacaaggggggaggttcgttattgctctggctttaaacggagcccacaggtcacagtgcaagtctacgcttcccaaaaggcttctggaaatatttgacactgtcattaatgctctctgttactttctgaagagtcgaatgcgtggtgagacaaagctgccatctgaatgtctgtctgactcttcttggcaaagccaccctgggggcacggacctgggtgtgttttgttttttgttttgtctactgtctttcagaaa

SEQ ID NO: 92607 - DNA, 1065 bp, Homo sapiens
gccctcaggcggtacagtggggcccatgaacggaggaagagaagcatggggttggggacattcagaggccactgtgctgcctgggtggctgtagctcttgcagaaggtggcaaggcctgaggaactgaatttgaaatttgaatgaatctttatagaaacattcctctgtggctaccctgttggacagcacaggtgtggaaaatgagtgaacagctttgtggtggtctctcctgtggtggacttcccttacccacagtgtgcaccgtccccactgtccccacacactgtccccgtcccctgtcctggctccagctcagctgagcagcagagattggaagaggcccctcggtaacttgagaggaacctatagaagagtttgggaactccaaacagatgcttttaaagtggtttgaaacagtagttttcctcagaaatatttgggacacatccccctctctggtttttgtgataagttcactctgtaaaacttgtttgacaaactgaaggtcagcttccacctggcccctgagaattaatgaggtctggccaggcggcagctgcagtgcaggccctgctcctgtcttggggtctcttcggttcttgcctttgtttgtgttttttacacataagttcccgtgaaagttgcttttcccccgctctgagctggagtggagttttcgtttggggagcatggtagttgagagcctgggtctggttagaattctcagcctgatgggtagacatctttgcttcctcgagactcaagctttgttattttttgttgctctaagatttcagtatttttttttaaatttttgattattgtgggtacgtggtatatatttttatggggtacatgggatattttgatacaggcatgcagtgcataataatcacattagggtaaatggggcttccatcacctcaaagcatttagccttcttttgtgttacatctcaattatactctcttagttatttttaaatgtacaataaattattgttgacctttgtcaccctgtttctatcaaatactagatcttattcattctgtccacctatattt

SEQ ID NO: 92608 - DNA, 1196 bp, Homo sapiens
aaagacaaacactccatgttttcaattatttgtgggagctaaaaaaaaaaattaaaaccaccccagtcactgagccactgccgaggactcagcagcctcccccttgggccccgtcgcttccctactttccgtaccctctgcccgccgtcttccgcagaccatttccaccgagaaaaagaaattggatcgtatgtccactatccagaacctccactatttaaactcctttgctgatgcaagtaagggtgatgacctgcttcctgctggcactgaggattatatccatataagaattcaacagagaaacggcaggaaggcccttactactgtccaagggatcgctgatgattacaccaaaaagaaaccagtgaaggcgtttaagaagtttgcctgcaatggtactgtaattgagcatccagaatatggagaagtaattcagctacagggtgacaggtgcaagaacatatattatgccagttcctcgtagagcttggactggctaaggacgatcagctgaagattcatggggtttaaatgcttgtggctcactgtagtttaagtgaggatttccttgcaatgagtagaatttcccttctgtcccttgtcacaagtttaaaaacctcacagcttgtataatgtaaccatttggggtccgcttttaacttggactagtgtaactccttcatgaaataaactgaaaagagccataaaaaaaaatgaaaacagggccgggcgcggtggctcacgcctgtaatcccagcactttgggaggccgaggcaggtggatcacgaggtcacgagatcgagactatcctggctaacacggtgaaaccccgtctctactaaaaatacaaaaaaattagccgggcgtagtggcgggcacctgtagtcccagctactcgggaggctgaggcaggagaatggcgtgaacccgggaggcggggcttgcagtgagccgagatcgcgccactgcactccagcctgggcgacggagcgagactccgtctcaaaaaaaaaaaaaaaaaaaaaaaaatgaaaacaattgaactcatggagactgacagtagaaggatggttaccagaggctgggaagggtaggtggggtggaagtggggatggtaaatgggtacaaaaatataggtggacagaatgaataagatctagtatttgatagaaacagggtgacaaaggtcaac

SEQ ID NO: 92609 - DNA, 1053 bp, Homo sapiens
ccaggctggagtgcagtggcgcgatctcggctcactgcaagccccgcctcccgggttcacgccattctcctgcctcagcctcccgagtagctgggactacaggtgcccgccactacgcccggctaatttttttgtatttttagtagagacggggtttcaccgtgttagccaggatagtctcgatctcgtgacctcgtgatccacctgcctcggcctcccaaagtgctgggattacaggcgtgagccaccgcgcccggccctgttttcatttttttttatggctcttttcagtttatttcatgaaggagttacactagtccaagttaaaagcggaccccaaatggttacattatacaagctgtgaggtttttaaacttgtgacaagggacagaagggaaattctactcattgcaaggaaatcctcacttaaactacagtgagccacaagcatttaaaccccatgaatcttcagctgatcgtccttagccagtccaagctctacgaggaactggcataatatatgttcttgcacctgtcaccctgtagctgaattacttctccatattctggatgctcaattacagtaccattgcaggcaaacttcttaaacgccttcactggtttctttttggtgtaatcatcagcgatcccttggacagtagtaagggccttcctgccgtttctctgttgaattcttatatggatataatcctcagtgccagcaggaagcaggtcatcacccttacttgcatcagcaaaggagtttaaatagtggaggttctggatagtggacatacgatccaatttctttttctcggtggaaatggtctgcggaagacggcgggcagagggtacggaaagtagggaagcgacggggcccaagggggaggctgctgagtcctcggcagtggctcagtgactggggtggttttaatttttttttttagctcccacaaataattgaaaacatggagtgtttgtctttctgtacgtggcttatttcccttaacataataacctctatttccatccacatcattgcagctgacagga

SEQ ID NO: 92610 - DNA, 1380 bp, Homo sapiens
gctgctgaccaaaatgaaagaagacctaaatgagaaatatgtgatgcacaggggttagaagagtcaccactgttagtgtcaggcctccccaaactgatctgaagattcaccccaaccccagtcagaattacagcagcggaaattgacaggccttttctaaaactgatacagaaggtggccatccgtctctagcttttttacctggattaagtgtggggcagggagcaataatgatagttttgatttttttgaacacttactgtgtatcttgtgctttctgtacattgtgctaatcttgtcaacaactgattctccttatacaaatgagtaacctgcaaatcagagagttctgggtgttcccaagatgtctgtgcagctggagctcagaccctgatggtcttactgctgtgtcagggttgtgtgcagtgagtggcccactctgtttcaaagccaccatgccttcagtgtgtctgtcacacgggtgacatcttgaagacttcagtgagtcactaagaaatggtacgcccagtttcattgacaagcaccagatttcaaaaagtatcttggaagattttttttttttttactgcgttcacttggactttttgagtttataacttgagggatatttgatattctggtcagactcaaaaatgattttatagtcatatgttgaaaaggttgctcttatcagaaataaaaatgaaataatctgtgtcttatgcaaacactggctgtgtagctgctgctcgtctggaggagagacttgtgtgactcccaaggctggcccagtggctggcagtacagcttataaacagccctgcatttgaagggagaaggcgctagtgcttcggtgtcaggaagctggcctgcaggaatttaacagcacctctgtctaatttgccatgctgacctatattgctgagcgtgtaccacaaacctcattcctatttctaaccacccccaagcgtcgtttgctaaaatgcaaccccactggtgttacttctctgcctaaaactctatagcattttttcatcaccctctttgaagttcgtggaagtcagttccagagcatgggagagagaaggaaggcctctgtgggcttcagaattttagggcaattgggataaagatggttctcttaccacagatccatccaaagattttaatgtgctagtaatgtggattgtgagtggttatcgttcttaaccctttcccaattcatctgtcgatgaaactgtcactgcctcccctgatcaccccactgtgagcctcaggtgagtaaatactgcagagcaccagatgagttccgagctcttgtgcattgcctggactcaggccacctgtcccgaccctccccacctggactcctctgtgccc

SEQ ID NO: 92611 - DNA, 1072 bp, Homo sapiens
aaatggtctccactgtgcagagttgtgcacaacatcacaacattcgtgtcgtgacacacatttgagtagtaatcgtcatgtcatccgtctagggagagtctccaccaggctgctgccatagagaacatatgtctctccttaaacgctcccttcgccgagctgtctgcatggaaggttggaatgtggggtgtcagcaagtgcttttccctctgcctgattcccaagtggcctgtggtctggcctggagcaggggtttggagggtctttgttgggtcagcaaggaggctggggctgggtagccataaggctggtgcaccctgccttcgttctgttatgctggtgacagcacttggtgttcaggttaatggtacatgcacttgactggaaggttgtacattgtcgctgtcttcagctcttagctcttatctaggctaagagctgaagatagcgacaatgtcattagcaaatgaagaaacggtttttgctgtgggaggaagagcactggactcagagtcaggaaacccgagttcttgttccagctctgctgcaaactcactgtgtgaccttgagcaagtcatcaccctctctgagctttggtttccatgtttagactaggtcatctttcaggatccatggaatgaaaggactcagcagtgagtatagcagccctgaggaggtggggacaatgagacctgtgctgccctgtggcgattttgagagttgagagctggatgcagacaggggctttaaaacagagaaagtaggctgggcgtggtggctttgggaggctgaggagggtggatcatgagatcaggagttcaagaccagcctggccaatatggtgaaaccccatctctactaaaaatacaaaaattagccagaagtggtggtgtgcgcctgtagtctcagctactcgggaggctgaggcaggagaatcacttgaacccaggagttggaggttgcagtgagccgagattgcaccactgcactctagtctgggtgacagagtgagattctatctcaaaacaaaaacaaaaacaaaagaaaaacagagaaagtattaacagtggga

SEQ ID NO: 92612 - DNA, 1475 bp, Homo sapiens
ctgcacttgattcagaagaaaatagggataataatagccaactcttagtgctcaggttaaactgaacaaaagacttacaagccacctagtaggcgttgacctttatacgaagtcccttccctttgggtgttcacttagagcaacactgaggtccagtcctcctcttggtttgagggacaccacgaggctgcatagagtcttcagcttctctcctgctgggctttgcattcattgcccagcaccgtgaaggaggacaccacggcccagctcccctcctttgtcatctcttgaaagacccatggctcagaaagcagcgagcgagggagtaagcaggaccatggaggttgcgttcctgtttctgtcatgcagtagacagtgtgtagtgacagatgcctgcctgtggccaccagcccccttcctgaacccaatgaaactaaactgcccatgtcttgaccgctaattttgagatagtttaaaaatagtatgtggtttgaaaggacctatccttcactgttaaccacactctagaattataaatagagtaaaacagaaggaattattgatccatctgtgaaactggattttaaaaatctaaaaattagatacttttgtttgacaaggtaaactttttaacgatgaaaacaaacatcgtgtagtagagtaggagagtggactttggaatcagaaaatttgggtttgaatcccagctctgccactttctgtgtttccttggatgaattatttgatctctttgagccctaattgcctaatagtgttatgagaaataatacatgtcttacgaagtttagaaaaaatatatgtgaagtttgtgctttgaataagtgacgcctgttgctgctgttacttttgttagtgttattggttatgcgccaagtgtggtaaactgagtctctttacctgattctttcattcttcctctgaccttgagagcatctcccagcaggtttttatcctttatgtagctgacgccgcaggcccagcgtcactgtgacttaccaaggtcatacagatatttacaggtggacataggactggaacctagatcttctgagggctcctgaggagctgcgtttgcgggtgtgtgtgtgtgcacatgtatgtttctgtcagaatttgtttgctgaatctggtctcagaaattcatttaatttatctagaactctcaggctctttactggaatgttaaaaaagaaaaaggactcaaacagtgaagtgagttttcttttgtgtctgctagatccccattagaaccctctagtcccccaaatgccactggaggtcaaagacatggtgcttcccccataggatgggtgagcagaccattcataggtcatagggattggctcagggtccaggactgccctccaggaacaaatgttccctcgttttcccacattgtcaggcccagcctagccattggcgttagctgacagtggtctcatttccccgagaag

SEQ ID NO: 92613 - DNA, 1013 bp, Homo sapiens
ctaaggtgggaggatcgcctgagctcaagaagttgaggctgaagtgccctccaacctgggcgacacagtgagaccctgtttcaaaaaaaaagaaaaaaaaattagtacactgaatggtgtatagaaatcggatgccatattgctttaaaagtggtgccattttatcttcctatttaagataattatactaaaaataaaactttcctttgcttgatggtatgaatgaatacataaggtcccaagtccctcttctcgtccttctccttctctgggcctgtaatctagaagcccagagtgtcacagaagccacaggggcccagcagtgggaactggcccttgggttgattcaggggagtggtccaagcctgggaagtgcgaaagtgggtttcgagctcgttttccacttgagggagggaatcttttcaggctcagggctctgagtccgtacttgaaggctcttcctgactgaagtttcgcatcttgagttgactcgcatttgaactgctgtcacggagacttgcttgctcctcgtgtacctgttggttaggaggcttccattccacccaatttaatccatgcggacggtgtgtgtccccactctcctgccttcttgcttcagggagaagaatgggggcaccaaggctcttgcccttcctgttcccttttatctcctttgcctagcaacacccccccaacacacaccccctcacaatcacaccctcactctcacaccctcccacacaccccccgtcacaccctctcatgtccactctcatacactctcacaaccacactcacacaacatgcaatcattcccaatcactcacatccacactccacacaaccacacaaaatcacatccacacacacactcaaccacactcataccccacgcaatcacaaccacacaacacacatcccaatcacacccactcacatccacactctcaccacactcaacacacaccccacgcaatcacacccactcacatccacactcacacaatcacaca

SEQ ID NO: 92614 - DNA, 1063 bp, Homo sapiens
tcacattattttccttgtaagggaaatgtctcaggacgagagacatgatgccaagcatctcagctacaatacgttagcagttattgttcctaaagtaagggaccttgggcaggagtgtgtttgagatggttagaaatcccatttatttgaaccatccatagtcttccatgtagctagagtgaagatttctcctagcaggccaggatagactgtcttattattaggagtttttggcacttcaatatttaattatctgactgtcagataattcatatggccccaaaataaagaaacggttacggaatccaggcgatactaagtgtcgatcatgcactctacgcattgtaaaagatgccaaagaagtagaagaaatcatctcagtcctcagaagctccttttaaactcgtattctgcttacttccatgacatttccttttcattgttcaacagtatctgctgaaggtcaacgaaatcaagattaaaaagggagtagatttacttcagaatctgatcaaatactttcatgcccaatgcaagtaagttcttctctgttatgttatcttaaatgtttgttcatgtgtggcaacttctggtagatctatagatagctcataggaaataaacaccacttagaagtctatagtaaagggaatgaggtgctgactcatgcgacaacacgggtaaacattgagaacacgttcaatgaaggaagccagacacaagaggccatgtactgtatgatcccatttatttggaaggtcaggaataagtacatccacagagacagaaagcaggtgagtgattgccgcagcttggaggaagaaggaaatgggaaatggctgctaacgggtatagggtttctttgtgggatattgaaaatattccagaagtgagtgctaatgattgcacaactttgtgaatttactaaaaatcactttaaaaggatgaattttatggctttatggcttagggattatatcttaattaaaaataaaagcatatatacaacataaaaaatctgtagtaattgccagatatatttatttttggctctttttgtaga

SEQ ID NO: 92615 - DNA, 1732 bp, Homo sapiens
agagagagtgtgtacgctgcctgctcttcaaatcagtcaggcagctttgactttctcaattcacattctggagggtacaacgtggagctcgagcaactcagctgcagagtaagagctcgcagccgtgcgtgtttccacgtgtgggagcgcctctcattcccccaccacacacgcccagtttccgcttctcgcccccaagggcacagctttgcctgctgggtgctgtgccctgctgggtacacgcgggcctctgcacactgctgtgctccgccagggtgaagaggccactgtgtaaaccagattccagggctcaggtttggctgttgacccttggaactacgtagatatgcgttattttgctttttcttctcgctttaagtgttcttaaagaatacttcgtgttcttttatttttatttcatttaaggaaggaattttcatctctacctctttcctggaatatcttgaaaacttgtcttattagtctttgctcctgaacattgaagatcctgtactctagcggaatctagaagtagggcattataacattataaaataaagacagccatggtttggcaaggcatggtggctcatgcctgaaatcccagcactttgggaggccaaggggggcggatcacctgaggtcaggagttcaagaccagcctggccaacatggtgaaacctggtctctactaaaaatacaaaaattagccggatgcggtagtgcacacctgtagtcccggctactcgggagactgaggctggagaatcacttgaacccaagaggcggaggttgcagtgagctgagatcatgctgctgcaccccagcctgggcgacagagcgatttttttttttcaaaaaaaatacaaccatggtttgaaaggtggtgatgaatgttgaattgacttgttctttgagccaatacctgctggaaaccactgtgaccagctgttgctcagtgaacttggaatgcatggtcaagataaggctcagccccggatgctgcagaagcttgcagaggagggaggggcgggtgtcacagacagaccccatcagcagacaccgcattggaatgtggtggcgtgaaggctgcaggaggggccctggcacggtgtgtggggcccagagaagaaaggagctactctgcttggtgggtttgataattgcctctaagtgggtgtattttaaaggatagaaatacaccccttctagcctggtgaggcaggctagaaaatgtttaatagacaacaaaatttgattgggtaatgttgatggtaaaagttctgtgaagcttggaaaagtgttaatgggctcaacttaagaaaattttctggggctatgtagttaggactgtcatagggacagcagccagcggagaaggaatagtgttccttttcttgaagcttctcctgacgccagggctgactgcactttgaaggggcgtctgggtgccaagacacacctcaaggagggtacgggaaggtcagcactttgaaaaatcagagggaggagattttccaggtaggtggatggtgaagattggctgggctattacagagatgaaatctaaatctaaatccaaattcatattgttattccaagtacaccattcatcgtcatgctggaaacagcatcctgacgagaagtctctgagcacttgattccactacggggctcatgctcacgcgctctcactctcgctctctgtctgaccgtagggagaattgccagg

SEQ ID NO: 92616 - DNA, 1499 bp, Homo sapiens
gccccatgagcaccaacgtttcactgtacctcagtcttaattttctgattggttctgttgtgtgtgtgtgtttttaaagatcaaacaggcccaggatgaagaaagaaggcagttgatacagcttcgagatattttgaaatccgcattgcaggttgaacagaaagaggtgaggggatttaattttgaaagattgcagttttcaccccattcttggaggctttgggtctgaagaacatgaagttcatgtcttctaggagctcacagttcactcgggctgtgtcaggcaccagtaaaacatttaatgtattcttgcaatttagttctataaaaccatcttttaaaatatgtttatttcaggaggaagcatttactacatgcatggccttaatggcggtgtataaaccctgtgctctgtcagttgctagataaggagctctcagtggcttcgtcacagagaccatgtgtcatttgtgctatttatcctgtacctggccctgtgtcatttccctaccctgacatacgtggactctgcccctttaggcctaggcacgtagcaggggaccagctggggctctgccagccctgagattgtgttctataaaatatgaggcatgagcttttcttacagctgcctccatcatgacaggcagaaatccttagttctcttacttcccctctttctgtaatgacgtctctgtgtgctaacacgtcagcagggacagtttgtgttgtggggacttgtttttaaaaagccattaaaaagtaagttttaaagataattttactatattttcactacaatgtgggtatcataatgtgaatttagtataaatccatttccttgttaataaaaggaatgtatctaaacatatatctagtgattttagagaaattgctaaactacttgacagcataaagttccctgttggcagtttggtgagctctattttattgtaagttcttgtactataactgaatattgttgtttttctcccaaatgcgtttaccttttgtgaccgaagtctaggagagtaagtagttcagtattttaataaattgcagaattttgcatgttttattcgtgaacatacatatatatattccttttatatattaatggttagtagcattttttattttaacccctcacctttcattgttgtagactttattaaaggctgaagagtttgcataaatattagggaagtggacattttctgggtttacagtttacacttttgctgctgttcctttatgaagatgaagcaggtccctccctccctccctttctctcccctgagtggctgaattctacacatctctctagtccctctgaagccccacctctggagcgctgcctctgatcaccccagcccacagtgatctgagttcacagagcacatcctgtttgaatgccccatttgaatcacagcctattcctctttttgagtgttggttgtgccttaagtgcacagatggcttttcaccagctggacctc

SEQ ID NO: 92617 - DNA, 1019 bp, Homo sapiens
gagacgctgtacaggtgagcagtatttctccacattccttccacagcattgttctcagcaacgttgaaagctggatttgctctaaattttggtgccgatgttccgcccttctgagaaaatgtggaagctgggaccatcctcatcccatgaatgcgtgtgtgccctagtttatccagaggctcaagtgctgtgtgaactttctgtggaaatgagttcatttctcccctcctgggctctgcttgtttcagggttggttgtcagttcagtaatggagagtgcctccgcatgttactgattgctcacgtggagttttttggtttttcttttttggcagagtttaaaaagtcagtgctagacactcatgtgcatgggttggaagacttattgtgaagataacagtactcccctaattgatctacacattcagtgcagtccccatcagaaatcccagctgcctttgtgcagaaattgacaagctgatcctgaagttcatgtggaaacgcaaaggacccagaatcgtcaaaacaatcctgaaaaagaagaacaaagttggaggattcacatttcctgatttctgaacttaccacaaagctgtaataatcaagacagtgtggtactggcataaggagagacatatagaccaatgaaatagagctgagagtccagaaataaatccttacatttagagatgatttatttttaacaagggtgccaaggcaatggagaaggagtagtcttttcaacaaattgtgctggggcagctggatagccacaagcaaagaaggaacttggtcccttacctcacaccataatcacaattaattcaaaatgagtcaaagagctaaatgagagctgagactataaacctcttggaagagatttataagtataaatcttcatgaccttggattaggcaatagtttcttagatagcacccttacagtacaagtgacaaatgaaacagtaggtaaatgggacttcattaaaattaaaaagttttgtgcttcagaatctttttt

SEQ ID NO: 92618 - DNA, 1047 bp, Homo sapiens
agcccttacacgtgtgggaatgcagtcctctgtgaatctggccacacacaagctctgtggccaactgatatttaccaagatcctgccagtgtctttgctgcagcctgatgcattgaaacatcttcaggaaggacttgtagcctgtgatgcccagacaggtttgctgagcccagttgggggcagtgtcgtgagtttgctagagtccattgtcatctttgaaaagagctctcatccctcctccttccctgcttgtcttccagtgggtaaaatgaattccagtcctgcaaattcttcatcctcagtgagttttcaaaaggtgccttcctatgagtatctgtagtgaaaatggtttgtgcaggggtatgtgggtttgggttgaaaactggccagataccccagagagtcatcacaggaaacctggctgcagtataagccgtgatttgatgaacatcctgagaaggtgagggacatggggtcaagacctgattctggctgattgaggagcatctgtcttcacccctctcagattcctcctctacttcctcaccagcctcatgggatgagtatcaccaagatgcttttgaactctcaagatgcttttgaactgcctgggtgggccaggcagtggctcatgcctgtaatgcaagcactttgggaggccaaggtgggaggattgcttgaggtcaggagttcgagaccagactgggcaacatagcaagacctacaaaaaatttaaaaatagtgcagtatggtgacatgtgcctttggtcccagctactcagggagctgagatgggaggatcgcttgagttcaggaggttgaggttgcagtgagttgtgttcgtgccattgcactccagcttggacaacacagcaagactgtctaaaaaaaaaaaaagacatttgggcagttggggaagtcaagtggaggcacatgcattgaggcagtgagggtgatattttctgtgtgcatctgccaggcactccatggtcacccattcctcctcttcctcatctggtcagttcatcttggaatctgcccagagaa

SEQ ID NO: 92619 - DNA, 1066 bp, Homo sapiens
gccaccagcacctgagtgctccgatcgccccctctgtctcctcctgctcttctccctcacggctgaagctctggaagccgtccgcttatttgtagcatctttaaagagagtgtagtggaggggattcttgcttgaagtttttcctcagaggtttgcctcctgcttgtgcagtttttacacgtcagaatgcagaaattggccaggtgcggtggcccacgcctgtcatctcagtactttgggaggctgaggtgggaagatcgcttgagcctgggagattgaggctgcagcgagctgtgcactgcacgtttgcaccactccactccaacctgggcagcagagtgagactccgtctcaaaaaaaaaaaaaaaagaaaaagaaaaagatgccatggtgttgtagaaagtggtcgggccagaagtccaggaaccaagttctgctgctggctatgcttgttttttgcagcttagcctctctaggcttcagccctcacccagtcacttaccaagagttgttctaagaaccaacgtgctttcaggagtaaacaccactacagagaggtggcgtgtccactcacttttaggagcacagatgttcgttgtgtttccctaagaagagaattggtacttgtcatcattctgccatctgcaaaagctggattcccctgcccctgcttttctttattaaatataattttattttttgctttggttttagactgcttttagacagagaatatccatatatccctcccctagctttcccttctgttaacatcttaatacagttatccagtagtccgtggtacatgttatccaatcatatttatgtagttatcaaaaccaggaaacattggtttgatgctattaactaaaaatcttactcagattttaccagttttcccccaaatgtccttttttctgttccagaattctatccagaaccccatgttacatttagttgtgattttatcctggtctcttgcagtctgtatcggttctgtagtctcacttgtttttcatgatgccttcttaaagagtattgacctgttttttggtcagactcccct

SEQ ID NO: 92620 - DNA, 1047 bp, Homo sapiens
tggtgggactttgggctggactcagccgttgtttgtggaatttaacacagcgttgctcttgtttttctagatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccaggtgacccagggaccccacccgaccctgggctctaggacatttcaatcccattctgattcacagaatccgttcattgattttcactttcatttcaaacacgaaattaagtgcagctcagcctgagttcatcccattacacaaatgcttaatgaactgtgcagaccgcggcaggggagaggggcgggaagatgtttgcctgccgggccccagagcaggactgagtaaagagggtttgacagagctgcaaagtttgaaatgctttttgagaaatgaaaactgaagggtacagtgagagtgaactcaaggtcatgtgggctgagaggctgcatgtggatgggcttccttgcttggaatctgctctcttctccctttatcctactttgcagaacttctgaagtagctttaagccgctgtctggctctgtgaccctgggagagccacttgctttgttaaacatcgattttcctgtctgtaaagtgaagggacaggaccctttcagctgacacattctgtgaaataagattttatttttacattttgataaagcatattaggggctttatagtaggatgtgatttaaggaatttgcttattctaattgagacacaatggtggggagtgggggtcggggactacacaggtgcattttctgaacatttataaaatgaaaaagatggaggcttggctagaatggttaatccccttttcattcctctaattctatgacaatttttcttaaaaaaccaaacacaaccaaaataagagtggacagttgagaattacctttaggttcccatgaccctgaagact

SEQ ID NO: 92621 - DNA, 1140 bp, Homo sapiens
tagctggatgttgacagtaaacagtaagtagatagtgattggcattgattttaatgttgaatttaaaagtttacatgtagggaatttaacgtcaagagcaatagtcttgacagaaaatcaatagttgtggaccatgttcctctcaaggggccatcagtcttattgatgacttcgaatccagtgtgtctgaacttcgaatgcattttgaactctcttgtcaaacctttccagtctttctaggaattcctttatggtcttgaaagacagagttgggagaaactacagtggatcctggcagcctagttagtaacatccttagttacttacagtttaaaactaagctagactcacttaaaatgtaaaactaaggaactccaaacagtgccttcctggttacatacagcaattattgttcatgtaataatgcacgtaacctacagcttagagaggtgcacaggtgtacatgtggtatctcttggataactgatgatggcatagattggaggttgtcatggtacattttcaaagaagcacaaagtacttttcagtaaacactggtgaactatggcagttgtttcttttactgattttcttaaaacaatggaaagtgttaagtgattcaagatgatgtaataattgtttattttgtactatgtattttgcaggccactttatatatactaggctcatttgatctccagtaacaacctgatgaccttggtatattatccccattttacagaggaggaaactgaggcttagaatgtttcagtatgcctagggttatgaagcttttaaggtgacagatctggggtgtgggcctctttaatctgataccagacctcacacttaaacctttgacgagcctgggacacaaattggcattttagtgggttgtcttgctagatgataaacatttaaacatctctactgtccttccctatcaccgtccccaacaaatgtttaacagtcaactctggagaaaaaagaaccctggtttgcaacctgcctgttctcatggtgtaaatactcccacaatggccaatttcaagctacctaagtgaattactcaatgtgaagttggaaaaagatgttcattatatagtacattcactatgcaaacacagtggatgtaaataa

SEQ ID NO: 92622 - DNA, 1043 bp, Homo sapiens
ccattttactgatgaaaactctgccgctcagggaaactgacttgcctgtggtcacacagccggtaatggagctgtgatttgaacctgagtcttagctttcctggctcagtgccgcttcactctaccagaactacctcatagctggcataagtaaaggttgtttgaggatgtgaaatagattcactttggttgaggcacaggtcattgggaggagtgggtaaggatggaaattcacattggaccaagttactggttctccctgtctctgtctgtactctatccagagcgcgttttatgacaatgcgtctctgtaataggcatgccgcttcttatctttaattttatgggtacctttgggctttgggttttgtccatcttcattaaaggcaaaccactttattgctctatttcttagtggccattaaataaatcatcagatggggatgggtaatgtgtagcagtagaatgtattaataattgagtatcctgaaatagactttcatttttgcagctcgccaagaatattgggaatgcaggctttaatgagatcatggaatgttgcctaccagctgaggactcagtcaaacccaacccaggcagcgacatgtaagtatgggactggctattctcatttgctgagtaaaggtttgcctttgcccgagccccgggaggcaggggaataagaagttttgggtgcatccatcgttgcttctttagggaataaatcagcctatgttgggttttcttagtcactttaaccttttgggtgaccaaatagaaatttttttaggaagaagccaaaagcaggcaggtttcgcagatgctgtgcgtgtgtgcagcgggtatgtagagagcctcactcgccactggtgggtggaagaccctggacttttcacctgtgctgtctgttctgttgagtcacttccccgtcttggtctctctgcataatcctgagccaccgagatggctggttgtggtagatatgtgattatgtagcgtccttcttgccaacgtccttgcctccttgcaaatgtggaatgtgt

SEQ ID NO: 92623 - DNA, 1007 bp, Homo sapiens
cgtactgcgcaagcagtgtcctgagcagtagggaggtagcaggcaaggagggatccacacattagccatggtctgagccagagattagaaaccagagcactggattatgggtgttttgtttgggtcgagaagttgtttttatgctttgattagaaatggcctttagagatgtgcacaggcagtttaccacagatctgggagtccccgtggtttggggcatattgcttcagtcatgtgttacctgcctggcagctgaaggctggacttcaagacccctcaacgtgtattttgactccctgatcgtggtttgagccatgtgtgtactggaggaggaggaggtgctgttaaaagccacagaaattgctccaaaggaaatggaaaattccaaaatgcaaaagccatgggatagtttgcattttgtgtcctctgctttttcctcccatttctgagcagaggagtgaagaaatggccagaaagtaggggagtgtggggtggtcaaccccaagacctgcagcttcttcctgaggaggctgagttcactggactcgtggtggaagctgccctgatgccccatctctgagtgccagcccggctcctagaacgcagcaggggtttcgtaaacatttggttgatagctgcgtgatgcctctccctccatgcacattttcagggggcaggagagggaaggtcccagtttctttttttccagagtggaaggaggacaaaagtgggggagaattctgaaaatgaaacacaccccccgctccccatgcccacaatttggtgaaaaagaaactccttttttgatattgaaaatgtaattggtttccttctcatggaagcagcaggtgccacttcctgagatcgcctttctgtctccactttgtgcaggggcacaaagctcactgcccctcctcagaatgtgacagtggccatgtttgctaggattgagggcctgtcccatgtctgccaagcctgagcaccttttgtgggtgacctggtcttgt

SEQ ID NO: 92624 - DNA, 1055 bp, Homo sapiens
gccatcctgaagctcgagaaccagtcctctttgatttttatggaagcttcttggtgtcagcatctcttcccccagggtacagggtgagaccctctctggggagggccttaagacccacagtcagaaaagtgggggacgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggcttcacctgagacccagagatttccatgcatttgccttggactagaaggcaggcctcctgcctgcacacttcagtgggtccagatgcatggccgagtgtatgagcaacagcactgaccatccctctgttctctcagctgacccaagccttatctggaagatttaattctcacgttcacgttgaatatgaatggcgactactccacgaagacctggatgaaagtgatgacgacatggatgagaaattgcaggtctgtgccaggttgctaaccattaagagttttgatcagcttcatccagaacagtgtgggtcctaatctgtaattaaggcagaaagctgttttatagaaatgaaaatgtagcttactttatgctttcattgatctcagtaggctcttggttttacccttcccactaccatctcctgtctcccagctcctgcacccattaatttaaaggaatggctaattatgtacttataggcagccttttgctacaaaggaaaggtgtgtgtggcgggggggttgattccagtggatttagaggaaggtctcttgctatggagtcatgtcataaagagccagatttcccccagtctaggtgatcacattctcctggttgatcttataaaaacatcaactgaaatcatcagacgacctttagagctcactgggtccaaccccttcctttatcagtttgggata

SEQ ID NO: 92625 - DNA, 3080 bp, Homo sapiens
aggcggagcttgcagtgagctgggattgcgccactgcattccagcctgggcaacagagagagactctgtctcaaaaaaaaaaaaaaccatataaccttcaggggggagcaggggtggccaaactcttaaagggccagatagtaaatattttaagctctacgggcctaaagcgtcacagtccatgttaacaattactcagctctgccaggatggctcaaaagcagccttagacagtatctaaatgacaggacatggctatgttccaataaaactttactgacaaaaaacaggtggtagtccataggccactgtttgctaaccctaatttggaggaatctcaggagctcctgttcatatgggaggaaaacatcgatctctgctgaatgagccatatagctgttggagattgagtgcagcgggctggccagagctggccaccctgtggggtagcataagaaggcatgtttgggaaggggaacttcagggaaaatgctgacttaggttgagataacttcgactcataagataaatagcttatattttaaatccatcacagaatggagaattttaacctgtaattaacagattttttggtatgtgtgtgtttactagtcagttcttacactgctgtaaagaaatacctgagactgggtagtttataaaagaaagaggtctaattcactcacacctccacatggctgggaaacatacaatcatggcagaaggggaagcaggcacctcttcacagggtggcaggagagagagcaagcgagagcagggaaaactgccttataaaaccattaggtcttgtgagaactcactatcccaagaacagcagaggggaaccgctgccatgatccagtcacctccttccctcgacaagtgaagattacaattcgaggtgagatttgggtggggacacaaagccaaaccatatcagtgtgtgtttccttcacgagacacaaggaggagtgaattttcactcttgcagctctcacgcaacttgtagctctcaggcaacagttgagagctcaaatggtaccaggcccagcagagttggtgtcagtgaggttttcacccctgtgttgaatgttatcaccaggagcagttcatatttgtctcacacgcctctgccccaatgttctcctgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaaggtatgaagctgtccgtcatccctgtgaatatatagagggtcttgttttgtggtttgggaagtttgcagctgccctgcctccaactcagtgacctttgggctcttttgttttgtagttattttctgtttgcttcctaaagggattccatcattcttatcaggccagatggtggtagagtctcttgatttgactcttattctgggcagagttgtggcatctgcctggcttgggtaacatgggaactcccccagggcagcctgaggtggccaactgggctcccggggctgggccaaaagacacactccttcaggtctcccctctgcacccttctgtttacctttctccactccttcccaggccttcattcttcctttttatttctcttctgccttcatctggtccagctcatggcccctgcgattacttcttacccatgatccccataaaagatattggggaacgatgctcggcctaattgtaaaatacaaaaccagccctgtgggcctaccagtgtcttagggcaaaaagcatgcttttcttacctcagctgtaacctggaggttttgactcaacaggtgacactttctgtttttagaaatacgcaaaccaaagctctcagaagttaagtaatttgttcattcctgaagagcagctggctacggtgcttcttgaaggcaggtccggcgagtgacccactcagctctgggctgagctccagtcgtggccatggccttcagagggtttcccacatgaaggaggctgctgagactttgatgcggggcggggggcccaggaaggacaagagtctgcacagagcatgtatccaggcattgtggccgctgtgagccgctgatggagtggagcccacgtccccaaatacatcccaaactgtccttatgtggtagctgctagctgggcaggctgggtcggtgcgtgagggtggctgaggccgggagacctggcccagggctgagcagacggctgcagctttgtgctgcacgtacactcggctgtgctgctgggcccatcttccctgccgtcctgggtgtctcacagaccctcacacggctctgcccctgtcattcagggaggcccagagaagtgacagtgaacctgtcatgtgagtcactgagtcataccccgaagaacaaacctgctgagagcagaccttcccccaggcaggcccagaagccagctgcttgctgtccccacacagcccacatcccagaccgcgtccatccctggcttgatgaggacgtccctgagcacagaaggcagctacaagatgaagccacacagtcgcatctcctccctgtcaaacccccaggctggctggtcggggcccagggtgggtgcggctttctccccgcctctcccagatcctgcaggcaggcatcaattttctacggcccacaatcaagatgattttgatcatcctccttcccagcagtggcttttgctgactgtgtgtgtcacgggaggaaagattttattttgttccactgggtcatggaggggtaaactcttaatctcctggtttcccgaagtcttggaattcaagggttttgattttttttcctttttctttttgccgttcctgtccctagcatcatttcttcttccagtaatgtaggtcataccccttacctgccatctccaccattctctgtgtagc

SEQ ID NO: 92626 - DNA, 1025 bp, Homo sapiens
tgccatctcttgtgggtcacctgaacctgattggtgtcatctgtgtctgcttccagccagaaatatgtttgcgggagggagggagagagagcccctcctctagtgtctgatttgcactctgcccccaacctgtgccagctgggcacacggtgttcctcttcacatggtggtgactcccacagcccatgggaaggagtcggtgggagggtggagaggagcagaagttccagaagctccaagtgcagtgttcgcaagagaacattgtgactgtttatttccttcttcaaatgatactgatatttgataaataaactcaggaattttaaatttcatggattgagaaaacctgctgagaatagtccttggagcctcttcggtttcgcgagtatcagtgtctatcttccacatgccggagacaggagtaaaagcattgagggttctaggtagaagggtcatactgaccgtttcataagggggaggatcaataacgcagtgttctgtttctgtttttgttcgtgtgtgcacgtgtatgtgtgcgtgcatgcgtctgtgtgcatgcgtgtgggttcagttcagacagcctcctctgctaacaccctgtggaagacaaactctgtaagtgtggacggtggaagccggcagcgatcttcgtcagatccgccagctgtccatccaccgctgccccctcttcgcgtgacatctaccagtacgtttttttcctttttcctttcttgcccgtgggctttgtagatctggatggcggggggtgctctctggagccacacagctgccagcacagacacgtgccaagtgccccgtgttgtatggctccctgtggctcttgtgcagggctctcagctcccccagcctccttcgtcacagctgcaaacccctgcctgtccccacactgcaccaccaagtagcttcctcactcccttcctctgtcttccaaagcatttcagcaacatttcctcctttacacagtaccccagggtttctttttcctttggccatttggtgatttt

SEQ ID NO: 92627 - DNA, 1041 bp, Homo sapiens
gaggagccgttactaagttagtagctcccatctctcctcagatccaccctgcccagcagcccgatgaagtgggtagggcctcatccctttggccacaggtcagtcgatgtgcaaagcaggccctgcttccccgggcagagctgagggccccggcctcctgctgttgggtctttgagtggagagcaggaaactgctggctttcccccagggagttctagctgagaaaatactcactcacaggctgatagaaaaattgtcatcctaactttaggctcccagcttccttattagtttggaaaggactccctgcttcctccctgtgaatggttttctgaaaactggcaaggaaatagcagcaggtttttccttaggaaatagcaataaaaaactgaagcccttctcagaaaagcctccagtgaggaggcctgagtgggaagcctggcggctgaccctctgcacgtctctccctgtcctccgcagatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccggggtaagccacccccagccagctcggccatccgtgctcctgccctctgacctcacctgcccagggctctgcaggaatgtttgcaatccccagggctcctactccagcgtgggcgccacataactaattcatcggggctgaagggtcttaaaaataactggaggatttttagactgtaaaaatgtcttacaaatgtacattttaagtccacagaatgaattcagacaaagtgtcctcaacacacaaggcttctgggttctatttgctgctcaccccccaggtggtctctgtttctgttttctattttcccaaggttgttttgaacacatagaccctctgtggtgtgaggcgtggatttcccacaaacaaggacattgtcctacctcacacaataccac

SEQ ID NO: 92628 - DNA, 1100 bp, Homo sapiens
gtccaatgctatggtcctgcagccccctgcacccatgcctaggaagtcgcaggcagtaagtgacgagccccctttcctgcctctctgctctagccaggggggtgcaggtggtttcacaagggctcaggggaagcaagtcttcccctcttcccctggctggggcagggcggggctcttcttggtacctgactgcttggatctgggcagctggtgggtttggccctcctgccgcagctccacaatgggcccactcagagtaccctgccccggccgcttcgtttcccagcccttggccccttctctctgcttggtggggagctcttcccttttctctccctggctcctgagctgcactgacctgccccaccttggcatctgcaggcttctcaggcctaggtacgggactcctgagaccggggaaggcagggtgcttgagctctctgccctgagagctgaggcctgcagccacactaaccgttgttccctctcctgacccagaccaagttgaagcctaagcgggtgaaagcgctctataactgtgtggctgacaaccccgatgagctcaccttctccgagggggatgtgatcatcgtggacggggaggaggaccaggagtggtgggtgagtcaagggtgggcctgggaggttcctgggggctgagccacgtccctgcccacctggctggagagacgggcttgcaggtgaggttttctcagcctgagcagtccagatgtagttcctggtgcctccgccccttagcatcctcaggagctgcttcctccatggacacccccttctgagcaggcctgattattccccagggtggcttcctcccctgttagggtgcagtttccacagcactcatgagggcctgaaatgacactccttcattttgaggtcttgagtttctaggtcatcaccccccattgctggattagtggaatcgggtgtctggagagagctgacctagagcgcagagccccaggcctgagtctggtcctgaaacaagctgtggccgcccaggcgtccagcagggtgtgggagcaagatgagtgccggccacctaagaattcagacttggccactcaggggctggtggc

SEQ ID NO: 92629 - DNA, 1047 bp, Homo sapiens
gcccaccacacagtagacgcaagtggcacagctccgcaactgagctcagagcagacagttcagctgggaactcacaggatttaggggaacttctttgtcgagtgcgaggagtttggacactgtctttagtcactgtccctcccagaactcccactagtgtttaaactgcatgtcttcagcctccagaggcgctgtgagctctcagggccaggcagcactgccttcatttggcagagctgggttcaccggtctttcctgtggcctcgtttgcccttaatggattgaaagtgtctgtggcctgggcgcggtggctcacgcccataatcccagcactttgggaggccgaggcaggcggaacacttgaggtcaggagttcgagaccagcctggccaacatggttctctactaaaaatacaaaaaattagctaggtgtggtggcaggcacctgtaatcccagctactcgggaaccagccagctcccacagttgcccacaacccaccatccggaaggggcgccaacctgaccacaggcttagccatgtggaaaatacctgctcatttccaaaactggaaaatagaggcataaagaagaaaacagaagttgcccataaccacagcaccccccacccactccacaaaaagcccaccattcatattttggctgtttttagccttttatttgcctacatcatttacactcttgagatcatatttggatataatttatgtatctacccaagagggaacataagtggatagagtgaagccttccacaagtacttaactcattgaaatggggccaacttatacctttgccactttaggtgacgttgcagctcacaaacttgtgacactcagttcattcattcattcattcattgaaaaatggcaagtgggaagtagtggtcagacagctgacctgtgtgcctcccaagaacaggtgggggtggccatccccacgagcgaacatctgggacatggctgggaagagctccttacacgggagaggcctgcactatttgaaatgtggtgaggaaaaacggacaa

SEQ ID NO: 92630 - DNA, 1139 bp, Homo sapiens
ttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttc

SEQ ID NO: 92631 - DNA, 1714 bp, Homo sapiens
agctcctccacccgcgccccgggagcgcggccccgcccggaaccaagcccgagcccaggcatccctcctccgcccgccccgcggccccacccatccttcctggccgtccgcgccgctctcgggaccgtgttcccgtcaggcctccgcgagctcggccccaagcgggacgagggctgggcgctcacctcgcagccgcgggcccatccccgggttgcggacttcggggtccgcgtgggagtgccgcggcctttggcgcccaggcagctactcccgttcccgctccagcgccggcttttccagccctcctgcccacgtccgccgggccgcgcctccaagactatgcgcaggcgcagtcctgacgtcctacccccggttccaagaccccaagtggtgggaagcctcgcgagcggcgtcccccgaccggaagtcgaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgacccctgtaagggaccagcgagagagggaatgaagccacgggctgtgaggggcgcgaggggtaaccggagactggcctcctccgtcgcccgcgctcccacctaccccggcagcctgcctttggtccgcgcttgcgggccaggcttctcaggctcgaggggttggaggaccgttgatcggaaggggcctgctatagagtgaacgggattttgctttttcatcagtttcaggggagggtatgttggagtcggaaaaaaaaaagttttacggggccaccgctcgctttcgtacacgctaagaagcgttttcacttagcacaagcacggatctctgcgcgtcagggcaagctgtgagggagccggtgaagcttatgaccgacaggatgagaggaggacctgaatgaggctacagccgtgcagggaagaattaagtctgtttcttaacaccagggcttcacatgtgccagaagttagaaaatattagggacttgccgtgagtttcgatcttctcagctcaggccctagtagaataaggaaggtgtaaagctggagaagagaaagtgcagaggtgttagggacaaaaactcagccctcgactgtccataaggagagtggcctttcagtggacacgatcctcatcagtcgggaatgctgctgaaggggagatgcaaatgtagagaacttgaattcctacagatgagcatttcgaacccacaacatgtttattgttagatactagttggcacaacatgaatatacgctttccaaaaggtagaaagtatctcctttacacaatcattcagtaaggcttcattgagcacctgcttgggacatagtccgtttccttctgcttagttcacacctgtcatgtcttcctgtgatgagcaaacactgagcaagtgtcaagcaccacacatggggatatagacgcaacagagggcccagttaattgctctcgctcttttggagagaattacagtgcacagtgggaaatattggagagatactttggaataataggagactattactttgaagtcagacctgaagtccattatctacttgaccaattagtaggacaacaat

SEQ ID NO: 92632 - DNA, 1023 bp, Homo sapiens
cgtgagccaccgcacccggccatttaaatttaagccatttggcaaatacacattatgatcttaaagaagatgacagtgttgaaatgcttatggctttctacttaagtgctaattctagaagtattattatataatctgcgtaactgctagtttacattttaaatacattataatttaatcctaaaattcagaaaattgaatttaaatcaagcccaaacctttgggcttcttggatctgtaccgccttctctcttaattttaagaactgcaagatccctggactcccaaggatcagttttcatctgttctcatgtggacactgttcttccctgtctttgtgattttgtagaactctcttacgtctcagaatttttcagtgaggtgctgtcatcagatggcatgtagtgtacattgtaaaaaagtgtaagtttattggacttggttttgattttttttaatccttctttttctccccttgaatatttacagtggagctgggcaagaagtaggaagatcatgtattattctcgagttcaaaggaagaaaaataatggtaattactatttttgtactcagtttaatagtatggctctgtctgtattgggtgttagtcttttctcatagactagttatctttttagctcccagaaaaatgttatagtacatgtaatctatgctgtatagtgttaatgagaaaaactaatacacacttctacttagtaatttagttgattaagaagatatattctatgactgtaaaattgtcagctagatctgttgaactgttacctcttcaaagtccctcttccactcctgaagggttgagccagcctaactgccccacccccagtggaagatcccaagggcccaagcactctgaacacactgagagctctagccgcctccagcatgtggggatcaagccttggcctagaagcttggatccccaggtcccactggggctgccggccttggccaagtcactttgcttctctaagcctgaaaggtagaggggttagagga

SEQ ID NO: 92633 - DNA, 1074 bp, Homo sapiens
gacagatttggaagaaagcatggacaaaattgaaactatcaactttcatgaagttaaggaagttgcgggaatcaagttttggtgttaccatgcaggtcacgtcctaggagccgccatgttcatgattgagatcgcaggcgtgaaggtaccctctggctgtggcgcttttctccccagagaaatcagtacagagctttgtgccaccaagtactattaaaaaaaaaaattccctaagacttgcaaagtgtcagaacacggaaacataagataaaaatacagttaacgcttgttccttttaaatattgcagttcctacctccattacaatactttctttatcaagactgaggaaaaaaaaatttttaaagactgagaaaagagtaaaataaacatctcaaaaagtgattccctgacaccataggattccgtttgctttagaaaactggttagggaagaggtgtctttgtggctgcattcgtttaaaattaaaacacaatttgatattcatgtccccctgatgtcttagaattcacaggtaagcccctaagcagggtggactgcaagagtgaaaggggttaattaggaaagatctttggggaagccttgaacttctgacaacgtgggtgggccgctggctttccagactccagagcagccgctctgaactcaggctgcaaataagactcacttagggagctgctgaaaataactgttgaatcaaaatctggaggcgcagcttggccttttccttttcgagtttgctaggtgattctaacgtcagccagagaaccaatgctctagtgtcacgtcctaaatttttcacagctgcttatacatttggaacttttagacattgaattgtaaagtatatcactaaatcacttattcttgcagtttgctccagggcacaaaaaataagtagcacaaatgcagatgtgaattctcttggaatttgatgcagaccctcttatgattttatctccggttttagaccatgtacctcagtgcactcctttccttgtctgcatgccctttttctctaagaagttcagagcacttctcaagtggattaatg

SEQ ID NO: 92634 - DNA, 1457 bp, Homo sapiens
tcctagctagttgggggactgaggcaggaggcttgcttgaacccaggaggtcgaggctgcagtgagctgagatcgcacactgcatttcagcctgggtgacaaagtgagaccctatttgaaaaaacaaagattttcagaatagaaatatatccacatatctaggaaatgactttggagagcacaagaatagttgggaatacaggtttgtctttctaagcataagagttatgattctcactgccagcactccagatagatgagttttagttaatttgtttacttttctcattaaatgtttgcttgattgagaacatgagtatttgatatttactgagtcagttatattagaatgattttgtgcgtaaggtcctaaatttaacatgaatttatgactgcatgaaaaaaatgaaaatgtacctttacgattataactgggtagtttgttttgttatttttctttattttccacagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtggttagtctatgaatttcatttattgtattaaagggaaaaaaagtgcatacccaggaaactgtgcagcaggcagttcacaaagcaggcatcatcacctactaatgcgacaccccctgagcagagcctttcacatgcactcggatttggcctttacaactcccctttgatttcagcaagctgccccctttctccagaactgactgactcagacctaccaaccccaatcctaatgtttttctgttattttctgctgcctctccaataatttaagagccaggcttggagtatgactgctcatttggaatgccagctccatctcttacttactatgtaacccttggcaagttacttaacctctctgtacctcatttgtaaataggaataatagctcataaggttattgtaaggatgaagtgaaagaacatatctaaagcacttaatatggtgcctggcacatagtaaatgcttaatatatatattatatatatatatatatattttttttttttttgaggcggagtcttgctctgtcacccaggctgactgcaactccgcctcccgggttcaagcagctctctgcttcagcctcctgagtaactgggattacaggtgcccaccaccacacccggctaatttttgtatttttagtagagatggggtttcaccgtcttggccgggctggtcttgaactcctgacttcatgatacacccgcctcggcctcccaaagtgctgggattacaggcgcgagccactgcacccggccgacttacttatatttttaagtatcgtgtaacttattaaaaataagttagatattttgatggaattggaaaggagg

SEQ ID NO: 92635 - DNA, 1570 bp, Homo sapiens
ccactgtctattttcacagcttttcatcactccaagcagaaactctgtaccgttacacagtaactccccattcccttccgccaaccctggtaatctcaaatctactttctgtttctatgaatttgactattctaggtatttcatataagaggaatcataatgcctatgatgttttcaaggttcatcatgttgtggcatgtatcagcacttcatgccgaagtcatggtccgttatatgtagaccacatgttgtttatccattcacctgtgggtggacactcgggttgtgtcactttacagcaaatgtgaagtggtatctcgttgtggtttttattttcatttctctaatgactaatgatgttgagcaccttttcatgcagtcttttgttcgtttttgagttttttctagcatgataggcctcacaggtatttgccactggcccttaatgagcagattatttggtcaagaaaaatcactctcctgtctatagcatcacagtgtgtagggtttagtcacagagtaggctcctcccaggtgtttcttattgtctgtgtgcatgaacactcccccagatttccaagccagggaggaaaagccgaattgctcttttgtgtggtgtcaccacctcatcctcagccccatttcatcctgtcactctcctggttctacttctgctgacagtttaagttcctgggttgaacttcatgctcattttcttgtgataaccagctccagcaaaagtatagctgcaggataaaattgcaatactagtagtgttggtggtagtaatgaatactagctaacattgattatttaccatgtgccggacactgtatatgtgttttatatgaactgacttgcttaatcttcatgaccgacagctgttctgcagatgagacaactgaggtgtgaaatcacttggtcaaggttacacagcttaaataagcagcagcaccaggattctgttcaggcagccaggcccaggcccttccccagcaagcagtaagcccctgccacgtgctggtgctggctatgcccagccacaagccatctaccacatgtgagaggctaagaacaatctatcttggccgggctgcagtcccagcactttgggaggccgatgtgggtggatcacttgaggccaggagttcgagaccagcctggccaacatagtgaaaccccatctctactaaaagtataaaaattaggcagggcacggtggctcatgcctgtaatcccagcattttgggaggccaaggcgagcagatcacgaggtcaggagatggagaccatcctggctaacacggtgaaaccccgtctctactaaaaatacaaaaaaattagacgggtgtggtggcaggtgcctgtagtcccagctactcgggaggccgaggcaggagaatggcgtgaacctgggaggcggagcttgcagtgagccgagatcacgccactagactctagcctgggcgacggagcgagactcggtctcaaaaaaaaaaaaaaaaaaaagtataaaaattaggtaggcatggtggttcacacctgtatcccagctacttggaggctgagg

SEQ ID NO: 92636 - DNA, 1048 bp, Homo sapiens
ttggaaccttgcactaggataatctgtcataacatagaaggttaataaaatatgtctgaactgtccttgattaagaggatgctagaaagaccagaaaagtctcttcaacaatagaattccgctgtagaatgttgacgcttacgaagacagaaggtagatgaaactagctggcaacaattgacaaattttatgttatatgttaagatgctagtggaaggctaaatctcttgtatacaaaagatagatgtttgagcatcacttaagtttgccactgataaaatgtttgatgtccagggtaaatgctatctagttgaatgtttgcaatacatgttcagacctttccgttgctgtactttgctgtttaaaaattgactatacaaatgagttactaactttttaattgtgtagctgctttattttagctgtctctataaacaaacgaatggtctctggaagattatcagaaaagtatatacatcttatagttatgtctttctttcaggtgatgtggaagaattagaaattcaagaaaaacctgctctgaaagtgttcaaaaatattactgtaatacaagaaccaggcatggtggtattagaagtaagaaaagatcatttacctaaacaatgaggggaaaaaagttttaaaaagagttcatgaacaattgtagagaaaattagtttcttcccaattagaaaaagaatattgttggaaagtatatgtgtgtgtgtgtgtgtgtgtgtgtgtgtgtgtgtgtgtgtgtggttttaaggatcagcattaagtataattaagtagctgagcattttctatgtagtcacaaaaaaacctaataataaattaagggttcttatttagtatgtgtgataaatatagtcctttcctataagtcttacctgattttgtggtactccaggatgtctttagttatatcagaaggttttacaattcttaaggtaaaaatttaattctgttaaattaaaacaaacttaggtaccactcgttaaaagagcagaattttgaagattcaaataaacaacaataaagtgac

SEQ ID NO: 92637 - DNA, 1036 bp, Homo sapiens
attaaccggtttaagttgaaacacaacgaatgtatttactaaaactatttaatcaaaaccagaaatctcaaatattctatagactgtttaaatataaaccaaactaaactatttaagttccaggatattagtgactttttacctgagatacttgctcagattatctatctgttgtgaactccattttaaaagcacctcactataccatgcttgaagtcaggtagtctgtagacttcatcacagcccctttatatataattacttctctcacggaggagtatggtgtatttacctgtatctttgaatggcttaagattagcatgcttcagctatgttcttgctcctatcaaagtgaaacctgggggtggctcagagacacgtgacgggtttagaatcccagagagcacaccctcactaaaggccggttactgcgaccataaacacttcttgcccacaattcatctttttaaaatttttcgtttcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaaggtaaaagcatttttgatgttcttctagctcacttttaatcatttttatgttacagcaaacttgcatttaatatacttttttcaactgtttactttctcccaatagatacagttttgccaaacttatgttgtttatatgtattcctggctttaacactggtggattttattcttgactcagtttctacataccttggttgctggcagtcctaatcttgcaaacagttaaatattttctagagtctgttagtgctatgctaagtttgtaatgtgttctctttagttgatgcatttggcagcagaaagcttaaggataccttgtggcttgcatcacactgatggcagctggtggcgtgtcttagggagggatatgtcagggcagcagccaccctgacctcagtta

SEQ ID NO: 92638 - DNA, 1047 bp, Homo sapiens
gtccagctgttacatgtaagaagccagcggtgtcagcgcagcgttcagcttccatggcctggcatttcctactagtgcagcccttaccagcccccagcccagctcctgcagccggcactctccaagcagcccagccctcctgggcctttcctgcctctctgcctctgttcaaggtgtcctctagaacatcctccctggcgcctcagaagattccggttaccactgaaggctccttcttcccactgcaccttgtcctctgctgggtagagcagcacaccagtaacctgcaaggctcatcaacatataccctaaaccccggggctggcccaagtggggtcaatatttaatggcattttgaaactgtctagatgagtggagcagaacttacacaagggccagcacttgggtttaccaactgccacctctatttcttctcttcaataggttgcaaactaaatcgcctgaactctgttgttggtgaatatgccaatgcgtgtttacaagtggcccaagactgtgggactgacgtacttgacctgtggaccctgatgcaggacagccaggtacggtggcttgctcggtcctctcggggtaaataggatcacacagaagtaaaccaggtgtgtgtgcagcagctttccctagaaaggccctgcttagctaagacagtcatccctttagccaatgaaaacaaacaggcttgggggaggggaggaatggaggttccaggatggctcacaagcccagcagcttaattcagccaggctccttggctaggagttagtgcgcagtgacatcaatgagcaacacatggctcatatttatgaacgtccaggccaagttcttctttcatacagagaatggcagaaagctaaaacttgttaataggtaaaacaatgaatttaaatacagtattggctaataaaactgtttgagatatgtagttctaattaagttactttgttttaaagcctgaaagcacaaatataaaaggtaaaaagcaggtcccatggaatggtgcactgactcaggagacagctggtttct

SEQ ID NO: 92639 - DNA, 2078 bp, Homo sapiens
gtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaaaattcactatctacaaacctagaatatttaaaatacaaagattgcctgttttcaaacactattgaataagagggtgagatatttcttaacaacaacaacaacaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctagaagggagagaaatcggttaaaggtgggtaactggcca

SEQ ID NO: 92640 - DNA, 1011 bp, Homo sapiens
ttattcccctgcccacagagggataaatttctcagaaaacatagcacttaaaccttgcctctttctgtacttaacgccaaaatgtatttcctttgagtgcaaaggaaacacttctagactggtggcataactaaagcttgggtgagaaatggattgtcatctgttgagcctgctatcactttctacaactcaggttctaagttcttcagttagtgttaggaatagcctgtgatgaaatagtactcactaactgaattgtatttgtagggaatgaccttcttgctgtttctttctaggataagaaattggataaacagtatgaatctctgtctctgtttcaccccagtgtaagtataccatatgaaagaaacataatcttcgcctggtctgaggccctgttaggcaaagaccttcacctgacccagcaagagctttcactggctgatggaaggtcatgttgcagcaggaagggtctaggttggaatgtttacccttctgacaacagtgatggtgaacttcgattagttgcatggatggacatttaaagagctgtgctgtccccttcccaagccataaggagtgatttagccattcaacacttagttaatattttgagttcaatttctctcttgggatcttaccttgagaggtttgaatcctcttttgggtcttcaaatggtaagtaagttttcaggatgcttgaaagctagtaattactgtttttgccattaaaagtaatggcattaattacttttgcaccaacctagtattttttagtcacttaggttgagtgagcctcacctagcacttttttcttagcatcacagtgccaacagaataagaggctgtttgatgggtaagggtggagctgtgaggacctccgattcatcttttattcctatcaatcaattgaacccatgtctttgcagaacgtcgaaatgctgagcagcatggattctgcatcggttcgcattatcaaaccctttcctgcgccccagactccaggccgcc

SEQ ID NO: 92641 - DNA, 2226 bp, Homo sapiens
gcaagaaggtcattccctacaaatacaattcagttagtgagtactatttcatcacaggctattcctaacactaactgaagaacttagaacctgagttgtagaaagtgatagcaggctcaacagatgacaatccatttctcacccaagctttagttatgccaccagtctagaagtgtttcctttgcactcaaaggaaatacattttggcgttaagtacagaaagaggcaaggtttaagtgctatgttttctgagaaatttatccctctgtgggcaggggaataataaaggcatcttcctgtgcatgaaatgacaaatgtcccagatgctgggtacaccaggaccgcactgactggaagggcaactggtaggaagacccaggtggctgggcctgcagcattcttcgcactgccccggcccatggcctcactctcttagctgtctccacagtttctgtggaccatgctctgctggaggaactgggcctcaatccctacatcctacttctgcagaaggctaaccacatggccatctgctgccccatccctgcctgtggctgaagcataataggtgacagagggcaaggaccaagaatccaggactaggcttcctgtctgggtgccatcaatgcattctatgaccaaaaacaagccatggccctccctcctatcggaggctttgctctgaaatcaagggtcgtgccttgtccacatgtgcaacttccctgtaaacaaaataggttccatcctccaatagaagcaatcgtgatggatggcactgtcatccagagacatctgtcaaagcttcaagcacgtcaccttcagctttcttcagcacaagtgctccctagagatcttcctatacccatcatgctcaccaccctgaggaagagctgctctgtgagatggcccctaggcaggagaagccagcaggaaaggaaaggaaggaggcagtaggaaaaactcctttgtcatcagagttgtgctggaatttttaaatgctcataggaaggccactatgaaagagtttgggaaaacaagtctggaagcctgggtgtgactttctcatctctacagcagacaaatccccattccccacagatgcaagtgaatggattcgtaagaacatttatgaaaaagggcctcaaatttataaaggaccaggagttccttagtcaaagcccaattcaacttgtagctgttactgattctgaatgagaacagaaaagactgcttactcttattttttggggaagatgtaaatactctatatgacagctgggccccagtccctacatcctatttgtgcagaaggctgaagacatagccatctgctgccaataatctacatgatatatggggaacatctgaaatgccgatgtttgatatttgctctattgcaacgaagtcagcctgaaaatgctcttcaataagggctttactcatcaaaggacctggacaaatccagttaaacagtctcctatgcttaaaagtataaaattcctaagaaatttatatattaaaacaccaacacacaaaaatagtattttttttaaaagaccattagttaagctttctacaagacatgttcccctaggaataacaacaaaaaaagctattggaaatatcaggccaaactttgctaagaacaagttttaccttttccagagattacatggttggagttgatcaaaatttaaataaaacatttaattacttaaaagttgatgacttaccacacaatggacaagaatgctgaaaggaatccaaaatatcaaggagaaaaccaggacagacccaacgatgttgtctgctaaaaactttcctgtgaacaattccaaacagttaatgtcttgaccaagtacttcacaaatctaaagtgaaatgctcttaggatattaccattgtgtcaaatgccagagctgctggctagacatactaccgagagcagaatgtctgtgctgcctgtattacaccacaccatctctccataccaagtgcttttaaagaaatagccctcatatactggctgacaggaagagattgcagaatattcaacatgttacctggagtagctgtgtcaacagattaatatggaatgctactactagtaaatgcttaagaagacaaagtttttgttacctggatattatttttgtgattaaattatggactcgtgacaacatgatataccctgcttctgcaaaatatgaggctcacttttacatc

SEQ ID NO: 92642 - DNA, 1085 bp, Homo sapiens
atacttttaagcataggagactgtttaactggatttgtccaggtcctttgatgagtaaagcccttattgaagagcattttcaggctgacttcgttgcaatagagcaaatatcaaacatcggcatttcagatgttccccatatatcatgtagattattggcagcagatggctatgtcttcagccttctgcacaaataggatgtagggactggggcccagctgtcatatagagtatttacatcttccccaaaaaataagagtaagcagtcttttctgttctcattcagaatcagtaacagctacaagttgaattgggctttgactaaggaactcctggtcctttataaatttgaggccctttttcataaatgttcttacgaatccattcacttgcatctgtggggaatggggatttgtctgctgtagagatgagaaagtcacacccaggcttccagacttgttttcccaaactctttcatagtggccttcctatgagcatttaaaaattccagcacaactctgatgacaaaggagtttttcctactgcctccttcctttcctttcctgctggcttctcctgcctaggggccatctcacagagcagctcttcctcagggtggtgagcatgatgggtataggaagatctctagggagcacttgtgctgaagaaagctgaaggtgacgtgcttgaagctttgacagatgtctctggatgacagtgccatccatcacgattgcttctattggaggatggaacctattttgtttacagggaagttgcacatgtggacaaggcacgacccttgatttcagagcaaagcctccgataggagggagggccatggcttgtttttggtcatagaatgcattgatggcacccagacaggaagcctagtcctggattcttggtccttgccctctgtcacctattatgcttcagccacaggcagggatggggcagcagatggccatgtggttagccttctgcagaagtaggatgtagggattgaggcccagttcctccagcagagcatggtccacagaaactgtggagacagctaagagagtgaggccatgggccggggc

SEQ ID NO: 92643 - DNA, 1917 bp, Homo sapiens
gggtcactgagctccccacccaagggtggacagttgtgtcccagctgctctcgctttcagggagccagtgtgggccctgaggggcacactttagactgaaaaaccaaggattgaagtcagcagggtgacaagaaagttgggacaaagggaagcatttagaagagcattgtgaggggcttgaaggggagagaatagttagactttgaagagaggtcttgaatctagaatggatttttctctgcatttttttttaaaccttgtggcctctgtcactgaaggctgaggagtgtgacctcagaaactactccttggtgggggctatggatagtattagctatttaaataaaaaataaatgtgatttcttacctctttgggagcatggtcagggaggaaagaggaggcaggaggagaggcaggtctcagaacaatccagctgtcaatgcgtgttctctgttccagaaactgacaactcctgcaaggtgtgctgcagggacctttctggccgctgtgtgccctatgtcgatgctgaacaaaagaacttatttttgaggaaaggaaagccctgtacagtaggattttgtgacatgaatgtgagtatttatgtacagctttttctgtaacagccagataggaagtttttattttgtaagtacttgattttgcagatgaaaacaaatcaaaacacaagtggggctacatccttctggcccattgttatctacgggtattacttaggaggagaagacggagtgctttcaggtccctgcctgtagtttccttctgtggtgggaggctttgagcccagagactgagaaggactggggtggggactttatggtaaagttggttggtttcaggcagtgggtcctaattatgttttcctagattacttacagaactgactaagattgcaaaattattcagggtgtgattttgaaacaggtgctgaatgagtaggaaagacctagaaggctgcttgacttacttaagccagacccttttgttctctagagaagcataatttttctcatgcagaatgatgggagagggttttaagatttacgaggcttcacagggagtctggctgtgttgttcactgtccactgtgtatgtgtagagtccttactggaatgcctcatctttagcaaactggtttccttgatttttgtctcctggtaattctaaatcacttgtaaaaatggagtaattatgaaagtgttaatgacagatgttctactttcttgggtactcattacgcggaagttattgccttgtgtcaaagatgggaaaacgtttgattttaatgaagccctttacatgtcagttatttttataaagctacattgcttctgaatacattgtgtttgggaatgatgctgtatgtatgttttttcttcatagggcaaatgtgagaaacgagtacaggatgtaattgaacgattttgggatttcattgaccagctgagcatcaatacttttggtaggtgatttccccagattacttactgagagctgagtcaatttctgtgatgacattagaaaagtgtgctttcagagtgatgtgctttaattctgcagtagaaggtggaactattcacagctttagttatgaaacaactttgttggctagaataaaatgaactcatagatagtctgtccccgtggagcttggatgcacagattttctgacaagggaaataaagtcaaaatactggcttccttctttacccaaaaatatccatgtgattagcataagcatagtttaatgctatagactgaatcctgattgatgtaagagtgtttatttgactgaatgctatatactgaatcctgcttgatgtaaaagtgagcctcatattttgcagaagcagggtatatcatgttgtcacgagtccataatttaatcacaaaaataa

SEQ ID NO: 92644 - DNA, 1050 bp, Homo sapiens
atgttttatttatttattattatttattatgattttttgagtggagtctcactctgtcgcccaggctggagtgcagtggtgtgatctctgctcactgcaacctccacctcccaggttcaagcgattctcctgccttagcctcctgagtagctggggttacaggtgcatgccaccacacctggccaatttttgtagttttagtaggatggggtttcaccatgttggccaggttggtcaactgactggtcaacaaactcctgacctcaggtgatccacctgcctcgacctctcaaagtgctgggattacaggcatgagctgctgtgcccagcctatgttttaaatgaattccttaataaaaatatttttaactgatgaaaagggcttacaggacaaaaataaagtagttccttgacctagaaagacagaacccatcaccctctactaggcaagcctatgaagagcagtttgccacaggtggacttctctgtggacagatgacattagtgaaaaggaatgtaggacctttgagattgtaacttcttaggaaggtttgctgaacggaagaggaagtcttatgacaaggatgcaaacagaagctgccagatcttcagggatgtgtaggcagaaagccagagttgcgggttggtccttttatcgttagtgctctccagctgcttgggagttgtaactctgacaaatcagtgaagaggtcttcttatctgttcactgtgaattttaactccattttaacctgataaaatggaacccagagatacatgatgttgatgaataaacccaccaaaatgacaactgcctgaggccccgattagaataaccagaccccttagacatctgtactgtaacgacagatttgggccgggcgcggtggctcacgcctgtaatcccagcactttggagaccgaggtgggcagatcatgaggtcaagagatcgagaccatcctggtcaacatggtgaaaccctgtttctacaaaaaatacaaaaattagctgggcgtggtggcatgcacctgtagtcctagctactcagg

SEQ ID NO: 92645 - DNA, 1175 bp, Homo sapiens
agtgctgcccaatagaactttctgctgcggggcgggggatgttttgtgtctgctctgcccagtatagtagccactagcccagtggagcaattgaaatgtggctagaaactgaggaactgaattgtaaattctattttatttaaatttttaataatgtttgcctgtgatgggagacgggaatgggcattaactgtaaaaggacatgagtgagattactggaaggatggaaatgtcctaaaattgacttatagcaatggtttcaacacttggtaaagttattagaaatcactgagttatatacttgaaatggatcaattttgtgatatgtgaaatatgtcttaataaagttgttaataagccaacaaacaaaaacagcagtgtgggagcagaggaaaagtagcgcggatgtagaggagctgtgaagtcataagttgattattgttgaagctggtgaggggcacgggggcattcatgataccatcctgtctacttcatagatgcttgaatatttctgtaatagaaactgtaaaatatgtgactaggaacaaaatttaagtagccacatatggttggtggctaccatattgcatactgtttctctaagtaataggtcatatgcttcttggttatgaggatagtgtcagaacttgggagcaaaatgttttactttgcagactgcctgggtggacatgcatgctgctgactcttcctgctgccagttctggggctcttcaaaacagccctgtaagaacttgccagtgaggcatggtggctcacacctgtaatcccagcactttgagaggccgaggtgggcagatcacttgagcctaggagttcaggatcagcctggacaacatgtgaaactccatctctacagaaaatacaaaaattagctgggcatagaagcacatgcttgtagtcccagctactcaggaggctaaggtaggaggaacccggggagttcaaggcggcagtgagccaaggttgtgctactacactccagcctggatgacagagtgagactttatctcaaaaaaaggaaaaagaaaaaaaagaacttgctaatgagaatggggcctgggaagaactttttttttctggagctgccagtctgtatcaatgaagaacaatttatttattttgtcctgagcacatcatatttagtctgtgttttt

SEQ ID NO: 92646 - DNA, 1043 bp, Homo sapiens
ctcacctgtgcaggtggagaagcactttagggaaagagcaaagcactgcacgaggttgtgattgctggtgctgagctgcatgccatcatagttctgttctggaatgtttagttgatttagattacatcttttagtctgatgtaattgttaatctaagaatgcttttttttttttttttttttttggtctttcaaagcaatttagctttgatatagctgaggaagcatctaaagtttgcttggcacaccttttcacataccaagattttgatatgggaactcttggattagcttatgttggctctcccagagcaaacagccatggaggtgtttgtccaaagggtaagtttttccatttcttgtgtgaatatgctgctgggattattaagatgattggattatattataattctgtatttaataagcaatttatctctgtttccttttgactttagcttattatagcccagttgggaagaaaaatatctatttgaatagtggtttgacgagcacaaagaattatggtaaaaccatccttacaaaggtatgttcttttatttctaaaagaatagtgttagagtttattgtagtagaacctcagttatatatttatgtaggtatttttttaaaaaatgtaatatatactgttttttaaatttctgcctaaataaaatttatgtatttttgtgggatatatgaaaattaaagcataaagaagaaaataaaaatggcctgtcagccttcttttgaaacatgtgaggaccactgcttttctcgaaccctctgtcctggacccctctgacctgcagcaactcttagagctccctgtctcctagtcctgcagtgcagctgtcattcaaggcatcccacaccctcttattttcagaaccccatggtctccctctttctcagtgccatcattttggtgtagtgtatcttgcaggagcttcctaagaaaacgtagatgacctgcatattgttgggatttcatatatctgaaaatgtctttattccactcttaagcctgattgataattttggctg

SEQ ID NO: 92647 - DNA, 1125 bp, Homo sapiens
agcaagaagaagctggtgcagtaaagatgtctttctcattgccttgcttttcccatgctgtccattttattcataccctcccaacttctttcccttccctttcatgtcaagtggatttttttttttttttttcaacacagagtctcactgtgtcgcccaggctggagtgcagtggcacaatctcagctcactgcaacccccacctcctgggttcaagcaattctcctgcctcagcatcacaagtagctggaattacaggcgtgaaccacagcactcggccccatatcaagtgaatttattatgaggctagtaagagtcactgtgattcttgttcctaaataagagagatttttactttaaaaagcttctctcttaatctgggttttatattaaggggctcctcttattttacttctttgttcattgcactataaatatgaatataatgagagatctagtcttaaaaattgtatttttttacaacttcttaggcataacttgtttcacagttgctagaacaaacctcatcaacccagtttttgaacagtagaatattctctttgagaaaaagataggtaattagcattttgttctttctcatgtcattttccttggaaactatactgccttccttctccagttttcccaaatcagagaacaaaagaaggagggttgctgaaatgaaccttgttctttctggctgtcttcttacccattcctcagtgctgaactttttggggtgagagtgggggaatagggttggcagttgtctgccacggccccttacttgtttctggggaagacattcgaggtactcaccaagagatagagtgaagatggaattctttttagaagggaatacagttgacccaggaacagtgcgggggtgtggttagaagcactgaccttcttccctctgcagtcgaaaatcctcacgtgactttttttttttaaggctctgtcgcccaggccggagtgcagtggtgaaatcatagcttgctgcagcctctattgcccgggccaaagcaatcttcccacctcagcctcctctagctgggacaacaggtgttcacccttcctggctaagttttttgatttttagtagagatggagaatttcccagga

SEQ ID NO: 92648 - DNA, 1098 bp, Homo sapiens
ctcactgcaacctccgcaccctgggttgaagtgattctcctgcctcagccttacaagtagctgggattacaggcgggtgccaccatatctggctaatttttgtatttttaatagagatggggtttcatcatgttggccaggctggtctcgaactcccgtcctcaggtgattcacccaccttggcctcgcaaagtgctgggattacaggcctgagccaacatgcccggccttactctgttgagcactttttaaagtttctgtattggaaaaattaaagaggcacttgtccttggttttgaattctacagtgttttaactttatgttacttttcacttttctgtcttcctccaaattattttttgttgttgttcagaatcctttagtgatattaagctcacataatgtttgtttcaaaaatatgttagatttaaagtgttaccataaaactccttgttttggtgaattttgatttaatagtgcatacaaattcatattagagcttgttcatcgagtgaaaagaagagctgacccagatcccatgaagaacacgtgtaaattattggtggtagcagatcatcgcttctacagatacatgggcagaggggaagagagtacaactacaaattacttagtaagtatttgatattgcatcgagtaattgaaaaaaaaatttgggtgggtacattccatgaaacttaatgcaaccagatctgttccagatactctgttatttccctaaaatatttgagggatattctctgaggtttttatgttactgtatggaaattatagtttcaaatttgtgacaacccattttacccttgaactaatattttctgcatgttagaatttatgcatatagggtttgggagaggttataatgtagtccttcctccttgatataagtgagttctttaaaaacatcactgctatcatggtagtgaacctgtggtgtcacatgtgaatgtaaaaatatgtatttgcatgaacccatgtttttcttttgcttatatgtatatttcagagaggaaggcgagttttgtttgtcatgttaaagacctaatcattggacttcacttgaaataggtgggactttc

SEQ ID NO: 92649 - DNA, 1035 bp, Homo sapiens
ggatcacttgaggtcaggatttcgagaccagcctggccaacatggtgaaaccccgtttctactagaaatacaaaagttagctgggcatggtggcgtgcacctgtaatcccagctgcttgggaggctgaggcaggagaattgcctgaacctgggaggcggaggttgcagtgagccgagatcgtgccactgcactccagcctgggtaacagagcgagactccatctcaaaaaaaaaagagaaagaaaaccagcctagaagtcaaagatctggcttccatggtcattcacatacttgttaaatatattgagcgcttgttatgagtcagggactgaagtaggtaccagaactttaaacttcactactttatagctatggctttaatctcactgagtttctgttttaccttttacagataaaaggtggacaatctatctagcctgcaagccaatgtgtgaaagtatttccaagtgtaaagggctgtggaatgtatgtagtggaacactcaagtgggaaggaagttagcaggatagcctaattttggaactagaaagttctaataaagtgaaaccagtcttgtggataagaaaatcaacaacactgagcagacctattgccctagattttcaagggcatagtcacaaaaagaaaatgacggtgtaacttgggaatgcgaagttaaaaaaaaaaaaagacaattaagctgtggttttgcttctaattagcactctctgatggaatacaatgggaaaggtcattctgttgaaataagtaaagaaaaatcaggacccagagaacaagtgctaaaaggaaatgcctttgaccaaaaactcagtcacttaccagcagttaagtcttgactaaggagttttgattcagtaagtctgaggtagggccccatagagcatttgtatttttaacaaattgatgctgatgctgctgatcaggacctggtactttgagaaccactgctttaaggaagcctcaataatgaaggccaaagtaaagatcgggtgagtttcacagcagagtagtaaa

SEQ ID NO: 92650 - DNA, 2134 bp, Homo sapiens
gtagagtgcctttttaaaaaagtttctcttttttttttttttttttgagaaaggatctcaccctgttgcctaggctggagtgcagtgtcataatcatggatcactccagcctcaacctcctggattcaagcagtcctcctgcctcagcctcctgagtagttaggactgtaggcacacaccaccccgtacctggccaattttgtttttgaaattttttgtagacgtgggatcttgctatgttgtccaggctgttgaactcctggcctcatgcgatcttctcatcttggcctccctacgtgctgagattacaggcgtgagccactgtgcctggccaaatgctttttaaataaaaaggaagctataaaaccatgctccagtggtatatgtatgtatgtatgtatgtcattttgtaagtgcatagtgaaaggtctgcaaggatgtactttgggaaggtgatggtctttggggttttgagagagaacttcagtcttagtcaagatctccattgtttgaggaatttactactcttgtagttaattttgatataacaatactacttagtgtaattgcctaatctagaaatagtaacttaatatgattcttctttttctagctttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaagttaattatgtgattgtgagtgccttggctgttattagaattgtgcttcagtggatattcaaaaggaatgtaagagttcagacacagatactcctcaacttaaaatggggctacaccctgataaacccattgcaagttgaaaatacg

SEQ ID NO: 92651 - DNA, 1155 bp, Homo sapiens
gtattttcaacttgcaatgggtttatcagggtgtagccccattttaagttgaggagtatctgtgtctgaactcttacattccttttgaatatccactgaagcacaattctaataacagccaaggcactcacaatcacataattaactttgctagttttaaaatgtccactttattccatataacacttaaccagatatcatttacatctgaggaagagatggcccatgagactgatctatagtaaaacactctaagaaatgcagtccaattttatacacttccaggcatccctagacaagtgtgtcacaatgcacaatgtggaaatataggtatcactactacattttacataaaagggaagtatcaataaactttagaaagtagtaaattcacctgtcccttaaaatatgggtatgcaattgttacaaagccatagtaaatggtttataaaatgtacttttattttatgttactctgctgttacatagggcataacattttcacaaggcttttttgggactacagtcaatgattagcaacacacaatagtggtccaactctctaaataacaatcactagacaaactggacaccctctcacatgtgcacaaatctgcatggaaaagtactaaagttttagacttggacttgtgtactttaatttatttcccctttctagtgtattaagaaatgacatgcactttaatttgccaaaagcaatgcttgtattctggcagcaacatgctacttctatcacatagtaaagtgaataccagaactacaaaggcaggaggtgtaagtgaatttttattgggaggggaggttggcaacttaaacagcagcaaataaagagtgaataaggaaactccctgttgccacagatacacaagacctccgtatgtgatacaggagccatttcaatttgtgacccctagacagagatggcaagtgcttttccattcaatctaatacttccggattcctactaaaaaggaatacattaagagcatggaaaagttgcttactgaaaggaaacccccgaagagtaagggagggaatgtagaaattaagaagttatgtggaatactctttaaattgtaattaactacattttcttattttcacagtaatacaaaacacagtcacttgcagaac

SEQ ID NO: 92652 - DNA, 1067 bp, Homo sapiens
tcctgatctcaagtgatccacccacctcggcctcccaaagtgctgggattataggcgtgagccaccgcgcctggccacgataatgttttttgttagctaccatgattttaaaagacccatacagagaaaaaatcttggttctaccaagagctagtagcatatgttcaagttgttaatgtactgtgtactggatggttatttttaatattgcacttcttatttttcgctcttcacagaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggtaagatgtgtgtccaggaaatacgtactttagctacagttatttgagataccaggtatgttaatttataggtattttacttggatacccagggatgatttctactatatttattttgaaatctcctctttttcttcccatcatgattacctactcctacccctgacaccttactctaccctatgattataagcagtgatgtgcctacagagcatactgagcagagtaatcaaagaaggataaatgatgttaagaaggaaacataaaagattagaaagtcatgcctgccaggtttggttactagaatagctgtgcatcagccacattcctcaaagtggctcaaaacgagagaataaagaggaccctgtagagataagtactacttaactggaaagaagtctgttaagcattgctgctgttccgttgtcctgtgaaagaaccaagacatgcttgtttactaagtgtatagttttataaaattccagtcatactcataagttcttaaactgggagtgtgagagaatggttctgttgagtttgttgatggtagaacataaggtgggtgttcacttattttgtaaaaatggtttgtaattgtagaataaccagttttcgtcaatgcacatattttaccatggatattaatatttatcaggcttttgatgag

SEQ ID NO: 92653 - DNA, 1507 bp, Homo sapiens
tgtcacccgggctgcagtgcagtagcatgatctcggctcactgcaacctccacctcccaggttcaagcaattctcctgcctcagcctcctgagtagctgggattacaggtgcccaccatcacgcttggctaattttttgtatttttagtagagacggggtttcattatgttggccaggctggtctcgaactcctgaccttgttatctgcccgccttggcatcctaaagtgctgggattacagccgtgagccaccgcgcccggccctaaaaaggtttttaaatggatgacctagcatcaagaaaaatggaatctaagaagatttctatcatatttgtcttttgtgactttttatactccaaggcatagcataccatgtactagaagtgaaaatttctttgtatgaaattagggacaaaagacatactcaagaacttttttaaaaaaataattagatttcgtagacctaaaattattcttttaaattgctgtgcaagtttctaaacctcttactctcgattcctgtatttacctcattttagatggatacttgaatgcaaagggcactgagtagcactattctccctcgtacttgatgttttaaacattttgtttcccgtccctaaaatgagtgcacatccctgttttctgtttggtgcatttctacttttccttcttcatgcctcaaatactctttccctgggaagcctgtcttaactggaggccatctccagcagagctactccatctgtgtgcttccttagcaccgtattcacatctttcttagttcttggtatgtagttggtgtacttacagacggtgagcttcttgagggcaggggcctgattttaagtcttctctatatccgttatagcacctagcaggtatgagtaaatgttgaatgaatggatgagtgaacagataggctgtttcaaattacaatgtttggtgtaatctagaatctagccttaccattagaaactataggctacatcatttaaagcctcccagggcaactagtggcaacaacctaacccctgctctaagaacatgcttcaagtccaggctggtatggtatagtattactgtagtagtaaatgattgaaatgcccgctaggcagaagttttatcatttaatgataatgcacagtaggcagaagtttagtgcctaatgttctgtcttatttatttcaggaattgttggataaatatttaatagccaatgcaactaatccagagagtaaggtcttctatctgaaaatgaagggtgattacttccggtaccttgctgaagttgcgtgtggtgatgatcgaaaacgtaagtttatttgttatatgggcaaaagtagaatataaaaaaaagaaatggggataaatgggacactatgacagtatacgtagtcttcaggctctttgtgacttaataattgaatgtatgtcaagaaaattagtattaccttatgttctcaaaaatgaaaattggattataaatttacatcacatgctctt

SEQ ID NO: 92654 - DNA, 1734 bp, Homo sapiens
tgataagaataacgtacagaagaaatcagtgggggaacatctaactatactcccgtctggtgactttttttttttttttttttttgagatggaattttgctcttgttgcccaggctggagtgcaatatctcagctcactggaacttctgcctcctgggttcaagcagttctcctgtgtcagcctcccaaatagctgggattacaggcatgtgtcaccatacccggctaattttgtatttttagtagaaatggggtttcaccgtggtggtcaggctggtcttgaactcctgacctcaagtgatccacccatctcggcctcccaaagtgctgggataacaggcatgagtcacggcacctggccctcgctcctgacttctgggaaagactttcagggagttatgtgtcagtttggggtttttggtctctgatccgtgttttttacaataattttaaaatattatacatttataggctatattctatctggcattaataatatttggtattgataatacagatacagacttgattatttgggaaagacatgaagcagactccattatgtcttttagttgagctaaagtatacatctttactactgatagtatatggaaagacggaactattctgtacctgttgtttccttcacagagagctagtggcatctgacaaagaaccatgatacctggctgaaactccaggatggaagtaatgcccaagtcactttgtaaaagcccaacactgtaaatcatacgtaatggttatatgcaaactagtagtcaaagttaataattttagaaagaagaggttagctcataagtggctgtgttgtaatgaatgcagtagctgtttggcagctttctgaatccttggaaggccctttgtccacagtccttgagaacacccacacatctagcatgagtgactcaggagagactagtgctagaatggaaatttctctcttccctactcctcaccctaagccattgttctagtcagacttttctcagcccctgctcttacaaatctaccacagttaacagagcactaggtcttaaaggtactgagtagctttttttgtgaccataaataatatcttcaccagagctggcatctttttggagatcctgtggaatttcattgtaactgactgactcacttggaggaacaagaaaagtgagaggcatcttactttacattagagttccttggtgtgggtacaggcagaggtggtatttctctcggtataaatactatgtttgccttctttgatactacttctcagaatccactcatttaaagataccaatgactgagtcagtttgagatctagaactttttttgtgactatctcactattgcctcctaccctcctccttccaccacaaccctaaattcagttcataaaaatagtttttaaattgaaagtcatccataatacatgaaaatggtaatagaggaaaaagttaaagtaatataattttttaagattcgagtgtctcagtttattaaaaaactattaaaattatattggtgatgttgagcacaataaattctgaaaaactgatttgtctgttgtttttacagttaagagtgtagtgatactggagcagcacttgtcacagttgcctttaatttgggtgtggccctaatgacctcttttgccacactcctggctcagcaactttccaacttgagccacaattttgatactcatgacttctataatgcata

SEQ ID NO: 92655 - DNA, 1229 bp, Homo sapiens
atagagctaacgatagtataaaagttccacaaattacaatctaatttctaaaactcatatattctgacacataacacagagttactctgtcccttttttgttttactgattaaatctctaagctgggcaccgtggctcaggcctgtaatcctagcactttgggagactgaagagggcggatcccttgaggtcaggagttcgagaccagccatggtgaaaccctatcccagttacttggggaggctgaggccaaagaatcgcttgaaccgggaggcgaaggatgcaggtgagctgagattgagccactgcgcttcagtctgggttggcagagtgagactcggtctcaagggggaaaaaaaaaatctctagcttagatttggctttatctttcttagaaatgctccattttagggtctattaatatgctggttaactgataatatagaaataatgactgatatgtgtatcctaaagttagagattcagcatgttaatagtgtgtttgctaatgaacctcagtaaactattaggaaaatgaaacttcttagaacatttttttgcttcctgttattttgcgtgtattttaaggcttttcataacagttacctactctttcttcaatagagtagcttatttactctgtaaaatggaaatcgcttataaatgaatttagaattaaaagattaatttgttgagtgttacagaattttgccactgaaaccaaataaattattttgaaaaagtggttgaagtgacggtaggattgttttatacaatagttaactcttgaagatcgtatgggggttttgttgttcttctggaagcctttttttcctaagatatgggggtgggggaaaggaggaatagttactgttctaaatttgcattaatattatttctcaacagtttcatttcttatattattctttatagcttttgtgttatagtctattgttcccatcctatttttctaagattaaacttattctgagttcctttagcatttcctaaagcaacctctataataacttacattctttcctttcactttccttgtttctttggtctagagtgttccaaattactagttcatcttttattgtgggtagtacattgacctcttagttttcaaattctcaaaaaggaacacactaccatccacattttaccctcagtcaagtaacactgtcagcaccagagggaccttcagtcttagcccaccaaaactc

SEQ ID NO: 92656 - DNA, 1028 bp, Homo sapiens
gtgatcaagctcatgcgactggtgcataaaaccaggaaagttagcttattcatttacagtgagccataactagcacaaagattgcagtactgtgttgacatgactagtatgttctctttcaggaggcagatagactcacgtaggaatcaagacataatcattaaattgtttagtaagtgtggtatgacagagaagagttggatgctgctcaaatgttgaatgaccatcgtctccacagtagggggtagatttgttagtgcactgattgtggttcacacttttttagactgtacattggatccttcagtgtccttatgtatcaaacccggacaagaaaatatcttttctttcagtggctctaaagagaagggaaatatatgttctcaaagtatactatgcttacttgtctgagaaaagtttccaaatcagtcttgacttcctggagaaaactacttccaggggcttgggtgactaaatatagaaggcagggagaatgagtccaaagaaagagtagggtgactcctaggtttctgcctagggctactgagtacttttcctaagacagaaaatcgagtaggggagcagaatcaatagtagatcgtgtcaggaaggtaaatttaatttttaaaaaatgagtaggcagggtgcggtggctcatgcctgtaaccccagcactttccgaggccgaggcagacggatcacctcaggttgggagttcgagaccagcctgaccaacatggagaaaccccgtctctattaaagatacaaaattagccgggcatggtggcgcatgcctgtaatcccagctacttggaaagctgaggcaggagaatcgtttgaacccaggaggtggaggttgcagtgagccgagattgcgccgttgcactccagcctgggcaagaagaatgaaactctgtctcaaaaaaaagagtaaagtttaaagttccagtggtccatccagatgttaatatatgtcggaggcacttggtatggtatgtaagagaaagatttgtgtcatgctgtatgac

SEQ ID NO: 92657 - DNA, 2013 bp, Homo sapiens
gtttttttggggtgaacgttgagggaagaggctggcggaggtgtcagtattaaaggaatatccggggtagggcttgttcggggaacagtgtgtcggtgtggctggagcagagttcatgtgcagagttgctgcaggagacaagcctggaaaggaaggcagccatcatcatttatagaagattggagtaaggggggtttcttcatttggttcatgggaaactggtttttttaaagttttatttatttattgtagagatgggatcttgttacacccaggctggtcttgaacttctggcctcaagcagtcctcatgacttggcctcccagagtcctgggattacagatgtcagcaccactgtacatgtagcagcatctagaattcgtggtttgagggctgactaaccagtctgtgatctgaactgacagataaggaagttataagacaagtgataattgatgagttagtaatttaataaggagtctaggaaagtagagtaacacctaaagtttttgaacatgcgtgctaacatagggttttctttttttcctttggtgaacaggaagaaagatttggtgtggaggaggtgagactaacttggtaattatagaagactagttaaagtaacatgaaggatagctaaatttttggtagaaaagagcagatattctcagcctcctccctttcatagagtaggttggggcagaattacttaaaccatgtattcaaaataactgtgtgaacaactctcaacccttttgataatcacggtattgaaagaggttactgaaccgtggaagcacaaaaaaatgttaaaatccaagagtaaagaactataagtgaaccaaactctctaagatgaggggagttaagatttcatccagttagagctgtctctcagtgtcattgtaaaaccgaagactttgggcttaactttctaagtctcttcgagttctcatggtttggggctgtagagtaatgcaggtcctagccattctgctctgctctgacatccttccacctcttaaatgagtagtttttaaagtccagattgaagaatacatgacaggttgaaaactggtgactttagggaaatggcttcagaaagaagtgaggcagaagtcattggtgatcttactgagtgttggcaagagcaaaatttagacacaaaaaaactgggctttggctggatgtggtggctcatgcctgtaatcccagcacattgggaggccaaggctggtggatcacctgaggtcaggagttggagactagcctggccaacatggtgaaaccccgtctctactaaaaatacaaaaaaattagccaggcgtggtggcacatgcctgtagttccagctactcgggaggccgaggcaggagaatcacctgaatctgggaggcgaaggttgcagtgagccgagatgtgccactgcactccagcctgggccacagagcgagactctgaaaacaaaaacaaaaccctgggcttaaatattacaggtaagatgtttaggagtcattaagaagaacttggatgtgagggaagggcaaatggaaaaagttagaggggttcacaaagctcttctgggacttgggaacaaaatctgtcatttacaaagtcagtgaccttggaataagaaccaggcagtttgagtgtatacaagataatttctatcttagacatcatattatcctctcctgtacatcagttctagtagaatttcagtaaattacttcagcataatgcataaacaatttcagaaactaaagtgcatatcgcaatttttaaaaatgagagttaaaatagtatgtagggaatctctggaagttgtctgtcttagtgtaaaagctttgtaaccttaattgagtagtatgcttgaatttagttgtgtttaaatttaatctcaataaaaaatgtcttacgctgctcattattttttagtaagactgatatgtttttcttcatagttaatgaatctgaatgtgattttattgacacagtggaaaaagtatgggc

SEQ ID NO: 92658 - DNA, 3374 bp, Homo sapiens
gaggtcgtgcgcgcctctgggtctcgtgccgcacccagaagtgccggggtggcggggaggctgaggggagttggtaacggcatcgccatggcaacagtgacgtccttttaccctggatctaattggaggaaaccccgtggccgaagccgcagcctgccggccaaccgaacttccccgtaccgacccaccctcctagcctccgcgttccctcccgctccgcccccctcgcccccttccgcgcgctcggtcctcattggccagcggcgcgctgggggcgggactctcgggagaagctcggcgcatcattgggcggtggaccgcccctcggccccggggtaggctgacacgggagggtcctcagctaaagccaaaagcagatcaaagtggtgggactcgcgtcgcggccgcggagacgtgaaggtgagcgcctgggtcggcccgcgggcttcctccggccgcgctcggattgagggccgggcggaggtgccgcccttgagagcagccggttgtcgatgccgctcccctcagggacggctccgggcgggaaggtgcggggccaacggtcgcttccatcttgggccggccgggcgggggtggcgggagcggccgcggctcgggctccctgcgcgcggggcctccgcgccgcccccgcctcctccagccgcgggccgcggcctccccgggtgcccagcgggggagggggcgggggagagggaaattcaagcggccgcgtgtgcgggagacaaaagcgggcggcgggccgcattgtctgacggcgctccctctctgctttttgttctcgcctcgccgccccgcccctccgcagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggtgagtcctcggcgcggggagcaggggaggccttttgtgagatgcttttcattgagagtttcgcgggcacggaaacaaacgtgagccggggcttgccggactgtctgctggggtggagggttttaggtgagccctgacttccctactgtgtccctccggttgttgagactcaagaagccgcttttccaaggataagtccttttttttcgccccagatgctgggtagctaccaaacgatggaacttggaaacatccaagtaggtctctgcgagactgaaaggcgtttttaagtttcttgtgcggggagactgcgtcctgagatctgtgagccctttaaatgtattcagtcggttcacaagcttcaggcagttgaaagaaggcgcaggcacctttttgttacagacaatgtagtagggattttttcccaaacccagtaatggaaatttacttagaaaatctgaacagatactttatttttcaagtaagagtatctgttgtgctcccccccaccccccataaacaggagaggaggggagttcgggaaatgtgaaaaggacacagctgtatctgaagaacacaatgtcctggtaaatttcaacatttaataacatttccttgctgttgcacacctgtgcttaaacactagtgttgaagtgaattcgtttccagtgtggagcagacaaggaaagctttccaggttttgaactgtccagtcttagcaaggacgattgttgggtggagtaggtggctgctgtgattcacccttattagtgagagagaacatttttagctttgtcattccatggatcttttgatccgtaggataagtttttaaaactgaaataccagcattatatccaggagtgtttttaaatgtttcagtgctgccaagagtcatttctatgaataaaatgggaaataatctcatatggtttgccttttaagtgtcacttttacaagaggcctacttatttttgatgtgtttgtgcacatcatattttaggtgggctttgatagacaagcatactagactggggatttttcaaaagggaatggaagaaataatttctccctggcctcctcccccacccccaccccccaagccgcctttcttcatctcatcagaatggtggggcagggaatatgttccccaccccttgtttaaaaaaaaaaaatccacgaaacttttttaacctatctatttttctaatacgatgacaggcgatccggacaaaatcatggctgatggaaataactggtaaagaggcaaagaaagtaatgcagacagtgtgtactaaagtggagaaaacttaagattatttactttatgaagtcaaaacttcgttgtattcttccgtgtgctcttagcttccagtccctgcttggcattgaagaagcacttgtaaaagctttttggactgaattgctcgtattaaaaaattttgccaacttgaaagtagtggtagacttcaacttgagtaacatatggtaatggctgttaacagcattatctgttaccaagggaagactcataagaattccatatgttaaggttttctatgtatgtattttggatactcttacagcatatttcatttctgttcagtttattgcttttcaattagttaccttgaagcaattcagaatcaccgcgtgatttttcttgttctcgagcaaggtgactctgagccaaaggaatattcgttttattttgtggctcttataaattctgctttttatgatggcgtaagtcggggaagagttttgcttagttgatacgtagcttgagagagagaccaggtgttattagaatagaactttcatacagaccatttcaatggggacaacccctgaatttaggacagtctcttttatatactgagaagacatagaatagtttagtttgatgaatccgagacaccaaggcataaatgaaatattcataaaatggcttaagaggctaactggggcttggtggccaacctataaaaaatatcttgggaaagcacttcttcaagttggcaactgtattgagagctttctgtgtgccaggcactgtgctctgagcaatatggggaggaacaaaacagaaccgtggattttgccctctgatgatttataatttagagagcatgtgagagatacacaaacataaataccacaatattccca

SEQ ID NO: 92659 - DNA, 1328 bp, Homo sapiens
atgatactcgataattagatcaatgctaacaacaagtcaaactccaaagagttggggatcagagaattaggcctgtatatacaggagcagtacggtcttatagtagaggcttaaaaaatgtttactgatgatggttggctaacttctgtaaatgctaggctgatgaaatgaataattgtaactcaccattagctagcgtatacccagactagggatcatgtctggtctgttttgctcaccattgaatccccagcacctagtaaaaagcctggtacacacatagttgataccccttatgctgccgagtgaataaatcgaaacttgaaaccattacaaatctagttcctctgtggtatgcgcttttagtgtcctggaggagttccaaattgtatttgcattttttaaaagtcttctctatacttgtttgtcatcttctcacagtattttcaaggagctttgtttactcatctttggttccagtttacccctactacctccttttctttttttttcctgtcacactgcatatttcaataaattttctccagtagtttaattcggtttcataccgcgcctctccttgtttgcggataatctctctgacatattttttattgtctatgattttttattaataaagttgccaggaacccattaaatagaactgcaaggtttaggtacgatgtattgaatgtggcttgatgggaacaccttttctgtcctcttctcccataggaagagtttaaagaacgctgtactcagtgtgctgctgtctcatggggtcttactgatgaaggcaaatattattgcacttcttgccacaatgttacagaggtaagtaacaaatatcatttatgaatttgcttatgttttaaaaattgccatttcagcctgatatgtagtctaagtcccaaagaattgggttgatttttgtcactcatgcaatgccaacattccaaggatgcatgtggtcttaggtacttacacataggttaagggatttgtgaattagattgaggatgagtttttgaaattatgttgggccacatttataaatgatttcttattcagagtatgtggttgagggaaataattaaaattgtacttagaagatgatgcatttctttttatcagttagtacttatttacatttttttaaatgtgtcatggtggcttagaggtttggaagatggaatgttagaaaacttgaggactgggccgggcgcagtggcttacgcctgtaatcccagcactttgggaggctaaggcaggtggatcacctgaggtcgggagtttgagaccagtctgtccaacaatgggaaactccg

SEQ ID NO: 92660 - DNA, 1037 bp, Homo sapiens
cagaagaaaaggactcaactcggtgattttaatgtctttctctatctaaaattaagaaggattttttcagcatttctcatgtacctgacactatgatgatattataattctttttaaggaaaggcaggtaagaatacatttagatggaagacttaaccagccctccaggtgattctgatgcacacttaagcctgagaactactggttcaacatactaatccctagtgtgcattttgtggaactcaatgttctgatagatgctacatacagaccccagagattttgttctcaacttgtgaataccacataaaacatttactggaaatttatatgtaagttaatatttaaagtacaagagagctgtggtgtagatgtgcctgtacatttgttgtcataacctgaatcacccaccactcatttcccttccaccttagaacgatgttttacataatttttggaagcgctaccttcagaagagcaagcaggcatattgtaagaacccagtttataccactggaaggaaacctacggtaagtcacaagtctgaaaagttggattaaaaaacatgtctgttgagatgtagagatgaagatgggttcatgaccagtttgagtatctgagattatgatgcttgtcagaggattttcagttaagaggcttctgttacagtctagaggacggggtcactgatttaaacgttggaataaagttttttcttcacttttttcctgcagtatggaattaattttgacatcttatcagactagttgaaacataaaggaatttgtggttgattttctagatagaagatagtttctatcactgtactattaaaataatttttaatttaataatgtatttattctgtttgcttggaatacctacttactttatgtggcatttcaagattcagctcagttatcatatcttctcagaagcctttatgtgaagaaaaataaaatctgggtattctcccatatccaccagctgtttttagcagtttctttgtaactgctttataaatgtgccatgtaaca

SEQ ID NO: 92661 - DNA, 2658 bp, Homo sapiens
gaaaaagaggtttaatggactcacagttccacatggctgggagtgcctcacaatcacggtagaaggtgaaggagaagcaaaggcacgtcttacatggcagcaggcaagatgagcgtgtgcaggggaactaccctttataaaactatcagatctcgtgagatgtattcactctcatgagaacagcatggaaaaaacccgcccccatgattcaattactttccccaggtccctcccatgacacgtgggaattatgagaactacagttcaagatgagatttgggtgaggacacagccaaaccatgtcaatatttaaaatgcctgtttagattttttgctgtttttcttttgttatccaaatagttcactggatttttaaaaatctccatttatctcctaagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggttagctagacctcttgtatgataatatttttgctggttactacatgaactaagtagacaaacttcggatattttgatttttataagaaggcttaacttgaggaaggaactggaaaggttgagtagcctgaattctaattctgaaatgtaatcccccctgggctagtaattcatcttcttgattttcttatttatgtagtagaaattatagtacttaccacacatgggctattggaaaattaattatctaatataatcttttgaagagaaaagtgacatttaagtacctgagtaatattagtaaatatttttcatttctaagaaaagataaacaggtgatctttacattagcaaaatggttatttgtagttacacaaaagcatatattggtgttaagagctaaaatataggttgtctatgtttgtaaggaaaagttgaagacaaaactgttgaaaggatgtgttatccagatagtaagcgtttatatttttcaggataatctacagagtgttttggttaatgaataaattacagttttatgtgtaagaatttctcacttaatagacgtgccaaaattcttatgtgctgatttttttctccttgctttatatgtgttctgaatagtaacatttgggtttaatcaatatgtagggtgcttttaacagcacaaattaggaaccaaactgctgggtttgaatcctggctttgccacttatttattatatgaccttgagtaagtcatttaatttgtctctgcttttgtttcttcgttggtaaaatggggctaataataactacctcatagggttgtaactactttcaataattagcgctacatggaaagcacgtagagcagtgtctggcacataataagacctcagtgctagtcattactgtttttgttttcatcatcaccaccatcatcgtcattattggctcagcccctttgattaaatgtaatgcctccagtaaatgatgatagtgcctttgaatttggccacatcaaccaaataaaaacgctttcctcaggtctgattaactctacaagcagatagcccatgattcagtgaattttactattaatttaaaaacctgatcttgttttgtatgcccccattgggtgatctcatcttttcccaacgctttaattaccactatactgatgactctcaaatttatatctctagcccagacttgtctactgagggccagacccatagattcatatatacagctgtctgctggacacagctacttagatgtctttatggtatctcagaatcagcatgactagaggttcatcatctgtctccttgatccagctccttttccagtgttctctttcttagtaaatgccatccaccctgttgcatcctatccagaagcctaggaatcatccttgactctttcccctctacgtacactgttggtcaattgtccactcagttatatgtccaaaaactcacagaaccattcttctctgcattccctctctctctctgtcctctctaccctcatttggattgcttaacagtctcccagatgagctctgtgtctgtaatcttgtgtcatttctatccattttcctcctgataaccagaaggatcttacaaaaacataaacctaatcatgtcattagagctggataaaggggctagccatcctacccaggacgatctataaggggctaacagaactctcctagaaatctaacaaggtggagaaagtcgtatttacctggaattcttctcagggagaatattatatgtggttggaataataggggtaagatactacccacccctcttctctccctccctcttttctcctctctctctctttccctctcctcccccaccaaggggaattctaaaatgccttcaaggagattaaatctagttagctagggggcttttgttttgctctgtggaatacacaagtttgggaacagagcttagttgcttggggctataggagaagagactgtcaccattgatattcttcctttgcttttctcccagaaagagctctaagtcataagttctcaaaatgtggcctcctgacttacagcttcagtatcacttgggaactggttcgaaatgtgaa

SEQ ID NO: 92662 - DNA, 1090 bp, Homo sapiens
caaacttctggcctcaagcaagcctcctaccttggcctcctgccttggcctcccaaaatgttgggattatgtcatgagccaccatgcctggcccagaggattcttatggatggcaaagtttgagaaccactgccaaactttgaaaaaatatgtaaagaacacagttttaagggagtatgttattagcctggccaaagtacccacataccttaacactgtgcatgtcactccctttttaagtcctctagcagcatccatagtccttaggataaattcattaccctgcaaatagcctgtaagggaccctgcctacctagcaataatggcattaatgaataaaaatagccagcccttattcattctgtaaatttgtattgaatatctactatatgcaggtgttgttctggcatctagacccttgcgatgcagttgtgaatcatataggtcaagtccttgctctcacaaatttcaagaccagaggaggaaaaaacaaacacatacatatggttggtgcaaaggtcattgcagttaatggcaaaaaccacaattacttttgcactaacctgataaataagaaaaggatcagacagggaaaggctattcagaagattgaaataggatggtatgatagaaaatgactagatggctactctagattggttattcgggaaggcctcaccaagagggtggcatttactctgcaccttaaatgaaaatagagccagtgtgaatatcaggagtacaatagacctcacttaccacagaagatatgttccaagacattggatgcctgagaatgtagatagcacggaaccctatatacactatgttttttcctatgtgtacattcctatgataaagtttaatttataagttaggcatagtaagagattaacaacaatacctaataataaaatagaataattattacagtgtactggtactactactcttgagctttgaggctgttattaagtaaaatataaggggtacttgaatgcaagcactgcaacactctgacagtagatctgagaatgagccaatgaactacaagtaactcatggctgggtggcgctacagcttggctgtg

SEQ ID NO: 92663 - DNA, 1712 bp, Homo sapiens
gtccattgtatattttcagaccacaggtagctgaaaccatgcaacacaaaaaagaggatgagtggggactgctgtactggcattccgggtagaaggaggttgctagtgccaagccctaaagcaagagctgtgtgatgaaggagcagaggagagttcgtgtgactggagtcagagaattctagggcggagtaggaggatgagagtgaacagatcatcagaggcagatatctgtctttgtaaaccaagttaggaatttggatttttaaaaattgaggtataatttatatataataaaatgcaccctttaaaaatatacaattcagtggttttcaatatgttttcaaagtttgcaaagctgtgcagtctctattttcaggacatatcactctggaaggaaacctcatacccaggggaactgcgggtttccagtgtgagagtaagcccctggaagattgcagcaggagagatacgatctgattgatgtttttaaaagatcattcaggcagctgtggaaaatgagttctgggaagggtggaagcacggagaccaggtggtcttttgctatcctccaggcaagagatggtggcttggattatggcagtggtaatggtgactgggttcaggatctgtttttacaggtagacacgacttaattctaatgcagtggtttttttcagtgatctgagacaaaggatgagtttactaaatttctaacccatcatagattgaaactttggaaaattacataattataagtagagacagtgtttccaggggacatggctaaactctgttggtcaggagaggcatatgagatgcttttagtctacaccagtttttctgtcaacttcctggattgatctagagaactagctgataatacctaggaagggaaatagattgttcagaactttgagtaagcagctttttttttttttttttttttttttggaaaaacaaatacttttctaaaaggagattcaaagaactatttataaatggtgaaaaactgttagaactccagatgccgaagacctgctctttgcggacatttctgcttcccctagtcaggtctctcatttcttcctctgctcctacagaactgactgtgcctctgttgtgctgcttgagacagtgtctctactgactcatgtgcaggctgtttgtctgacctattagggtgggagtgtggaagacccttcatctcttacttatctctgcagactcctaacactccacatagtgctggcatgtattatcacataggagtgaagactacataaataatgagcacattaacatagtggaatactaggcagcttaaaaagtgacaggtatacattacatcttgtatataaaataatattaaaccaaaaatataatttcacaataatacaaatactgattactgcacataaatactatcatataaacgaaatatactaataaaaacttagctggggaacctttaacaccatttttatgtaaatatttctcaactttcagtagagtaaaaattaaaacacatttttaattgaaattaaatttgaggctgggcctggtggctcacttctgtaattccagcactgtgggaggctaaggcaggcagatcacttgaggtcaggagtttaagaacagcctggccaacatggtgaaaacctgtctctactaaaaatacaaaaattagccaggcatggtggtgggtgcctgta

SEQ ID NO: 92664 - DNA, 1062 bp, Homo sapiens
gtaaaaaagcagagagacttcttagagattttggtggaagatataagcatagaaaataatatgaaattacatcttggtagcaaccactgcactttgctttttttcacttacatcttggagagcacttaaaaaaattattttggaataattttagatttatagaaaagttgcaaaactaagagtagtacaaagaatgcccatatatcctgtatccagagttaactgttgttagcattttatgccattgtttgatcatttgtgccatttttcctatctgtctacctacctacttgtgtatctgtgtaattttatttctgcgtcattgattataagttatatccatcctgacccattactcctgagtactttaaaagactaaaacaaggtagctaggtaatgaaaaaataagccaaacaaaaccagaaacaatctaaatgtctatcaacaggaaaatggaaaaaatgtgatatagtcatataatggtacagtaaaccactatgaaaattcatgaactgcagctgcaagcaacgtgaatgaacctaagaaacattatatagagtgtgaaaggcaaagctcaggctagacgtggtggctcgccctgtagtctcagctactagggaggctgaagtgggaagattgcttgagccttgggaggtcgaggctgcagtgagctatgctcatgccactgcactccagcctggacgacagagcaagaccctgtctcaaataataatcataactttaaaaaaaaggcaaagctcagaaaactacatactatggtataatactgtctttttaaaaggcaagttaacaatgagcaaaattcagtaaactagttacctctggaggcagagacagagggatgggatagggaggaagtatactagtagatacaaccatattggcaatgttttagttcttaagttgggtagtggattcataggcatttattattaccaggcttcatagcttacagatatagtatatgtattcttttgcatttttcagaattttaaaggcagctaaaggatgttgtctaaatagaatttataaaagagagga

SEQ ID NO: 92665 - DNA, 1056 bp, Homo sapiens
cccagtgtcagaaattgattcagttaagtatagtgtgggctctaagaagatgtttttcgtaagcatcttgcaagtgattctgatggagattacgctttgagcagtgcattatataagccttatctctatgtctgtcttttgttattccaccttgttccacagaagatttgaggtagaattagcagataaccaaagggtcagtataaaacaaaatgctgttataccttattaagtatgtgttgttttaaacaggattctgtttaaaactgtttgggaactatatctattgagaaactggtctgtgagtttaacatatatgaaaacagtgaaaatcaaggctgaaaagatagaagtatccttcctctctctgtaagtcattgacagagtacagtgtatctaatggagaagattctggcaggcttcttattctgggaaatgtagacacatatcttggtgttacatttttaataattatagtttaataactccgtatttcccccaaaagtgtatttataagaggtttcgtgtaagataaaagtagatattagcaagtggtatagattttgaatgtctgtagatttcatatatgctgaattttttaaatttccagctttattacacttctaattatgacctctttaacatgtgttttttttttcctttagacagacattacttacattccttttttctttttttttttctcctgccaccttgtctgagaacttaggttccattttatactttttttggtggcaaaatatacataaaagttaccattttagccatttgtaagtgtgcagctcagtggtattaagtgtatttatatttttgtgcatccatcaccaccatccatctctagaattttttcatcttcccacgttgaaactcatacccattaaacaccaacttcccattccccacttgttccagcctctggtaaacaccattctactttctgtctctaggaatttgacttctttaggtatctcatacgtgtggaatcatacaacatttgactttttgtgtctggcgtctggcttacttcacttagca

SEQ ID NO: 92666 - DNA, 1008 bp, Homo sapiens
aaagtactttgcacaattccttgcatagaataggctctaaactaaattttattttattttattttatttgagacggagtctggctctgtcgcccaggctggagtgcagtggcgcagtctcggctcactgtaagctccgcctcctgggttcacgccattctcctgcctcagcctcccaagtagctgggactacaggcgcccgccaccatgcccggttaattttttgtatttttagtagagagggggtttcaccgtgttagccaggatggtctcaatctcctgacctcatgatccgcccggctcggcctcccaaagtgctgggattacaggtgtgggccaccgtaccctggccactctaaactaaattttttatgtgaatagatgagtaagtgaaaaactacatgcagtattaatattaggaatgtttataaattgcaaaaatacaaatggtatatgcaaaaaacttcgagttcttaaagtaagtgctagacagaatatattaatatttgttcatagcttttctgaactttgtaagagaatcttatatatttttatatgtgcgagtttagtataaagttgaattgtggatttttaactactagacttaaaacctggtgttactcccatgtggaaagcacgtgaatattatgtaacagtgagccgcatttgttagctatgaatttgaagagtaatgagagagtgcaggtgggaaaggtgagagggaggttgtgtatcagagcagtcatgacaacattataactctgattgggttgtagctttcatcctttctccagattcttctaaggcaagaagtagtgattttaccatatcatgggaaaacccagtaagagttttaagagccaaatagaattttagtggcttttaacatttagtatttatgacttaaaattgctgagttaaaatattaaggatttatgggggttttctcccttcatgcttttctccaaattccaaattttattcagtaagtgcatattagttttatctg

SEQ ID NO: 92667 - DNA, 2080 bp, Homo sapiens
caggaggctgtggtatcatgtctgttcttagaggaggtcactggtataaccaagttctctaagatgagtgagcttcagccaggcagagcctgagatgaggaatgggggaaagaaactggctttctaggcaaaggggcaaaagtagctgtgcaaagcagagaggcaagtgagaatatggcttgtttgggggaactatggagattaggctgggagctaaaagctttagtgagttcatgagagcaggggaatacgatgattgggccacaggagagtaagactagagaaagggagagcagttataagggtggcctaaggagcaacagtgacgggaagaaaggggatggattggaaagcagtcagcactgatccaagtgccttaggtatattcattaatttagtcttcacaacagctatgaagcaggtactattcttattcctattttagatagattgtttaaaaactgaggcacagaaaggttgtataacatgtccacggtcacagagctagtaagtgatggagcagggactctagtccaggcagtttggttccatagtctattctcaaccatggtactatatgccacattgagagaatggaattaacaggacatggtgactgaatgcatgtagaagattcagttcagttccatgcaagctcattatctcttataaaaaatggctgtcatacttgaaattgtgtggtcacagcttacatacttagattgggaagtacagaaattttttgtttagttttcaaagtctattcacttgaacataacctcaatttattctcattataacccattttacaagtgaagaaactgaggctaagtgactctgatccaagagtcacaaagctagtgattggaaagcttaaatataggtcctaggttttctggttccaagtcccacattattcagtcttgagtaataggtgtagtctatgctgaacatataatttctttaggaaagcaatatatctagttaaacagttgttgagggcttccagtgtgctagccaggatgccagccagtgcacatacattgctagagaagcttttggtctcataagggagttagttttaggtgagcaaacactgctatagaaacacagacaagagatgtggatgaaacaactggtatgtggctgccagatgccaggatgtgtcctagaaatagtagatgttttaggaagtcggaatagggaatgatacgccgttttaagattctaccattcatttttctatatggatgccatgttttgatgttttattcacaaaatgtgggtctctgagttcttgcatagtgtcgtgttttaagataaaggttattttatggatatatacattggggatggtctagttggcaaataatttacattttactgttttgttcttcagatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtaagtgtacgtcaattttatgacaagtaacattttatggtgctgatcttagttttttaagaaagctttaaatgtcatgaagacactttaaaaaaagagctaaagaaaaaatttgtactgtatttacctaattatatgttatctcaaaaaatggagactctcaattgttacagaacattgactagtagtcacaattatttcttacacagtactttgactcagctggttgtcagttgtttgatcatgttttatacctgttattctttaggtagcaatgttcctcattgctccactgatttcctagttttaaagtatcttcataaatctctatctatatccctttaggctcctggcaatatgtgttctcaaagattattttagaaagtaaaggaatcttaatatgtcacccctcccagatgccaacaaagagtgacagtatttatagtgtctcctcctctgtttcagtgattgcttctccattaaaacatggtatcaatttcaaa

SEQ ID NO: 92668 - DNA, 1095 bp, Homo sapiens
cttcgccagagaataatggagaataatccctgtatggagtgaaagagtgaggagtgagtttttatactttactgcattcagttctgttgtctctctaatgtctacatcttgatcacacactcacaccaactgcccagtgcagtcaattaatgaaaactcagatgaacaatgtatattattatagtgtggtttatttggttaataatcttggattttatttctttcagataagccatggtttgatttcagaaagtggtaccaaattatgaagaaagcttttgatgagaaaaaacaaaaatgggaagaagcaagggccaagtatgttctccttcctggtttagatgcacctgccttacttctgtgtctgttactttacatttgaaagctgaagcttcatcagtatacacttatctacattgtgacttttttttctggaaatattagccctacactctaattaacttttctcttttttacattactattaatcaaagtttagatttgatgtggatttcaccagtgtttttattaatgtcctctttctgttccatgatccaatgcaggataccacagtatactttttataatttaactttttataatttgcatgagacttgcctatatttctaatactcctccctcttcccctttctcaaatttagtcatttctcatctatgcttcccaatattaaaaagattacaaatgttaccttgcaacatatgtaattggaatgttcccccaaaataaagatccctgtgaaaattaaaacaaaggaaagcagatagcaagtccatttgattcagccagtgtcactgcctttctttgaactgtcattctgatgtgggctcattgtggtagggtagaagagagcataagcagcgctaggtttgaatcctgtctgcattacaagctagctgtgtgcccatgggccagttacttaaccttttgctgagtctgagtctctttgaggctttgaagaaaaaggtaacatctctgtatttaatgtaaatttacagtaatactaattcgactcagtaattttatatcctttgagaaaaatcaaggttccccatattagttgaaatgagaatttg

SEQ ID NO: 92669 - DNA, 1031 bp, Homo sapiens
ttagtcctgacggatcctaaggactgggtgcctaggggccattcctccctggggtctcagtggtgacagggctttccttaccccaagccagacaccaacctacactttaaacatagctcttggaggcccagttcattattgcagtgttatgtcagttgcacatttaagacttaccggcttttagctactttagggaataatttattggccaaagaaagtaagtctggttataaaatggcactttccagggaggtaccgggccccaaggtggaggctgtcgaggggacccgtttccaaggtccttcttcctagagtatgtgctgagggctgacacacacgtgcagtgtgagtcactgctgagtaatatgcgaagcactaccaactgctgctcaggcccagagctcagtgcgtggtggccacctgtcggtttcacccttccccacccccatgttgacatacatgtctaatttttctctttgtttctctgaatattatcatccatgttgtcagatgaaaattattaaaacattttctatatctgagcatgggttcctatgcatgagattatgaaaaacactaataaacaatagttgaaaacctaaaacagcgtaagaggctactttgatgacttctagctgttatagaagatgttgagaagaacatggagaaaaattaagcctgtgcagaaaatctctatgccctaattggtgtatagtgatatctcattatggttttaatttgagttcactgctaatttttgccttcccttttgggttaggcagaaatttcttagatgtgacaccaaaagcatgatctataaaagaaaaaaaattggtaaattggacttcatcagaagtaagaacctctgctccacaaaagaacttaaacgaataagaagctacagacgaggagaaattaaatgcaaatcacatatccgtttaaagatttgtatctagagtatataaagaatttttaggcaataagaaaaaaactccatttttttaaatgggcaaaatatttgaaaagacgtt

SEQ ID NO: 92670 - DNA, 1052 bp, Homo sapiens
cctcaggtgatcctcccacctcagcctcccaaagtgctgggattacaggcatgagccactgcgcccgactcctttctgttcttaacatttaatatcattgcagaaattcaaaataaaaagtcaacatctgttttatgtatagtcatgattttactgacttgatcaagtattttttaaaattcttgaaaaaatcagttcttaaatcggttaaaatgattatttgctaaatgatattactaaaatattgttaaaaatgtgtgcttttatatacgtattacttcctagtattaaaaataaatggtgagaaattattatagatgctacagatttttaaaatatttgtatttctggcttcctatttttaatctgtttttctggaaagttcacagatatttcttgagtatctactagccaggcactttgtcaagtactaataataattctaattattgtataggatttaaagaaccaatacatacagcatcttattcttcagaataaccctgtgaaagtagaggataagtttagagatgctaaattcatttctttgttcatttattcacccaattattcttcaacaaatgtttaaatgagttcctactctctaccactccctgacaacactaggggcataaggatggctgagacagtctctgcctttaagaacctccataatttgtcattcaaggtcatgccactagaaaatggtggagccggccgggcgcggtggctcacgcctgtaatcccagcactttgggaggccgaggcgggcggatcacgaggtcaggagattgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccaccactgcactccagcctgggcgacagagcgagactccgtctcaaaaaaaaaaaaagaaaatggtggagccaggtcttctgattcagtactctttcttg

SEQ ID NO: 92671 - DNA, 1005 bp, Homo sapiens
aggcggagcttgcagtgagccgagattgcgccactgcactgcagcctgggtgacagtgcaagactctgtctcaaaaaaaaaaaaaagaaaagaaaaattagttttctgaaggccaagccaaaaaacatcataggatactcgacctcacttatactcaagaaatacaaattgaaatgaatactgtttcccacatactggattggcaaagattataaagatgtgtaaaacctggtatggacattggaaaatcaggcattcttgttctgagttcatttatgcatgcaacagatagcaactcctgtgttcaggcatgttctaagcactggggatacagcactgaacaagacccccacctttaaagatcataggttccaactaggtgaaagctgatagtaaaaatatatattatttttgagggaattaagtacaatgaagaaaaagcaagaaaagataaatgataaggtaggccattttttaaagggcggctgagggaggatcctctggggcagtggcattagagcagagaccaacttgcctggaacacagtagcacgagcagccatgcagccatccagggggagatcagcccaggcagaggaaagatgtgcagaggttctgagcaggggcatgctggatgcagtcaaggactggcagggtgtccagagtggctggagcactgtggataaaggggagagggagagcagatgggcaggtgggatggtagaggttgctctgaggtcacggtaaggatgaccttaccacggttggcttttttctcaaatgtcacaggaagccactggaaatttttaaacaaaagaatgatgtgatccaacgtatatcataaaagtatcactgactactctgatgagtacaccgtagtggggatgtgagcagtggttagagagttcattttgaattgaatgtattttgttactctctacctgtttcacttattgtaaggttttcttttttcttttctttttttttttttttttttttttttttt

SEQ ID NO: 92672 - DNA, 1850 bp, Homo sapiens
tctgagcccttagtatttcgaatgaaattttacttaataggtttggattttatttgaccgataaccagaaagcctttttccctttatctagtaatgggtagttttgatgttttctgtttattctgtcaagtgttattgcacaggacccaacagcccaatgccattaggaaaataaaaattgtcaaagaactacatcagcatcgcgtttgaaagcagttttcttttcttaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggtaaggaaacaaaaacatcttcctaagacgcctgcgtgtttgtataagtattgggttccaccttttccttgttatgtaagcatgaaactcagcctgaaatgaatggattaggaataaaagattttttttttaagagaaaaggcccatgggtataatttgtaaactaaacctatacaaccagaagttattatcaaggatgcaaggctaatcttaccagcagctgagttaacaattatgatttcagctaagggatttgctggagaaagagaaccccatacataatcttctgttgaccacaggtagattctcctagtctgttttcagcacttctcccagtgccaaacaagctccctggagctcatataaaatgagttattatatctttgcttggtgtttcttggttggtaatgtagtcagggagagcacaaatgcattgtgtgaggtttacaaattaattccaaatagttctgggggttttatggtgatgaatacctcactcagctaaaagttagggactaaaggtgttagaaaccatacttagtgacttggtggggtaaagagcatccatctctgcgtatggagttaggggcagaatgttagcctttcctgagaaaatgcaccacatctcttcagctgtggtgtgaacttgatgctgtgtcttaacttggtataatgatagggtgacttttaaaagtcatgaaattttggttgcaggtcctagtgtttgaacagagttgggatgtgtgtgaaagacagaaaagggggtcgtgagtcagaagcacttagtgggagtacctacacagcttgttgtaatttacttgagtggcatataaaagtggatattttctctgttttaattttttaagtatttgtagaatcaaaatttttactcaaaaataaatatggaaaggatagtgggttgctgtaagccacatacttttatgcggtaccagagcttggtctttagtaagcatgataaccagttaaatagttgtggcttatcacattgatatttcaggttttcttcccctcggatctcagtctgcggatgcctggcatgaattcagaggactatgtttttgacagtgtttctgggtaatagatgtcttttaatttgatttttaatttgcagcttttataacttattcctttcttgttaacttgataaatcaaaggtggctttagcaggctttccccttatcttactacttttactgtggtacagtc

SEQ ID NO: 92673 - DNA, 1044 bp, Homo sapiens
acgtggtggctttccacaggacactagggccagaagccatgtagctggctaacctgagaatgtccccactgttcagtctgcaattgctttaaggggtaatatcttctttaaaagattctgattattatttggagatgatggaggtagagaaaaaaacaagtaaaagaaagatattgctgctgtgcagttgcctaacagtcttccctagtcacgtgctaaaccgtgtaactaacctctctgtgggctgtagtggcaaacctgtgcaaatctgtatttactgaagtagcgttacacagacctctgttcttgccatgtatgtaattttcatgtaaaaccattgtctgtatcacagatggctgtttaatattagtgttactttttttctttaccttttgtaatgctcttgtttccttttcaggagaatgagaactcagttctaatcttggttctacagagtagttttgtgaccttgggactgttatttaaactttttagacttaaatttcctaattgtgacataatgagattgaattaaatatgtctaagcttgcctctattacaaaaactctgtgattctttttcttcgtattttgaacttcttctaatcgaacaaaatgttaatttaaattgtccagaggtgataatgctaaaaactagatcttattttgaactgctgggatcccatgttgaaactaagactcatgagttttcattttctcttccaccgcttcctgtagctgactataaagaaagcttcaacactatcagtaacatcgaggagattgcgtataacgccatttccttcacatgggacatcaacgatgaagcaaaggtgggtggtgaggtctgggcgccttatgtccagccatttgagaaatgggaggagtttaatgatttgacaactgatttttttttttttcacagttttatgtgtttcattctcaggtgttatgaaactatcctcttccctttttattctcccctcctccaaaacagatcatttttgttgccatcctttgcacagagtccagtgtgtgaaacatt

SEQ ID NO: 92674 - DNA, 1034 bp, Homo sapiens
tcaggtggctgcatagtccggagtttgttgcttggctaagcaataaatagagaaactttccattttatataattgttgttacagttgttttgaaattaaatatcataataggactcagtccactggctactacgaacagcctatgaaaagtattggccttgtgccccaggatgcttttattcttaaagcaaactggagtgttacttgctgtttgccattggggcctcactgagaaattgtggaggaggcgataaagagcccataagtcctgagttcccttttccaacttatccatgaccttgggttagtccctcagttcactagctcagtcctttccccttgatcccccaggagagtcacgaggttagagtggccagctcttcttcgttgggtgtggtcaggattaataagcgcttgtcataggcttggagatcttggccgaaaggcccagcgcatgggcagggcgctttgtttgtttgatgtgtcactctttggggtgggagtaatgaaagccaagatgacgggtagggataatggcttgttttattctgaaggcctgcagcatatttgtattagaaatattgttggaggagtggcttaagtagccttaatagcattgctaattgatgtaggtaaactcagtttcatttcccctttcagacccccagcactgacgtgattttaagcctttgcctgccgccagaagggtgttgtgccatttcttaatgaggctgctgtctttttgaagctgatatcaggcagcaacttcaagcatgtgttctaattaagtatcgaggttttttgctttccctggccaacttgatgttttctgtttttattcttaaagtaattaatgcctcagggcagcaagagtgaacaagtgtacatgcagaatcctgtatagttggtttttttttttactgttttctgaaaatatctactttctttgcccactttcttgttctcatttaggatgcatttgttgatttctttttttaattgtaagatttatacttggcacataataattgtac

SEQ ID NO: 92675 - DNA, 1746 bp, Homo sapiens
atggggaaggagaggtgcggattcttctctacagccacagggaggcaagaagaaaaagtgcagggcccagagggatctctgcatgacctgttttccctggtgtggctctttttttatctggagaagagaggcttacttttgcccagtgcagagccaggggctgagctggattcaatgcagggagagtctggaaggtgcgtcgagtcttgaggggaaagtttgtgctggctcgaaactggggagcaaccgtggatgagtggacattccattgaactaagacagcaagatcttgagtttttcctactcaaaaatattggacctatttttggcaggggacgggggcagttcttttcatcctattaagggagcttgtcttttattgagatttttagaggggctaggtaactggaagtatgtttgctgtcagaggcctggtctgtcaccctggcttttgcatcaggtacacaaagcacagtggctgagcacagtgaatgagcctgaggccttttttggattttttggatgatgtttactctttgtgtggcattttggtgattttcaccttcctgggtgctcgacatttttgtattattgtgaatctccttgaattttgtcctgaaatctggttaagttgctcggaaaccatctgctcgttaagatcttatgtctatgatttgctaggcggatctggagctgtgctcagtgtaaggctaatcatcccgcgctcctgagcaggatttttctgaatattctaccaagtgccctgctcattacaagttttctcacattacttccttgtaataatcctcatgacagggatttccagtccatcccatatggtgggaacaggtactgtttctggctctgtgtgagtttcgggcactgtttctctaatcttttcggatgtcagttcccaaccctgacccccagccttgggcagcttcctggtacctgtgtacctgttggtacccggccacgtactggagtggggctcactgaagatctcggagctctttcctctttggtactttgtcctgctgccttggtctctgtggacttccagctctgtctcctcaaacctgggcacctggactgagaatacatgagaattcccatgccatggcctgggaactctgaaggcagcagccagcatggtttgaggacttgccgcgggttcctgtctcccagggatcactgttctttagttgcctgctggtcagggccttctcgttcttgtttctgcatttcgtctggtttttgttgttgtttcagggtggagggtaaatctgatctgtgttactccatgttatgtagaaacagaaataccttattctttatagatacacagataaataaggagggacagtcctattttgtaataggactgcaccctccaccttttggaggagggtggtgtttatcatcagaatgaagttatggttagacttgttagaagggacagagagacccagaccaacttcatacaataatggctaggagattggggatatttacctgtttttctgtgtcagggagggactgttgtgtcaatgttacatagcaatttttataagcaggttgtatatttactatgttagtatgctaccaccttctagaaaaggcagaaggtggttttatattctgtttttaaaatgtggtccttattatataataatgctaataagatcagtgggatttttattgcctctttttgctctcagcaaatttatttaacagaaaaataag

SEQ ID NO: 92676 - DNA, 1051 bp, Homo sapiens
ttattattattattattgtagagatcctggtctcaggcaatcctcccgcctcagcctccctctttctgttatctgccctcagaaaggtgcatcctgatggagagagccaagatttccatgggaagttcattcctcagcatccctcttccctcatcttccatccattcccagggcttaaaccgtcatactggggacattcatgccccacacgttacccatcgtgcctctctttgaaggcgaggcctgcactgcccctttgattcttagtgtttcaggcttgagtcctgccggcactttcactagacggctgctgtgtgttaggaactgaggtggcagagtctcggaggctcagcccctgctcctgaagtggccattctgctccaaatccagcactccctcccttcactttcagttatctacctcttctcttgcttgccgtgacaccacctgctggaccctccatgccaggtgcccctggtagccaggcgttcgttcgatctgagtttttctctcctcagactctccttggtctgttctcaccttttggcttccatgataccaccatattttaaacctgtggaatcctgtgctcggattataccagcctccttcccctggtttttctgcttgaaggtcctggggtcccctccagtcttgaccacacactttgggtaccaacacactttgggtaccacactcagtctcacagacctttcaactattccctcttctctgccatgtaaaatttaattccttagagctgaatgatcaggacattcacggtagagtcggcttcccgaaatttctagatatggcttcctgtgggccattctgtttgagccaggctggccctgcattttcctgctcacacttcctcagtgttttgaaacatcatctcctttgtcactgcctgtacaaggttatctcagatcctgcctcctccatagagtgtttcctgaaaagaagcaccagacagccaggcgtggtggatcatgcctataattccagcactttgggaggccaaggtaggaagatcgcttgagcccaggaa

SEQ ID NO: 92677 - DNA, 1007 bp, Homo sapiens
ggagccgggcggggcggcggccgcgacgggcgcgcccgggtcggcgggggcgaggagggggcgtgttccccgcgcagctttgtcttgcgcttcctgggcggccccgccccgctggccccgcggctatttccagccatgacgtcaccccggtcctgtgagccggacggccgttgggcgggggagcggctggcgggaacgcggcacgcggccttgggggcggggcaagagctgctggcgggaacgcggcacggttttgggggcggggcacgcggccgtcgggcgggttaagagcggctagcggtagtgccgctcgggcctgggggcgggcaaggtctaggggccggggcaacgacgggaggcgggagcgccgcactgccttggaggcggggcaacgcttggaggcgggaacgcggcacgcgagcgttgggggccctaagcgtcgcgacctgggggcttcggggaggtagccgtggacgtgggcagagcgcgggcctcgtggtgtgcgggcactgtgggccgggcgagccccttcccgcccgtgtggtgagtcggcctcggcgcccggttctgtgacatcacagggggtttagtggcgcagcctgcgggacagaggccggggatttgaggtggcctcgtcttgtttgatctcggggaacctcggcagacggaaagctttgatgctttggtgcatggcagatagagaggaaacgtgtatcttcgtacatttaaagtttcctttccttttttttttttttgatagggagtctcgctctatcgcccaggccggagtgcagtgggcgcgcgatctcggcccactgtaacctccctgggagggaggggtattactcttctcagagtaatatcaccctctcgcccccggcttagttttcttttggaagagatcagctcattccagcctcttccctcctcccctccagattaaagagacggtgagggtctggtgcggtggctcacgtctgtaatcccagcactctgggagaccgagg

SEQ ID NO: 92678 - DNA, 1037 bp, Homo sapiens
tcagagttccctgcactgggctcttgtgtaggtttgggagaggtaaacacgttgggaataagctgagaaagcagagtgcctcatgcagccttgaaacccactgggatgttgaaaacagggttaactgagtgtctagatgattctgtgtaaaggtattgggagcattgtgatgaattaaatcccttttaaaatttaaagcaaccttttaacatggtacttttttttttagtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccag

SEQ ID NO: 92679 - DNA, 1899 bp, Homo sapiens
accactttcttctgagtttgatgaacacgattttaaaatgacatgaattaaccccttgaataaggtgcttagcgtttcctttctctttaatatgtattttctcacctcacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttcttt

SEQ ID NO: 92680 - DNA, 1101 bp, Homo sapiens
agtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattggatgtgtgtcctgtgtcatttaactgtacctggtggcctaagtatacctagagactttttggaagaatctataaaattcattgtgtattggctcaaactaaactctcctctttgttttctggagttttattctgtttctttgggttctttggagggttctttctgaaaaaaaatgtgtgaagcgagctgagtatggtggctcacacctctaatcccagcactttggggagttgaggcaggaggattccttgagcccaggaattcgaggcggctgtgagctatgatcataccactgcaccctagcctgggcaacagagcaagacgctgtctcaaaaagccaacatgtgaagtggccactctggcagtgggtctggtccagacagacccagtagtgtgccgggtgaccctgtggccgtcagtgctcgtgcccttcctgtgccagggggtggctgcaaagaggtagaattgaaagtggttttccagctactctggaagaagtgcttggaagtcttccattatttccttccacccctggcccaggattgcaaagtacatcatggagccacaggcttcactgttccttcttttccttcccaactcttaaaactaaaggctgccatatgtcct

SEQ ID NO: 92681 - DNA, 3074 bp, Homo sapiens
tgggaggaggtgctttcgggaggcggggccgcggcccggggatcctctcgcgcccgcgggctccaatcgctgctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacggtgagcccgcggggagggcgctgcgggcaggggagggaggcagggaaagcgaagccgctcctcactcacacgcgtctccccgcagccgccggccctgagcgggacccgcgtcctggccagcaagaccgcgaggaggatcttccaggagcccacggagccggtgagtggcgggcgtggggcagaggggccagggacggccttgggcgtcttggcgccaaagccgcattgtttcctcagctgttcacactcccgccccggctcctttcccgcctaggcggcccctccccagggctgcctcccgcgcccctcggcccatttcccggttcgggcgtgcgctcctctgctgcgacccacggagtgcgacgggacagccacgttttcacatcgggccccgtgaaattgccgccaatggaaaggacttggtccagaaaaacgttagtttcatatggttcgcccggtacttaaatgttttattttctcccccaacagaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtaatcggaggaccccagaagacccctgcaggggtgaccgtcacgcctcagacataaatgcacttggaggttcccgttggcaaggggggctaactgtggggcatagtaagtggtgccagcatacttaaagtttgagtgctcagtgtgagtcctgtaggctttactctcttccttttatgctaaaattgtgacttccgaacctcaggtggacctctccaaggacattcagcactgggaatccctgaaacccgaggagagatattttatatcccatgttctggctttctttgcagcaagcgatggcatagtaaatgaaaacttggtgagtttccaaaacatctttcattcatttgacgttgacgatctgaggtcgaactagttcgctttcctcgtcttgtatgtttttccatgctgagtgcatctgtgtgtgtaagctgggttttatattacatggcatttcctgttttgtaacactttgcagttctttcttatggtattttcccgactctagagaagctgagacaatattaagtggtagcaatgtgatgactctttgtggccaccacatctgccccctctttttttttttttttttgagacagagtctcactctggcccaggctggagtgcagtggtgtgatcttggctcactgcaacctccgcctcctgggttcaagcgattccccaacctcagcctcatgagtacctgggattacagacgtgcgccaccatgcctagctaatatctgtatttttagtagagacagggttttaccatgttggccaggctggtctcgaactgctgacctcaggtgatccacccaccttggcctcccaaagtgttgggattacaggcgtgagccaccacgcccggctctgctccctcctttttgtggctttgctgttttaataataatttggttgtatctcttattgcgaatggatctttcttgacataaattaattaggaaatcgagcgctcacaaatcctattttatatgtatctatttcctgatatgtaagttgagcatatgacataaaatatcaaagaattgtgacaaattggatgaaatatatatagaaataaaccttataatggtacaaagagtgcgatgctgccagtatccgttgacagttgctgctgttggttttttctcaagcttaactttgatgtgttttgccactaggtggagcgatttagccaagaagttcagattacagaagcccgctgtttctatggcttccaaattgccatggaaaacatacattctgaaatgtatagtcttcttattgacacttacataaaagatcccaaagaaaggtgagtattcaagtggtatgccaagatttttaggactcactaattgttgatttattacacatttttagttcacctagggataaaaatgactccagaatgactaagacagtcataggcattcccagcacccgtggtcatgtctgctcttagcaaggggcctaaatgcactttattattcacttagagttgtgaaggtactccttttaaagttggatgtctaccaatgtaaaaccttcttttgaaaaaattcctagatgttgggtaagacaaactaaaacctatgtctgaccatctttgctcatttggtaaagttgttgagaagctagaatgtggggctgcagtgggatggacggggaggacttgcctcctaagaagcctgcagtatagtataggcaaataagacttagtaggagttacataaggcagaggcagcagtgaaccctgagactgatttaggcatgcaggagtttggctgaataa

SEQ ID NO: 92682 - DNA, 1085 bp, Homo sapiens
tcctagtaggaagcaatcttagtttattggtttaattattttatgatataggtgtggcaactgaggccaaataatgcacctaatcatagtctgataatagcacagcagttaggattttatggttcttcaaatttaaattctatgattcttcaaattgaacaatgatctggacttgaaataattttaaaggcaacaaatgtccctgctgtactggactatgttttactgtctgtagaccctgaagctcaatatgaactacagaatacccaaacttgtattaatgtaaatcaagtgttgaggtttttaaaagaacactggagggaaaaactgaccagtaaaaataaaacatttcggtgtgagttcttcctttaggaagaggattggcaaatacttgaatttggcctttgtcccagagctcttatctagcagttggtaatcggaggtcttttactgtaatgcttcaattgctgataccgtatgtgcctactagggaatttctcttcaatgccattgaaacgatgccttgtgtcaagaagaaggcagactgggccttgcgctggattggggacaaagaggctacctatggtaaggagacccttgcccctacttaaacctgagcttcattttccaagtaatgttactggatttttggcccttgaataccaactcactagaatcatgttggtgttaactcctaaataggtgaacgtgttgtagcctttgctgcagtggaaggcattttcttttccggttcttttgcgtcgatattctggctcaagaaacgaggactgatgcctggcctcacattttctaatgaacttattagcagagatgaggtgagtctaagtcaaataatagggtgacctaaaccccaaacacaactcgggcatgctcttgtgttcactgacggggacctgagatgctagatggcatatatccacatttaatgtgtgagttcaaccatacacatacttgacaaaagaaggaaatactttcatttactgaaactgttttacttgcattctcaatatattgtaatacatttgtacatatgtattcccctataggctttgaatgcataaaac

SEQ ID NO: 92683 - DNA, 1117 bp, Homo sapiens
tttttctagggtttacactgtgattttgcttgcctgatgttcaaacacctggtacacaaaccatcggaggagagagtaagagaaataattatcaatgctgttcggatagaacaggtaaagtgggtgatgaaatgggtcactcaagcttgctagaaaatgcctgtgctttagttgtattcagaagctgtattttggttcctaggagttcctcactgaggccttgcctgtgaagctcattgggatgaattgcactctaatgaagcaatacattgagtttgtggcagacagacttatgctggaactgggttttagcaaggtaaagtattgtttacatagccttttgcttgttttgaagctggtgctctgtatttatatcttgatgtgaaccttttcaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaata

SEQ ID NO: 92684 - DNA, 2215 bp, Homo sapiens
cgggcgtgtgcacccggcgtgtgcaccggcgagcgctgcgatccggctctttgcgtgtgtgttgtgcgcgcgtgtgtgtgtccgggagtgcccgcgtttctctgcgcggtggagttgtgggtgactgcggacggtggtgtgtctttcgaatggcgtgtactcgtgggcatccatgtgtgccttaggtgtgcacattttggactgcgtttgtggaattgtgtgtcggggcgcagttgctggtggggagcggtgcctggcgggtgtcgtgtgtgagcagctgtgcgcagagcggggtggcggggtgggtgtgggtggtccagccccacgcccagagccccctgtccctgctggtcggcgcagtgcgtagcttaggagcctcgaggacagctgggacccgacgggcaagggcgggcctcgcgggcaggctgggcagccctcagggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaag

SEQ ID NO: 92685 - DNA, 2266 bp, Homo sapiens
ctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcgaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatggg

SEQ ID NO: 92686 - DNA, 1041 bp, Homo sapiens
ttatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaagtcctctgtcagctctgcaattcaggaaagatgtttaaaaatgcatacttgcattgtaggtacatccaacatagagcaaagagagaattttcctagct

SEQ ID NO: 92687 - DNA, 1592 bp, Homo sapiens
gtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcactccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaaga

SEQ ID NO: 92688 - DNA, 2036 bp, Homo sapiens
gcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcc

SEQ ID NO: 92689 - DNA, 1069 bp, Homo sapiens
ccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaa

SEQ ID NO: 92690 - DNA, 1164 bp, Homo sapiens
tagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaagatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtct

SEQ ID NO: 92691 - DNA, 1039 bp, Homo sapiens
gatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaa

SEQ ID NO: 92692 - DNA, 1059 bp, Homo sapiens
ggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtca

SEQ ID NO: 92693 - DNA, 1101 bp, Homo sapiens
caggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaatta

SEQ ID NO: 92694 - DNA, 1157 bp, Homo sapiens
gttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccata

SEQ ID NO: 92695 - DNA, 1035 bp, Homo sapiens
ggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttct

SEQ ID NO: 92696 - DNA, 1018 bp, Homo sapiens
tggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttg

SEQ ID NO: 92697 - DNA, 1677 bp, Homo sapiens
gccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggcc

SEQ ID NO: 92698 - DNA, 1029 bp, Homo sapiens
aacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactatttt

SEQ ID NO: 92699 - DNA, 1035 bp, Homo sapiens
agaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacaca

SEQ ID NO: 92700 - DNA, 1188 bp, Homo sapiens
tgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggattt

SEQ ID NO: 92701 - DNA, 1028 bp, Homo sapiens
ataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggg

SEQ ID NO: 92702 - DNA, 2740 bp, Homo sapiens
ggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgc

SEQ ID NO: 92703 - DNA, 1069 bp, Homo sapiens
gagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcc

SEQ ID NO: 92704 - DNA, 1023 bp, Homo sapiens
ctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcac

SEQ ID NO: 92705 - DNA, 1040 bp, Homo sapiens
gtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggag

SEQ ID NO: 92706 - DNA, 2255 bp, Homo sapiens
gaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttca

SEQ ID NO: 92707 - DNA, 1034 bp, Homo sapiens
ggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatc

SEQ ID NO: 92708 - DNA, 2214 bp, Homo sapiens
attcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttc

SEQ ID NO: 92709 - DNA, 1156 bp, Homo sapiens
atcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttgga

SEQ ID NO: 92710 - DNA, 1006 bp, Homo sapiens
ggatacagcacgggtgtccctgactgcatcccgctcttccctgggcatggcaggcgccaggcaggtggcgggcgggggtggccctcaggagaccaagaagctgcagaggggagggggtgccccaaaccacatggttttgcccctaccgtggcgtacacatgcagccccgcccccaccccgcactaccgtcattgttggtgtccatctgcctgaagatcttgtctgtgcgcttctccggggtggactcatcctccggcatcttcatcacagacgacaccatcttgtagatggcctgcggatgggggcaatgacactgtgctcagaggcccgggggcttgggcgggtgcagcaagggtgggcttccgcccagcccacaacaaggctcggagaggtcaggggctcccggtggccttcgggacccttccccagtggggagaatgttccctagtgaacctcacgggtgtctatgtgaagttcaagagcagagctggcagaagggttctactgggagggtggtgagggtgctggtatctctgcctgggggtgggtagtgccaggaaggtgcctaagtgtccctgtcgggggctgggaatgctgagggagagtggtggtcacagatgtgtgaaattccccacactgcctgctgagctgtgtgcattttactccatggctgttacccctcagtttaaaagagactgagtccctgaaactcacagggcaagccccatcaccagccccgacaggacaggaagcagcagcactggggtctccatggcctgtttagggcactgtcagccgagggctcagtctagccactggtctctctgcgtgtctctgcctgagtggcccagcctggggcatgtgactctgtgctgctggtgggtgtacagaggagacggtgatgggactggtgagtggccactgagcagagtgacatgcgtggggagtggtggcactgctgtgggattttctgagcactccacgtgaaggtggcttgatattctca

SEQ ID NO: 92711 - DNA, 1057 bp, Homo sapiens
tgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaa

SEQ ID NO: 92712 - DNA, 1817 bp, Homo sapiens
aggatggggcttccgtctcacctgtcctcctacctgtgtgtgggtggacccactcattgttctctgagaatcagagcgagctatacgggattcgtgaactgtctggaatgaacacaccataaaaacgtcccaatgcctaattatttcaagatactttattttaaaaacaggtcacaacactaagcttttggcccattctgccattgtacaagctacaaatgcttgttcagcagctgaggggcactcttgagtagcgtgtctgaagagtgaataaaaatccatataaaacaaatattcaaatagtttccataggaacacagataagtgtgacccatatcctagtcttccatatggctgcatcatggcgaccctactcttacaaagacatttcaaaactagcagtaattaagttacatggtccccccaaatcccttaattcaagctaaacttgcagttaacagctaccagagtgctatctacacattaatactagccgaagcacaggctgctctgtggcgtttcatcccactctcccaggcacaagacacaggcagggtgctggcatcctgttcctctacttcgggtgggaagtcggggttctggaattgctgcatgagttgcctgagaaagaaaaagtggcatattaaaaaccctgactcactcctaactgggcatgagagtatttacttcccatcaggaaacaattcaatgtattttttttttttctgagacagggtctttctctgttactcaggctggaatacaatggtgctatcatagctcaccgcagcctcaacctcccaggctcaagcaaacctctcaccttagccaagcagctgggactacaggcgcccactaccatggccaactaattttttaattttttgtagagacagggtctcactatgttgcccaggctcgaactcctgggctcaagtgatccttctgccttggcctcccaatgtgttgtgatttcaggtgtgagccagcacacctggccaattcaatgtatttctaaagcaagcgtttcttcagtcaccgttttggtaataaggaaaccacaagacacatggcatgaacttaaatatattccaattacatagaaatacactcatcagtcttttctaaaacttttcttaggaaaaatatccatatatatttaatcttaggcaagacaatttcttattcgtctagacaagaagcacacatccaagaaggtgcctattcttggcagcaccatcaacatgcatggcttacttaccacgcaggccctgacatcacatagtagatcgtcggcctctggaagccattgaacgtagaggcagcagcaacagtgtaagcgcccatgttttcaaagagcatccaatcacccacatgcatttcaggcaggtcacagcgctcaacaatccgatcgaggccatcacatgttggtccccatatgctggatgaataatacttctcatctggtttaggtctctatataaagagacggagagaggaagtactacttaattacacgtgttgtgaccagtcctcttaattgttttatacagtatgctcagaaattaccttttgcagaaggggctttacatgtgcgtggtcatagagtatgcaattaaatgatccatagacgccatcattcacataatacataaaggtctgctcactcgactcatcttcgtctagaaaggcagatcaacaatcttaatgactttttgcatcagctttcagttatacatgaagtgattcgtcctttatacataccatcagagcccgtctgttcctttaatacaattttcttggcaatgatattaact

SEQ ID NO: 92713 - DNA, 1857 bp, Homo sapiens
catctctacaaaaaaaattttaaaattagcctggtgtggtggcgggcacctgtaatcccagctacttggaaggctgaggtgggaggatcacttgagcccaggaggttgaggctgcagtgagccatgatcatgccactgcactcagcctgggctacagagtgagaccctgtctcaaaaaaaaaaaagaaaaagcatgttgctgtgggcttcctagagaatatgctgactgtagcacatcatcaccccaaatgtgctttgctagacctatgcttcctctccttaaaatacttgaaatgtttagtcacttaggaagttaagccattatattggtgcttgaatttataaaatatatccacatggtttgttaaaatcatgacgtaggcagaataggatttttatcctgttggcatgtatttgttaaaatgttttgacatcttgatgccttcctaggtagtagttagttgcgtactgttctttgataaaaatcatacccataacatcctaaaggagatagggtgcctggaggggaatgaaaacgagccacctgggatatgtagcctggttttcagggagatgttgatgtttttttgcttttgttactttaatgataaacctgtctgttgatgcctggtctcatgatgtcatgtcacaaggccctgtgatgttactcccccatgtgaatttcccacaatgaaggctgctctttcttttctgtttcactctcttagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatggtatgtataaaggacgaatcacttcatgtataactgaaagctgatgcaaaaagtcattaagattgttgatctgcctttctagacgaagatgagtcgagtgagcagacctttatgtattatgtgaatgatggcgtctatggatcatttaattgcatactctatgaccacgcacatgtaaagccccttctgcaaaaggtaatttctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggtaagtaagccatgcatgttgatggtgctgccaagaataggcaccttcttggatgtgtgcttcttgtctagacgaataagaaattgtcttgcctaagattaaatatatatggatatttttcctaagaaaagttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagcctggga

SEQ ID NO: 92714 - DNA, 2672 bp, Homo sapiens
tgcagtgagccaagattgcaccgctgcactccagcctgggtgacagcgtgagactctgtctcaaaaaaaataaaaaagtctataatgctattttaagtttctaaggaactgaaactgctctgaaataaatcagaccattataagacttttttccatatcagtgagctaagtgcagataagcttctgaaacttgcatgctagatttttttggtacaaatatttgaaatgcttagtgtgctgccttggaaaaacctggtattttttgttgtgtccttatactgccaaggtttatggaatcatgtaccttatgcctagtaataattaggatgaccaggccagtgagtggttcatatccggggcatgattagctctgcgtgtgctcagccagtgccccatcttcaactcgatgtgttcctaaggtagacagcaaattccctattttatttctcagattgtcactgctgttccaagggcacacgcagagggatttggaattcctggagagttgcctttgtgagaagctggaaatatttctttcaattccatctcttagttttccatgtaagtattcagtttacatttatgttgcaggttaatcttaagaattgtattgctaaggcttctaagtgaatttctccactctatttgcattttgttgcatttcagaggaacatcaagaaatcatgaacaactttggtaatgaagagtttgactgccacttcctcgatgaaggttttactgccaaggacattctggaccagaaaattaatgaagtttcttcttctgtaagtatatgaggcccatgctggcagtgcagctgagagtgccaggcaagtggaaaactttggcaaggtctaaggaagagcaatgaggcttacatgtcttgttatggaatgtagaaattaattcactggtggtaaattaatagtgataatggtgatactcatatcagtggctagactcaaaagagcaggattcattgtgactgatgggaatgaaggtcgctggctattggtgtggtgtgtggtgaggctgctagtgagtcacctgtgaccactcttgtttcaggatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaaggtaagcgatagcagcaggcctcaaaagcgttgtataaaatgggcctggtattccccacgaggcagatacaagttgtgttttttgggcaataaatgctcactaaaggcaaatggggcgggggggtacatgacaacttcccatgcttttctgtttattccacgtgttaagccacatatggatagcatgacaccactcttctttttcagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagtgagttattcccccatctgagggcaagatcgggagcataagatatgtggattcttatcaaacaaacttaaatttctgattattatatttctatactttagtagaaagtagttgaaacccccattgagtcatgaagcctgggactcaaactacagaatatatcagcgacagtatttagaacaggattgtttttattttaattgtggctataagtgaacatctatcatgagacatttgctgcactttccttgcttgtaggttggttttgcggattgccactgatgattccaaagcagtctgtcgtctcagtgtgaaattcggtgccacgctcagaaccagcaggctccttttggaacgggcgaaagagctaaatatcgatgttgttggtgtcaggtgagattttggtgggatagctagaggtcaagacattgaacagtttgagttttacaggctttctcctagtgtttgctattattttaagaaatactaagacacagtgtctcgtctctttattttaccccagcttccatgtaggaagcggctgtaccgatcctgagaccttcgtgcaggcaatctctgatgcccgctgtgtttttgacatgggggtgagtatacgtgaccctgttagggaagggcgggacacaactgacaataactagtcttaattctagagttaactttttatggcagttggttctgtattacatgggtttcagcctatctgctgcatacatttttgttattagctgtggatctggctgacttattttcttgattctaggctgaggttggtttcagcatgtatctgcttgatattggcggtggctttcctggatctgaggatgtgaaacttaaatttgaagaggtaatttagaacaaaactgtaatactcagtagccgttctaataaattcctttttggaatatttcaaaatttaagtgtcttaactaataccacaatgggctgaagtgtcttggtgtgatattttgagtgatttctttgtgctgtctgacattacacttgataccatttggttttctaaagtgtgaat

SEQ ID NO: 92715 - DNA, 1901 bp, Homo sapiens
gactccccggccgcggaggaagggagggagcgagggcgggagccggggcgggctgcgggccccgggccccgggcacgtgtgcggcgcgcctcgccggcctgcggagacacgtggtcgccgagcgggccacgaccttgaggcgccgcttcctcccggcccggggttctcccgcggctggataagggtgatccgggcgcctcgttctgcccccgtcttcacagctcggggctggaggggcctaggggagacccacccggagaccctgcggccccgcgccggcctctttcccaacccttcggcggccgcgcgctggccggggagccgttggggaggccctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaaggtttgcagaaaaggctgattgtgctgtttgcgaagtcgaaataattggtgaaagtgtagaaggcagaacctctcaggaatgtctggggaggacaaagaatgtgttggctgactttgtttaaacataaaattgggcagactttaattgatttgtgaaatttttttcaaagtttgtttgaattagcccctatctcttctaacattatcctcttgtgctaattgattgaccattttaaataacttagctgttacagaaagaccgaaaggtgttcttcagtaaaatatattcaagtaagttacttaagtaacgccttaaaagatacagaaaagcaaaaaagtattggcgtattaaaaagaaatcaaaactttccaagtttaggcctgaacattgccttaaaaatatttaataaggcctcaaatgacccagtccgagactgcatgagcctatttattattaaattgtaaatattcttcatataaacaaaaatatataaccatgtctgtaacaaaaatggttttgctagcgttgttactctcttcccttctccgaggggtgatttaggcaacttcggaggttgacaatgccaagcagtcacaatagatagagctttaaagcaaattctatgcatgggtttggatttatgacaggcccgtcaccctgggcctgtcatagtaccccatgccagagcaaactgtgtccccgaaccattgcctggcctctgtgcccgtaggctgctggcactgaagtgggttgcacagtggaaaagaagaaagctctacctggcagaaatttttaaaggttaaaataaataattttaagaaagctggttcacaaggtgccacatttgatgaaagcaaaatacagtggcttttattgttactagagtgatgttcttgcttgtttttcttttttggtgaagttagccccaaattattctcatagctaagcaaatacgagagtgactgtaaggacagttggcattcccggaattgctaaacttggtaggcaacgctggtttaagaatactgagttctagccgggcgtggtggctcacgcctgtaatcccaacactttgggaggctgaggcaggcggatcacctgaggtcgggagttggagaccagcctgactaacatggagaaacgccatctccactaaaaatataaaattagccaggccccgggtgtggtggcacatgccggtaatcccagctactcgggagactgaggcaggagaatcgcttgaacccaggaggcggaggt

SEQ ID NO: 92716 - DNA, 1015 bp, Homo sapiens
ttggaggaatgggttttccatcatttgtccatccctcctatgttatatataataaacagaaggaggttaaaaatgcgctggtacctccaccatcattctgtttatggtaccaacagacctagatcaggccagaaggagtgggcctcacagagcccattattgcacttatacttgctttgctcatcccctgcaagagctcagagctccatgttccaggattggatgagtaatatcagccccttggacacaccattgggtcaccctgccagtaagagacagatttgtgatagccactcagttcgaacatttttttcacttttatttttattttttgtccttggcatttgttgagcttctttaatgtatggattgacatcttttggttcattccaaaaaattatcagacattatctctttaaataataattttgcccccatctcccttgcttctccttctggaataccccctaaatgtatttagaccttctcactctatcctcctctttttcatgattttcatctttctgttgttctgtgctatcatttggataattttttctgacccatcttccagttcactaattctctctttgcctatatctaatttcctattaaatccacctattaaatttaaagtttcagttattatatttttcatttttataagaaagatctatttgattttcgaaaaacctgccaaatcagttttttcatagttctctgtttcctgcaaatatctttaagcttgtattgttttttcaacataacaattgtataatttctttcctattatttcattatatgaaatatttgggagtagtttagctgtttgttttttctgcttattcatgctcatgttgccttatttccttgtgtgcttccttatttttcactaagtgctgcttgctttcttttcttttttcttttttttgagatggagtctcactctatcaccaggctgaagtgcagtggcgcaatcttgactcactgaaacctccgcctcctgggttcaagc

SEQ ID NO: 92717 - DNA, 1086 bp, Homo sapiens
gaagccaggtagtcacgaaggtcaattatagggcagggacaaggccacggggccgtctaataatgaaaggatatatgagattgtctttctttctttccacacgcagcttactcctgtagctgctgtgctgagctccatatgaaaaggttactgaccacagagctttgggttagttcctggtgagaactccagggtagggtgggtaggggaagcgtgccttccgccgtgggacagtgtctcggtgcctgactgtattagggttctccagagaagcagaaccaacaggatgtatagagagcagtagaaagagatttattatgagggactggcgtgtgattacataggccacgatgtcctaagatctgctgtctgcactgcactggggattcaggaaagctgatgatggaggtcccaggctgagtccaaaggccctagaaccaggagctctgacgtcggagggcaggagaaatgcatgttccagctcaggagaaaagagagacaatgggcctttcctctgccgctttgttctatgaagccttcctcgatgggttggatgaggcccacccgcagggaagagagcggatcttctttactgggtcccctgatggaaatgccaatcgctttcaaaaactatgccccccaccccgccccccgcactgacacacccaggaataatgttttgctgcttatctgagcatcccttaacctagtcaagatgactcataaaattcaccaccgcgctaaccccaggtgtgctacataccttgaagtgctaaatactggatgagatactttactgctgggatctaacagcttctcatccaaccctagaaagcccctaggatcttcctcctcatgagtgaatagattaaggctgaccaaggtctcccagcccctgagtggcccagctggaatttgagttcgtgactatcagtcttcaaatctgagtcgtgcctactccaggctgatgcagccctgagcggctgaatgagctggcaggcgcaggatgtgtctactgagttaaatcgaatgtactggaagggaggggacttaggacacattatattattcatgcatttttgcact

SEQ ID NO: 92718 - DNA, 1086 bp, Homo sapiens
atcccaggctgggcctggcccactgctcaacaagcatcacactgtcacctggggcatctgcagaacttttcatcagacaaggagaaatggcctgtcccttgcatggggagaattcctctgctattttaaccattttcttttcttttttttttttttaagacggagtttcgcttttgttgcccaggctggagtgcaatggcgtgatctcagctcaccataacctccgcctcccaggttcaagcaattctcctgcctcagcctcctgagtagctgcgattacaggcatgcaccaccacgccaggctaattttgtatttttaatagagatggggtttcttcatgttggtcaggctggtcttgaactcccgacctcaggtgattcacccgcctcggcctcccaaagtgctgggattacaggcgtgagccaccgcacccggccttattttaaccattttcaaacatgcagctcagtggcaggaatccattcattgttgtgcagccatcaccaacatccacccccagaacttgttcattatcccctgctgaaactttgcacccacaaaacactctctatttcctcctcctcccagcccctggtaaccgccactggacttttctctctatgaatttgcctcttccgggtgcctcatatcagtggagtcatgtccctttgtgtctggttttttcacttagcgtagtgttgtcgaggagtcatgtccctttgtgtctggttttttcacttaatgtagtgttgtcgaggagtctgtccctttgtgtctggttttttcacttagcgtagtgttgtcgaggagtctgtccctttgtgtctggttttttcacttaacgtggtgttgtcgaggagtctgtccctttgtgtctggttttttcacttaacgtggtgttgtcgaggagtctgtccctttgtgtctggttttttcacttaacgtggtgttttcgaggagtttgtccctttgtgtctggttttttcacttaacgtggtgttgtcgaggagtctgtccctttgtgtctggttttttcacttaacgtggtgttttcgaggagtttgtccctttgtgtctggtttttt

SEQ ID NO: 92719 - DNA, 1179 bp, Homo sapiens
atgctttaataacgtacttttagtacatttaagtattttttgtttttaaaaacagtgggaataaactaatggctctagtttgtaaacaaagatctctaaaaggaagtggacactctaagtgatatcatcttcttaaggtggctcttgtgtaggctcttttaaaacatcccagtggttgtgtgagtgtgttggttgaaaaaccagtctcctactttgtaggaggctggtctgtcagggcccttctcttgcctggggttcagaatttctgcttttgcattgatggtaaaagttggccttggtcctgctgtttctgccagggtagcatttgtcagagcagagtccaggcagccccaccatgtcccctggagcctgtgggcagcatttctcctggcagcagttctgagattggtggtggtactgttggcagcctgacggttaccagaaaagaggtatagaattttctctctttccctctactcatttcattttctcttttagtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggt

SEQ ID NO: 92720 - DNA, 1049 bp, Homo sapiens
gaggacttaatttgtgctcattcctttgtaaaaggtggacgagtggccaaattactcacatacctaatttgtgtattgtttaaatatatcattatatcataaatgccattgaccattatgatcaattacaggcttcaggagtagattgctctttgcatttggtcttcagaaatatgattgattttagtaagaaaagtagcaggcattgaagtgtttggtcctgccacttaagatattaaattagtgggtgtttttgccagccattgttttacagtctatctctggaatatgaataatgactatttgaatgcacctaattctttccatttattgtgttaaatgaatgatattttctgtttacatgtgtaaacatttttcttcgctatcaattctaatcaaaacttgtttcaaatggtaaattaaaacataattttgattaatgtggcattcttttgaatttcccatagcaaaacccttgaagatcgtttgaaaattgaagcaaaaaatgggacattgagtgtatccgacaccaccgttggcagcaaacaattgacattcacgttaaagagggtgagttgtcttttattgttattttttaattcacaaaagaaaaatagcctttcaatagtgtttgtgtgtgtgtcctcagagcagccttctcaatgcttttcccctattgaggaagctgtgttccctgttctaacattttccttgcaaccagagcccctggtgggccaagagcacagtgtgtgactgcagcagagccaggaatgtcactggtgttccaagggagacagggagttagtggccctggagttagctctgttggagatgaaccagccgtcttggtttctggattgctctgtagcctcaggtgcggcttataaagcaaaagtcccatcctgaccctctaaagatgtagggctactacatcctgaccctctgaggatgtagggctacctcgcatgtatatggactttgaagaagaccgggaattggcgagttctgataacttgtgacagtcacacccagcttgcccagatactatc

SEQ ID NO: 92721 - DNA, 1023 bp, Homo sapiens
catatggctttagataaacacgtgtgtctgttgacacatatttttatgccttacagtgggctaactttgtttgtgagtctgttcatccacttatcagcctctccaccacccattcattcatcaagcatttatcaactgctcagtgcgagcataccagcattctagacccaggggatgggaagaacgacatggcctgcgtacctgaagcgctcatgggaaaggagcataagaaggaaggagctgaatttggggagccttgaaatcatatggaaactggttgtggaaagatgcagagtggagcattcagggctggtgggaaagatagcattcctggcagaggcacggtgcagccacaggcaggccatgcgaagggttgggggtgccttcctacagccagagcatggggtgcctgaaggggtagccgagcaagcactggaaagccacgatcttacagcttagatgaatgggatccaatctattccaacccctcccctagtgttgtaaatacttttgtaataaaagcagtgcatgtttgttgtagcaaataaaaacataggcataaaaagtccctattcccagaaacccattagcagaatatctccattttagaaagacaatgtgcggagaacctggacacccagagaccagctctcaaaccattagaatcatcccagttagaagggccacaggcctgaacgatggggtggagaggagcagacagaccagaagactaagagtgagaaagaaaaaggagcacaaactccaccatcagttcctaataatatcaaaggagaagggaatagtcagggatgacgtagagatgtctagtaatgttgccattgaggtaaaaaatacagaatgcaaaataggtttaaggctaaaagtaatgagctgggttttgtgcacattaaataaaggagcccatgcgtcttctgtgtcacattcagtaaaccaatggcagtgtccatcgggcccaggaagaggaggctggagatgtcagtttgagagataccagcgtttatt

SEQ ID NO: 92722 - DNA, 1134 bp, Homo sapiens
gcatgtagcatttacattgtattaggtattataagtaatctacagataatttaacatataggagagggtgtgcacaggttatatggaaataaccacaccattttatacaacttgagcatccatggattttagtatccaagggaggtcctggaaccaattccccagcggataccaagggacaactccactccatttgtttttattaccaagtaatattccagtgtatgtatagaccagtttatatcccttcgtcagttaatggacatctgggtagtttccactttttggctattatgaataatgctgctatgaacattggtttatacagttttacatgtgttttgcatatgttttcatctatgtgcaagaattggaagaaattgctggtcatatagtaactctatgtttagccttttcagaaaccggcaaacttgtccacaggctgtgccattttacattctccagcagcgtgtgcagcctcactttttatacagctgttatgtgtaggtgttttactgggagtcctgcttggtttgtgctgttctggttctgtggagtaagtttatttgttgagtatatgctgtttttgtcttgctctatttactgctttatctctggctcttgaataagtacttagaatagagtgggcacttgagaaatacttgctgaaactgtgaatcttttttgccatgacaacacatcaggcaactcagaagttactccttcaagatctgctgagaaaggactccttttccccatagccattgaccaggaaaatctgggagcagttgttttgagtgtaaccacagcaacaggaggctgtgatttgggggtaggcggtctgactaatctctctaacattcttccttttgcctgggggctgtagtaggatatggaggtataaaacaaagaggataaaaatttgtatctaagaataacccatagcgaggtgaataaactgcagttaaacattctaagttaaatatcaccaagttaaacattcttactaagttaaatataaccaagttaaacattcttactaagttaaatatcaccaagttaaacattcttactaagttaaatatcactaagttaaacatcctttttgagaactatataagtgataatatttac

SEQ ID NO: 92723 - DNA, 1017 bp, Homo sapiens
aagactcttagagcaacaagaacttcgtgaaaaagtaatgtactccttatcagttagaatttgctactgtttctttaatgtaatgttttctttgtaagttagaagagtctttgattatacttgagatgtaattaattccatattaagtgtttgacattgggcttaggagtattatcttatttatttaaaggcatttctcctgatgcatgcagtagagcagctgttaggcactcattaatgggccagtgctgcttcagagaaaccaaggggtctgtgtttgactgggggaaaggagttgctgcttactatttttattctcaggaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaagtgagtagcactgcctgagcgcacagttgacatgtaaccaagcccttgcttttcctctctggcacattgccctaaagatgacatttctgtctttggatgatggaggtgcagagggtggaggggacgagggaagcaggggaggtaaggccgtgcaggaggtgatgtgagggaagcacccaggaggcctgaggggagcgtcgctattgaagtacattggtctctaggggatttacttatttgtcacaactttttgaggtatagtttacatgcagtaaaatacagggtagagagagccttatgagtatcagtggaacacttttaagctgcagaagccacacactttccttgtccttgttttttccccatggggttccctcacctacaaatacttactctgtgccctacagatcagtggtttgaagccttttggacagtggttgctaggaga

SEQ ID NO: 92724 - DNA, 1634 bp, Homo sapiens
tagaagatactagtgttcaagccaccatctttactcagaagtctgtaccagcctaacttcataggtatcatagcattgaaagaactaatttgattggccggggtgcagtggctcacgcctgtaatcccagcactttggaaggccgaggcaggcgaatcaccaggtcagaagtttgagaccagcctgaccaactggtgaaaccccgtctctactaaaaacacaaaaattagccggccgtggtggcgcgtgcctgtaatcccagctactccaggaggctgaggcaggagaatcgcttgaacccgggaggcagaggttgcagtgagccgagatcacaccactgcactccagcctgcgtgacagagcaagaccccatctcaaaagaaaaaaaagaaaaaaaaaaaaactaatttgtttcaaatggcaatcattcttcatatatgttactatgttggaacaaaataataataggcgtcccactcaggtagacagataccattcttccaggtaggactgtggtatgaatagtactttaatgttttctatattttaatggtaaagttgagcatgtgtagacgggtatttataggacggatcactagccagacacttgtaagctcctatagaacattaatagctataccttatcctacttttttccttaagacagctgtgaaaacaaacagactaggaaaaaaccctgagggaaatatttttacaagctgggtcagaagaggttttattttatagttgttcatccaaagcatacttgtctttaggcaatgcaattgatttgttttaaattaagaaaaaaatcttaataccagcaacatatgtagtctttgtaacattttctctatttattaaatatgattattactttaataaatatagtaagatgaaaagtaaatatttgcccttgggtttttttaacctgaaaatgtgtaataggcacatagttattcatttgaaattatctttcacactatcatctatccgatatctacagataactccaaaatttacatcatagccccctcccttctcctgagacatggcgcatcgttcccagacacctagtggtgtccgtctgaatcctggtgctcttctccctgtgccacaggcataggcagccctaaatggagcgtgatttcttcccctttactccacccctgcgttttttcctaatgctctccagtgatggattctaactcagtgtcgccagctttctggttgcttaagctacatgtttgagagaagtttctaaccctgtttttaattcttaaccctcccatctccatagctggatctgtcaattctaatttagaactgtatctcgtaattattctttcttaaaaactgtctgttcccattgccctaattcaggccctgtctctcttgccagtttcttaaaatggcttcttagtcttctcatgatgctaacttcttactcagcagtccgtcagacatcaggctgctgcagacttttgaagcacaattttgggttggtttgtttgtttgtttgtttgtttgtttgtgacaaggtctctctgttacgcaggctggagtacatggtgtgatctcaactcactgcagccctgacttcccaggctcaagcgatcctcctacctcagcct

SEQ ID NO: 92725 - DNA, 1071 bp, Homo sapiens
tattgctgccactgagaacacaaaaatcgaataagatgtttactgtatggttgatattgaacctaaaatgggaagtggcccaccacataatgtcaatcagtattatatggacattatccaaactcagaaattttggttgcattaattctagttaacaattaaggccgagtgcagtggctcacgcctgtattcccaatactttgggtggctgaggcaggaagattacttgagcccaggagttggagtctgcagtgagccatgatcacaccactgtactgcagcctgggctacagggcaagacagcatctctttaaaaaaaaaaatgaatgaatgtatttattctttcaacaaatatgtattgaatttccagtatgcacaaacagctttgagaggcatgggcatctgtgatctgtttgatttgtgagggtttgagttttggttagagctatttttcctataggtatcattttttgtatgttagtcttttttgtcagtttcttgctgtggccttaaagtctctgatgaatgtacttttctttcattctgcagcagctcaggcaggactgtgcatgagatctctaggccaggggtctccaacccctaggccatggtactggtctggggccttttaggaatcaggccgcacaccaggaggtgaacctcaagcttcatctgtatttacagccactccccattgctcacattactgcctgagccccacctcctgtcaggtcagtggccacattagattctcataggagcatgaaccctattgtgaactgcgcatgcgagggatctaggttgcgagctccttatgagaatctaatgcctgatgatctgtcactgtctctcattagcccccgatgggactttctagttgcaggaaaacaagctcaaggctcccgctgattttatattatggcgagttgtataattatttcattgttattacagtgtaataataatagaaataaagtgcacaataaatgtaatgcgcttgaatcatcccaaaactccctcgcgcccgccccccgccccccaccaccatctgtggaaaacttgtcttccgaa

SEQ ID NO: 92726 - DNA, 1040 bp, Homo sapiens
gttctttttttttttaagcttattctttctctgtcctctggtttttaaccaggtacgtgcatctaagatgggtgagctccttttgtcttcatttctgttcatgcttttcaatacccagggactgcaactgaagggtcttgttcctagctcttggcacactgcttatgtaatcttgggcgattgctcgtcttcatggggtcacagttttttcatctgtaacatgcaaggaccggatatgggcattcttagagctgtgctttccaaatggattcagactcaagactcccccttgctgtcttctgcttccttagtctttccctgcatcccctcatcctcgtttattacattcttttagtatattgtttaaattttaatttctggaagcctctcaagtaaatagaggacttttaggtttccattttcatgacatgaatagtatgccaatgttgaaataattcctcaaacttattaatatttgaatttatgtctgtgtgtaatggctctgcaccttcctaagttacaccaatgtgtataaatgaatatatatatctttaagtgtttagaatacaagtctttgctgctgtgttgactctctcctcagagtattcacactgatcttcttgttagctaagcctaagcatgattagggaggtaacttttctgctttgtaatgtcattttacagtaaaagctaaatggaagtgatctttggatgtacatgccatgccctaaggcttcagtagatagagagtagagctaacttagactgtagatgtttgcattcctatctgtgttttatgccagagtctttatcatctgatagaggcaagaatacttaagttacaatttaattttgctactttgtgcagcatgctataccagagcctgtttataaggccctgtgattatctagatgcagaagtgcccttcccttccccccatttctttgtagacctttgctgaggttgagggcagccagagaagatttagaataccccatagtgcaggatggtggaaatgacctcacaagttgaacacatg

SEQ ID NO: 92727 - DNA, 1782 bp, Homo sapiens
gaaactagtgtgaactgcacatgcgagggatctaggttgtgggctccttgtgagaatctaatgcctgatgatctgaggtggaatagtttcgtcctgaaactgtccctccctgcatccgtggaaaaattgtcttctacaaaaccagtccctggtgccaaaaaggttggggaccactgacatatatcgtaaatgttctgcatgtgagtacatcacatgtggacttattttgaagatctcagtctttttctgtgtcaatatttggaattaataaataattcctgtgacatagagcattcttatgtgaccaccagcaccacaaattctaagtgtaacctattaaaactgggaaactctgtgaaagtattgtttgaggcagggttctcaaatgctgactggcagtggacttttcattagtccctgatgaggagtgcatatgtgatatgagtattaatatgcatgtatgtatgtttatatatggtggtaggaatttgtcagctgttctttcttggaagacggttctttctacgttgtttttgtgagtgtcctttgtctttgcaaatggtcgatgacaatgtttctcctctctcccttctcctcatttcaatttggcaacttactgttgatccccagtattattttctaaattgaacttgtttgtggaaataaaaaatctgaggaccactcagagggtataagggaaccctctttgtcttagttcataaggactttctcatcatttttgtgtgtagtattattacatttaaaataaggatgatattgctgaagtagattaaatgttctctatagatatcaaagaagattagtaattctaatccttaaatttttagtctgaagtgaaatcttactataatcaaattgttgcccaagaaaaactgttgaatgttaatgaagattgcataaggacctgctgtcttctgtttgacctttcccagggctcacccacctcattggatctcctttcctccgggcatatatgcatgggtttttcatggatataagactctatcacaaggtaaacagaaaactacagttattatgtttcaggtaactaatgcgcagtctgtggccatttcctcactactcgcactttcataaatcatacataggatttgtaggggatctgcctgttctttggcataactgtcgtggtgtatatgaaaatgatattaccaaataccattcttttattttaaaaacttttttcattttgaaaaggtgaaactgatggtaaatccatttgcttatgaagaatataggaaagataaaatacgacagaaaatagaagaaacacgtgcacagagagtccagttaaaggtaaatattatacttaccattgaatttatcagagaagagtacttaatttccattttgtgtattattccaaagaaatctgccattcttttcttgattttccatctttaatttgcatcttttactgatatttttggtatagtttgtttgtcatcagtgtgtcatgtttgtcatgagggtgcaaaactctttacaattttcgcattatgacctctgcggtaattgtactgtgggacataatgctagaatgattgatattgtcacctccactagaaacctgatagcatttttaaatgggttttccatttttggagtatccgggctttgctaatccctattccttactgacctttggccgtatcttaggctctgtttggatcatgggaaatggtcgacagtcgtaaactgcactctctgtctgagtacatagaatttaatgtaaagaatgat

SEQ ID NO: 92728 - DNA, 1090 bp, Homo sapiens
agcatttagttgttgacttcaagctactgtcctaaaattgcttaaaaccatagcagttcttttaaaaagtgttctatatggaattttttaaaaatgccttgcatttcttgaaggtttgtcttttatggttggagtcaaaccacttagtatataaaaacctttacttctatttttaaaaattgtagattgcactaatatgaagtttctgtggaagactatatatgctcgagtttttttcatgtttatgagtaccatagctgtgttgaggtgaagagaatcactctttctaatccggcaaaataatgtcactaaattattatggccatatctaacatttacttttctttttatttgaagagggtgttaacaggggctgtttttctttgttataattctcttccttctgcctttccttcttcagaaagtttaagctagatttaataatttccattatgatttctgggtttttttccagtatgcttgattgctactgaaataaacaggttaagtcgtcactggaagttccattttgcccgagtccagtgttctctcattacctctagcttaagggaggatttcgctagcatatcttctctgttgactgagccaaggtttcctttggcatacattgacctcagcgggtgtggcattttgttgggaaagatttgtatcaatagcaaaaatgtacaaagtgatcatagtattttatgaaagtaggtggattatattttttcatagttggattacaaacttaatgattcatattttattagttggttataattctgttcagccttttgttcctcagcctttcattgggataactcgtggagcctggtcacccatttagttttgaagacttatttatacagaaatttaaaaaatcaactaattatttttaaatggcaagtaaaaattacatgtatttgttgtgtaccgcatgatattttgaaacatgtatatgttgtggaatggctaaattgagctaattaacatttgcatcacctcacgtagtacttaccattttttgtaatgagatcatttaaaatctactctcttagcgattttcaagaatacaatatattgccat

SEQ ID NO: 92729 - DNA, 1018 bp, Homo sapiens
ttttcaccaagcttgcatgttctgaatcctgcttaagttcaaagtttataaacctccgttaggtacgtgaatttagttttcagcaaattattcctttggtttcccagaagcttccttcacattccagctcctcaagtaaatgttaaaagtttaacaaggaaaaggagtgaattgattttgtatatatttttgtttggtgaaatagcagagtgtaggcatagtcttttcagataagtttgctaaaaagtagtttcctgtcacctccctttgaaaagaactgaggtgtgccccatcctcaaacctaccatctttccaatttatttgtttattggggtagtaggtgggaataaatgtttcttagatttttctggcctcccttcctaagccagggtagctcctggcaaatagtccccagacaaaccttaactgggccgccttcctggaacctcattttatacccaaaatacaaaaaaataaaaatacaaaaataggaaaacacatgaagataaagtgctgcaaacacacgactttgcaaatattaatcatacagagccaatcgcttatggtatagaaatagtctgaagtattcttttggcacagcattgcctgtgtgattctcgccagaaaggtttaactggatctgattatgagcagtgatcagcagaggactgtggggaacccctgcaaatcagggctctttctaagagctctggcctgagccttgagcagatgtccacatcctgaaagtcagtgaaggtgggggctcctacattaaaggaaactaaggagacataataacctccttaattcatttttttttaaaaaaacagctttttaaagacataatacacataccatgaagtttatccttttaaagtgtatagtcctaagccaggctctgtggtacccacccataatcccagctattcgggaggctgaggtgagaggatcgcttgagcccaggagtttgtgaccagcctgggtaacatagtgagaccccatctcaaataaaaaagaa

SEQ ID NO: 92730 - DNA, 1080 bp, Homo sapiens
acattttattccactgagttcagattgagttcctttatgtcctttgctgtgtcagtatcatgctttctttccttcagctttatttgggggaacatatgggaaatcttattttgtatgaatttaaaatacgttcttcaggatttcctagttccgtgcatgaccgcctccccaagataatcggtaactgctaaatggtgttaatatattttttcaccttcctagaatagcactgttaaggtatagaaccttgaataaaagtgtacatataatttttttaaagttttgctcttcctttttttctgccgagtttccccccctgggtatttttacatatatcggtacccttagtttttacatagatttcaaaattaagaattagaaagcaataagaatatgcagaaaagttattaataaacacttttgcctgcaaggaagtcgagtagaaccaggaaactactgatgtgctaaggataacacaccaaaccatctgtgttactaactcttggcaggaataaaatgacaaaacaagatcttgggagatgctcattaccaggtgcatgatcaaaaagataaatacattctcatgtaaaaaaattggcgtagtgcctttagcatccttggggcatgtgtgcgtgtgcatgtgggcaagtttagcatttggtgtagttaggaaattgggagaggaaaagggtagaagtagaggactttaacattgcttagagtcattgttattgcaaagtctggaagtgaactctaggaaactgcactggaattcaagtgtaatatgatgataaacatcaaatgactgtttgtagccgaggtgcaaggccaggctcttcaggaaagaatgaataggagaccttaaaataaacatctgtttttttattcagctaacagtggactttgaagaagattggggccatgttcagattttctttttcttccttgagaattgaagaaaaatgtcagctgaggatttttttatgctatttaacatgtcatttgtagtgtttcatgaaaagcagacagatatgtaaagctttttattccacttcaaattagaataataagttagatcca

SEQ ID NO: 92731 - DNA, 2085 bp, Homo sapiens
tcaaagttaatttcagttctgattgggtaaaaatgtatgtaattttcatggagatatttgatacacatatgacatatattgtgttagtgtatcagatgatgtttgtttttgcttaaatagtcttacatctggcatgtccattttcttgaaaataaatgacaacttcctattcagatgctagtttgacttcaatgttgaccaaaggccttgtctcctggttccggcatttcctccatcttggtgcttaccaagtcgatctcgttgccattcttattttggatgagatatagtcggacttaaacctagtatttcagtgtcctggttgtgtagtcacttaggtggcgatgtctttagttaacatggccattatctcttctttttttttggttttgttttgttttttccttaaaaaagaaggtagcttatacaagtaagccagaaatttagactacattcttttaaaaggcccaccttatacagaaaataataagaaagttctaggacttacaccatctctactttgattcagtgttctcaaatcccaacgtaagtttctcttctgatgcccacttaggatgtaagctccacaaggcgggaactttgtatgttgtgctttttgctgtgtccttggttcttagaacagtgtcttatacttcataggctttcattgactccatgcatgctggtttaaagtaatgaatattgacccttttaaaatttgttttatttattattattttttgagacagggtctcactctgtctcccaggctggagtgcagtggtgtgatcatggctcactgcagcctccaaactcctgggctcaagtaatcctcctacctcagccccatgcagctgggactacaggcacataccaccatgcctggctaattaaaaaaaaattttttttttcatagagacagggtttcactctgttgcccaggctgatcttgaactcctgagctaaagggatcctcccatcttggcctcccagagtactgtgatcataggcatgagccaccacacctgacctgacacatttttttaatgtattatgaaaaaaatgtattttgtctctcattggttagaggagaaaaaatttcaaatagacataaaagtagagagaaatgtaacaaacccgtcttctacccatccttttgctcccatgtcatcagcttttcccccaggctttttttttgtgggggtggggtggaggtaaagttggcttatactgtattactagcaccgtaaattgctctagaaagtagttattacagattgttaaatgggaacgaatattagatcttgacatgggcacaaatcctcatttggattatatgtttaccttcttgaggaacagaacattattcttggttggaaaacaagtaatatgtaaatgatagtagtgggacattgaaagaaaggttagatctgcctgtccatgtttcttgcatgtctgtacatggttatgtcattcactcattcagtggtctttattttttagagcagtttttggctcacggcaaaattgagtggaaagtacagagttcttatgtccctcccccacacgctccctcaccatcagcactttacaacagagtggtccatttgctgcagccagtgaacagacattgacacatcaccacctgaagttcatagtttacattagagtccactcttggtggtgtacattctgtgggttttgacaaatgtataatgacatgtatacacggtcataatatcacatagaatagtctccctaccctaaaagtcctctgttccacctgttcatcccttcctccaccccacaaaccccgagcaatcactggtatttttactgtctctagttttgcttttttccaaaatgtcatatagctgaaatcatacagtatgtaggcttttcagattggcttctttcacttaatcctatgcttttgagattcctccatgtctgtttgtggcatgatagctcattttcctttatcgctgaataacattctcttgtctggatgtactgcagcttgtctgtccattcacctattgaaaggcctcttggttgtttccagttttggcagttaggaataaa

SEQ ID NO: 92732 - DNA, 1051 bp, Homo sapiens
attctaacaccagatggaaattctgacgggcctttcaagtttaggtttgcttatattccatttagtcttatctgcttgactttagaacctgatctttatataagagattaaaccaatgaaattaaacttcagaaatatttaatgcaatggatagagtaggagaaggggaacaattttaaaaatacagttagcggaatgggtgagatggtgcctagcagcagcagcatctataacaaaaagagctctgttggtttcagtcaactgtaaatcaaaggaataaaggttaagtagaatgttggcagtgactccacttgtgaatgggggtcgagaatgtcaggatagcacagtgaaggggctgtcttggggctcttcatgtgcagagtgtacctgtgtgtgttatttctgctagtggtggtaagttggagaaagctcagaaaagaattcaagaattgtgtttccaggcatcatctagatagagaaggcatgattttaggatctaggaaaagagtaagatcatgcaagaaagctaccttgtatgaggtacagaaaatgataggacattggcctgaagacgaaagttttcattgtttgagggtgtgggaagagctgtcagacaatgggaggcagtgaagcactcgcctttcacagcttctaaaaggaggaaaaagacaaatttgaatgaaaaatatgatttactttaaattgagttcaaatttgaattcagatgtatatttttaattttttattatttttattttttaaaattttaactttttttagattcagggggtacatgtataggtttgttacatgggtattttgtgtgatgttgaggtttaggatgcgattcaaccagtcaccctggaagtgagcatagtatccaaagttgtccctccctccctctctccctccctccctctctctccaaaagatgtgttttttgttgttgttgtttgtttttttttgtttgtttgtttgtttgttttttttgagacggagtcttacgctgtcacccaggctagagtgcagtggcgcagtctcagctcactgc

SEQ ID NO: 92733 - DNA, 1081 bp, Homo sapiens
cttttgtttttctctccatgcttttaactggagttgctgggagtgctgtacacgtcattccctaagatttgggtttgaatcaggaccacgattggtccagctgatgtatttcagttcaaagccaacaatgtaggatcatttatgtttactaaattgatattctggagaagtccccagtaagagatctctttgccccattagtatatgttgaaatggccctgaatctgttagtgtccgtgtagaatcctaaaaatgatagatcacactttcatctaaagtgcacatttaagcagagccctattagacatactgacagatgtaattttgccagaaattgctcttttatagtaccagtagcaacatattctctttgtttgggaaggtagtgtcagatgaaaagaaaactcttccctagggaatttatcagcatacaaacgatgttccagacagaatgtaaacgggaaagtcgttgctcaaatcttgtccacactaaaggattcatcagtgtgctttaaaggaaaggggaagctttggagcatagaccatcagagctagaagggatctccaaggtcatctagtccagcccttaatttgtagctgaggaagcaagtttttgggtttttttttgttttgtttttcctgagacagtgtcttgctctttcgcccaggctggagggcagtggcacgatctcagctcactgcaagcttcacctcccaggttcacaccattctcctgcctcagcctcccaagtagctgggactacaggcacctgccaccaccatgcccgactaattttttgtatttttggtagagacggggtttcactgtgttagccaagatagtctcaatctcctgacctcatgatccgcccgcctcagcctcccaaagtgctgggattataggtgtgagccatcgcgcccagctgcaagttattgtttaaggtcaaatggcaagttggtgacagctggatctaaaaagcatttcttccttccacattgcatagtagaaataacttagactttggaattggttggacccgagtttgaataccagcattgccatttataaatgtgaccttga

SEQ ID NO: 92734 - DNA, 1041 bp, Homo sapiens
agagagccctctcctaggtgagctgcatatggggacagtgtgagcagaagttgcttttgctaagcgaagcattatgctgaaacttggacttcagtgttcctttctgacctacctttctgccctgctccctcccacagtactgagtgatattttatagcaccacttgtctttacttggaaactgctctttgtaaactccttcaaagcaaagggagagcccaggggtctgaaagcctgccatttttcataagattttatcaaacgtaccaagttgacgtttggcaggaaggttcatttgaggcctatagaaccaaagaaatgtgtgtttaatgtatgatccatgccaagtttaggaagcctggactgtgatttgtattaacatcttataaatcaggtttgaaaactttttccctccctctttggggcatactgaagatgaaggcaacttagtgttcttttagcttgttaatttttgcctatctgatatcatctttcttgagtaattgaaatctttataaactaatgcagttcctgatacaccaccttctggcacttagatatctctgtagccagcttgtcctttgagaccaaatgggttgtctgcagcccctgtcccattttctcagttctttccttattttttatttttatttttatttttttaattctctcagagaccaggttctattgttttgtttgtttgttttctccagggtctaattcgtctgcagcttcagagactaatgccaagaataatttttcaagcttgctttttcctctgaaacataatttaatcttaggttagttctttataattaacatccttggcaactatgtagacttcagagggaatccaagtcccctatggcacccaacccaaaacctttctgcttaatggtgtttctgttggaaatgctcctgaattccgagcccctagcatatcagggcactcctgcagccactcattgcttggtggtggtggttggggtgtgagtgattgcttgctgcttggtaatgtggatgtgtaaacttgaggaaaaat

SEQ ID NO: 92735 - DNA, 1484 bp, Homo sapiens
agaagagagtagagtgaggggtactgaagatcagaatctgagggaggtgaactctctgtaaccactatcatcttgcaggtatgaaaattattcctgtctatgatagtccttttaaaattgctcagttatgtattttcacacataaaaaaagcatgctgcttgctgttgactctgtggtttcgggatactgacgtgttgttgaaagcacttagagatatttcgtttggttggtagtgaaatgaaggccgttcaaacaggaagcattttggttttcctaagttaccatttgttccttttcccctggactcttgcagatactgcattcatattcctgtcaacttatccatctttccttgtattcacttgttaataaatattatggactacatcaactgtgtgttgggaacgatgctgtatgctggcagtattacagcatccagggtgctgcccttctctttgaggagttactgttgggaatccaacaagaaagtaggcagttgccattcagtgtgaggagtgctaccagggtactgtggtgggagcacgtaggagagaccctgtacccactgagggcccaggagctgatgagaagtgtggttggcactcagggaatacttcccagagggagagactttgaaggagggaccgaaggatagctgcgtcgactgggtgaaggggtggggtggagtgaggtgcccagtgggagaagggtttttttttccttttcagtcgactttcccaggttggacagtagatcggatcttgacagtagagtgggtgcagagctgcgggagcaagtacctcccatggctgagcattcgagcctgtgggggcaggtagaaagccaggttaggaggggtcttgtgagccggctgtggggatgtagggcagggagtcctgacaagagttgtaagcggggggataggatcagacctgtgttctgaaaagattacttttgctgccgcaggggaatgcattaaacaggctctaatctggacgcaacaagcacaggctgtggcagcccacaggagagatgatggcacctgcattacctgtgccaggctccctttctagtagttgtggctctttggggttctgggataatgtgagagaagtctaatctggtaggcagtacttgcagacgattcatccttgaattgcctggtggcatgtctcagaggtgttcattgatagagagctgtatagatcacaagaatgctgccctcagaccagcgttacgtagttttctcccagtttgtgcccctttggggaacattgtcaggagaggcagaataaatcagcttgcccctaaccttttcatcatgagaaaggtctctttcatcttcctcttagaagtgcttattgtattttgatcactacagcaacatggacagcaagtgcctgtccatgccttggatcttagatcccttctgcatgtcaaaagtagatagaatcaactagtgggcaggtgaaaagcactctca

SEQ ID NO: 92736 - DNA, 1214 bp, Homo sapiens
ctactcgggaggctgaggcaggagaatgacgtgaacccaggaggtggagcttgcagtgagccgagaccacgccactgcactccagcctgggcaacagagcaagactcttgtctcaaaaaaaaaaaaaaaaaagatagtattgagttcctgcttgagtggtaattgactctattcactcagcatctcatttctgtaatagagtcaaatatcatcacttttacaaacttttgtgttaataaaaggaaaggcagcaaaaaatatttttaaaaacagaatctaatcattgcccttaacatttggtatattcatttatcattatgtgatctgataatctaaatgtcttctctctgtggattcctcttgtatcttacaaatagatttttaaaatgaattcttatttagctgatctgtagaagtctttatttaaaagcaggcgctcttgagtttgactttagctttaacattctctcacgactggggcatcagtccctctgagctttattttctgatcagtaaaatagggctgatgatacatcttctttgagagggttgttgtatgttcactaagatagtatatgtgaaagtgcctagatgattatgaaggactggtcaaaggcttgctggtttcagttttatttaaagtgcagtggtccagagcaggggatctgaggagttttgatgtttgcatattgccatgttggagctgcttcagaacacttgtggggaaggagtatgttgcaaaaatggcagagaaaagggaacaaaaccgagatatttgaatactttgatactaagtagtttagtaccaaataataatgtacttataggttgctcctggggttatagagaatcctttattgaatgccggaaagttatctctttcttcagttttgctttcttatatgctgatcccaaggagactcaattattaaccaccctgttggttcagtctgttataattccctgtgagggagtgactgtgctgtagtcagggctgttagagtccctctaggactttctggtgtagatgataacaaaatgtagacattttgttttgcagtcagttttgtaaaagttaggaatttgctttgcaaaagcaaagcaaatttgttctggaaaattcgaatttgttttgtaaaagttaggaatttgctgtgacattttgtgggaaatactatactttggttcactgactaacagaagttcctcaggca

SEQ ID NO: 92737 - DNA, 1068 bp, Homo sapiens
tcatctgaggttctaaatagggcaggagcgcccctgccagtcccctttggcacagttctgcgtgcacagcctgtctcctctgagctgttcaaggtggtgactgatgccatatgtttttgcgcagcacttcccaacacgtgtggtgaaggaccaggattttggttttttgttttgtttcgaattttctaatccactgcacgttgatacgtctgtaaaagacaatacaaatgaattactaggaaaatgatcacacatttggttgtcactgcagtgttgaattgcaggtttctaaatgcttcttttcaatttctgcacttatttcctggcctggtaacagtttgcagtctgtcactggggacacactttgagcagctgtagagcactgtgtttgtgttgtgaacttcagtgagtcctttagtccccagagcacatgcagatgagtactgatttgtgcatgtttctggggagggcactattttgtcaaattctcttttattgtattattacagcgtactatacactatagtgtactgggtcatattggaaatgtgttcttttgactccaggtgctgatatcttttccttcctttaaaaatgtatagttttattgtggataaactacattaaaataaatttaaaggaaaaaagtcctcaatgccataatctctttacacgtactgtcacgtactattactgtcttcatgggtgaaaccatattaattctgtgttcatatgttttaagttgtcctcacactgtacttacggttatcttttgcttttcagtttgatgttatattaaacacatctttcacgttgccatgtggtattcatactgacttttttaaaatggtttcttacttgatcatgcaggaggtcttttaattttaccttagttgatgaagtgtcagagtcccatgttatgagccttggaattggtagactgtcagtggctctacttactagctatgtggtggccctgagcaagggaggtaacttgctgagaatgtgacttgcctggcgcgatgctcatgctcttctcttctcctgccttgatcatcttaatttctg

SEQ ID NO: 92738 - DNA, 1017 bp, Homo sapiens
gccagtggtctcagaatatccttcatcctcgatttatgtgatttttttttctcgtgatgttgtttaacttgatcctctaccgtgtattttttctaaaatagaagttaagtctaaagacttaattaagtttagattaaatttggggcaagagtaatgtgcaggctgctgaggtctccaggtcgttgcagtattggagaggggtaaggttgatcccattgttaagtgatgtcgtcattacaaagtacagtttcttgcaaaccagcaactttaagcatgatgttttggacaaaggaatgactgttactatctaataactcgtaagaggttaatcaagagtagaaaagctagccaaataatttatttcataagagagcaggcagaacaagacccgtaggcgccccttctttgtggcttggatctgagtgtggcggatgattgcactccgcttttccttgctttcccacaccttttcctcccgttcaactctttgtgtctggtgcttaatcattgtgggcttaatcatagtttagaaaagctgaaactgtctttcttttttcttttcacttactcattttggagtaattgaagcataatcatgattatggttttgtaatatttttcttataccaaggctgctcagtatattgggaaatggttctgccttcctgccttgttcagggccctgctcctatggctcatcagccacctgtacagtgagcagctgctccatgccggtcagggcacttgaagagacagcacggctctatgacttgggtgtgcatcagattcatgacacggggagcttgtaaagcttacgtgtgtcttgagtcccactccagacctgtggaatcagcatcggtggtttcagaaccatggtagagagaaaagaacaggggcactgggctcaagaaagatccaattcaggcttaatagtggtagaaattacccaacctcggaattctcacctgccttacagggctgttgaagactacctgtactgataagtgtgaaatagcc

SEQ ID NO: 92739 - DNA, 3284 bp, Homo sapiens
atatttcttaagaatattttgatggtccttctcctcagctctaaatgtcatttgaaatgtaacaaaatcctatattgctggttttaatctgtcttctgcttttcatttttcattttaaaacctaagtattttgagagaatagtaaagagttgatcaaataaatgggaaaaatgcattcagtatagctatgtttttaagagttctttgcatttaattcattagaaacttagcatttttagtttaaaaacagatcacttttaaaaaattcccatttgtgatgaagtcgggtggacggcccaccagcctgagcagttcgtgcctaagcgcaagtgcccgtctattccgtgggggctgcctgtgcccaggcacacacgctgcagacagcccctcacagttcagctgcctgttgagtctctggctttctgggctgttactttggttttttaaatttcattttgttaattcctgaagtatgggtcttacttggcttcttttccttttttctctggatctgtcctggagaccagagctgtgttctacatccctgaggccctcacctaattcataggttctggtgactttgtttatgttacagagaagaacataaagaaaagacaggctttcagtctttctaaattcttggaagaattgccctgatgattgcccaggaagtgtctatgctgtctgctttgttggctttgagtttgaaggattttgagggcttttttaaggaagattcatgatcttagaccagaactttctctgctctttttctggcaattcaaactaattgatgttaaaacaatatttatttttaatactacaaatgcatatgtttttattcttaaaaattcataaaacactggtaaagtagaagttatttatccttgacctggctttcatccaaccaaagggaaagactgttagcaatctggatgtatctttccagaccctttaacttctgcatagtttccatcatgtggattattatcacctttgacacctttttgtcattgttgttccgtgccattataattcctttccctttgcttcctggtttcccctcttttccttcctctttcagtgggaacttgagaagaacagcaggtagctgtgtgaatttcactgttagtcttgggttaggacttggccgtgttcttcatcggacacaaaccatcttgtctgtgctctaacactgctctttttcgccgtgggcacttagtccatcctagtgtcagactttgcataatgagttacaaatgcaagagctggcagaaattttcaacatcacttcttgaaatcatcacactgtaattgctacagtaaattttattttggcattttttttgtttcttatgactaaagacttcctcttgactaacacccacgttacttggttttgcctgacttgcttaccttgtttatctttctcatcacctttttccacacccaccttcttagcatctttttcttttactttccttctcttaatttttaaaagataaaacacttttccccaacagttaaaatagaaatggtttagccctaactacatagtaactaacacttaagtatttgtaggatttcattttgtatttcatatccattgtctcacttgatcctcctcgaaaccttgcggtgcaggcatggcagtgttgtcctcattttccatgctggccatctctctcctctgattggtttgttttcttttcttttttcctttcctttcctttcctttttcttttcttcccttctttcccttcttttctttcctttcttccttccttcctttcttttcttcctttctttctttttttttttgggcagaatctcactctgtcgccccaggctggagtgcagtggtgctatcttggctgactataacctccgcctcctgggttcaagcagttttgcctcagcctccctagtagctgggattacagttgcaggccacgatgcccggctaatttttgtgtttttagtagagtcggagtttcaccatgttggtcaggctggtcttaaactcctgacctcaagtcatctccacgcctcagcctcccaaagtgctggtattacaggtgtgagccactgctcccagctgtcttccgatttctttcaatacaagttaagctgggtacacttcacagattatgagagatttttttttaaagttgatgcataattcaaacttcatcttttcttgccatgttgacattatctttaaaatgttgtaatttttcttttttttggacaggtcacttcttctccttaggcctgtttcttcatctataaaatgggattttttgataaattgataagataaattctctaagatttttaagaatttaaattttgtatttgaagtaggctattttatttctttacataggagtagatggttgagttacagcttcagtttgacattgccaaagttgttgttctttaacttttaatacttcgtttttgcttgctatttttagggaaaaatatttacttccttggagccagagcatgaccttaatgatgtttgtctctaccccaactcaggtatgcattctgtagtgaacgttcagtgagacaaataaaaagatgcattctgtagtgaacgttcagtgagacaaataaaaaggctatacttttttaggttttaaacccattttatttcttaagatagaatttggctttgtcagcacaattcttggatatttaacttacttagaagaattaagagcaggaagtggtgtggatgattcagaaaatggcactcttaatgactcagtgctcagcccgcccagctattagtggaacgtggtaacagcatacaggtaggaggcaggtgaagtgctattttagtgtgctctttagctcttttatgtgattagtaatagtgtgtggaaattgagggtagagatttggagaaagctagattgcctgataatacacagatggctcatgaagccataggttttgtaaattctaagttgtatgctattcagcaatttacatgttaggtttcaaaatttaacagtgcattcaaggcaaatctgtgaagaatttcagagtatgggagaaaaatgagaatagtttctactctgagggcagaggtacccagatcatcttgatagagagaagtaaggcagagcgtgagaactcctatcacatttgtgcaaagagtactttgacagcttgctggagagagagagcttttaccctgtgaccaccgagagcggagcagtgagaagattttgctttgcgttgagctggagtgccgagtgagatttggt

SEQ ID NO: 92740 - DNA, 1078 bp, Homo sapiens
cccaagaagtcatagccttgccaccaccatctgtcttgatctactaggactgttcctgattatgtctttcatttttgtttatatctgttgctatgacactgcctggtacataggccctcagtatatatttgttgaacaaattaaattcttatgggctttcattttttgttctttcttagtatgttcagtagctcttacaaattaatcttggggttgaattcataaaatgtatactctaaggattatttaagagatctttctggaaagaatctcaaatctcagcaccttgagtaagggtgttcattgtgttcataacaaagcgatgaagcaaatggctgccattattctcacttagaaatatttcctttgaagataaaatgtctagtttgtttaaacagaaataattttttttcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccgtatgtatttttggttgaaattacttgcttctttatttgcaggtgttccgaatgatcctttcctctccctttccttttttatgtgggttattgggaaagagatactgaatatacatttgggaacttagcgggaggtcagttacttttggatagataatatccatatttagataagatactcatgattgctttccttctgttaagttttcccaattatctagaattggcatgcattttagatgttaagttaggtagagagaaaatagtggtttacaaaagttgatctatgacccgagaaaccccctagatattgagattccctcacaggtgtaggaaaagtcttcagagctactaattatccttccatgcatgttggtattattacatatctcaaattcatacttttcctatttgattttttttttttgagagagtttgctctgtcgcccaggctggagtgcagtgccatgatctcagctcactgtaacctccgcctcccagtttcaagcaatt

SEQ ID NO: 92741 - DNA, 2194 bp, Homo sapiens
ttaaataaattggttataaaatgttcaaaaatcagtgaccttgtcagcactatccagttaaaaaggttataaatggaaaaacattctaataacaacaaaaattgtaaaactcgataagaacatatatgggccaggtgtggtggctcacacctgtaatcccagcactttgggaggccaaggcaggcagatcacttgagatcaggagttcaataccagcctgggcaacatggtgaaaacccatctctacaaaaaaatacaaaaattagctgggagtggtggcacacatctgtagtcccagctactcgggaggctgaagcaggagaattgcttgaaccggaaggtggaggttgcagagagctgagatcatgccactgcactccagcctgggcgacgggagtgaaaccctgtctccaaaaaaaatatgtgaagaaaatgacaaaggaataagtagagaagtatatcactatactgaaagaaatgattaagtatactttgaagagtaagtgactaaagttgctgtgcatatgaggcttcgaggttcccacaggtgccccagcgcagttacaggctcaagctctaggtggcagaagagacctgatgatgccgacagccaacagccaggactctaggtcctgggccaagggcatgtggacgataggattgatagtgatattgtccacttctgactcatcgcctagcactctttccactggagatcattgcttttggtgctgattgtcttggttggtatgtgagaagcatattctagagtcgtggccatagcattcactctgtctttggtactttcagaggctctagggtccccatttgaggattagtcttttattttagctgaacttggctaattttaaagtggaaatggtgtacccatgtccaaacaaaactatgtcttcttaagtatgaaaggggatgtttctataaataccttattctggcttaattaaaatggaagaaagtagattacgttttgtatataaagtgtaactttgattatgaaagtttgaataaaattactatttacttactatttttgagacagggtcttgctctgttgtcccagcagagctccactgcagcgcagtggaatgatcacagctcactgcagccttgacctcccaggctcaagcagtctcttgcctcagccacccaagtagctgggacaacaggtgtgtgccaccacaactggctattttttttttttttaattttttgtagagatggtgtctcactgtgttacccaagctggtcttgaattcttggcctcaagaaatcctcccacctcagcctcccaaagtgctggtattacaggtgcgagtcatcttaccaggctgcagttaccttttaaacagaagcctagaaatgtgattcctcccccccccccccattagatttgaagtgaagactaataatgaacttgttacttggaaggaggtttggccgtatattcatgaagcatgaatattttgcttttcaggataaacagtttaccaacaatctctgctttgaaatttaatggtgccttgaccatggcagttggaacaaccacagggcaggtaaatatgtttaatttggaaaccacatgtaagttggtatttcagtggtgtgtgtatgtgtcatgagaaatacactgcaggaacagaaaatgagatcatactattttagccagaccagagggtattccagaatgctggattcttccacaccttgagaaatcttgactcttgccttggtcagtctgcagtgctgtggacttagagctgcagtgggataggcctgcaccaccacacctggctaattttttgactttttgtagagacagggtctcactgtgttgcccaagctggtcttgaactcctgggctcaggcgatccccccacccttggcctcacaaagtgtggggattacaggcgtgagccaccgggcttggccataggtattctcttgttagtggtttggaacagcatttttcagagtctatgcaacagaattctgtggtcagacagtcttgggagtctgccagacttttactcttgaagattgacagtgggtttcaatactgttttaatgaaggctctcaggaattcttgcagacaagaaatatgtttaataaatatttccaaaatttgtgtgttcaaggaacttttttttttttaatatagcatcattaactata

SEQ ID NO: 92742 - DNA, 1067 bp, Homo sapiens
cagactagtctcaaactcctggcttcaggtgatcagcccgcctcggcctcccaaagtgctgggattacaggcatgagccaccatgccccgccttctacagcttttatttaaaattgtttttcatttgcatagggtagagtggagtgctgggacccaagaactcgaaacagagttggcctgttagactgcgccttaaacagtgtcacagcagattcagagtaagtagaaattaatttgcaatgtaaatgttcatcaacttttaatttaagtaatgtgtctatattaaattcaaataaattgctacaggatatctgaaattgtactttccatgattgtttttcataaagatcctctcctgtaaaagctcactagtgagtaagccagatagaatttctttccaaaatactatacagaaggccttatttctttagttgctgtacgattttattaaaacaattacactacaggaatttgtattccaattttgtagaatctagtgatagaaccaggagtccaccacaaagtccacagaggtgtgctttgaattctaaggtggaaggaagcaagtgtttttttaatattttcttgttcctgtttgcctaatttctacatttaaaccaatcagaagagttttcactattatacatccatttacagttttatgattatttcctgagaaatgatacctagaacctgaatttctggattaaatagcatacatgttttgaaggtttttggtacattgctaaattgccctacagaaaacataacctcaggttaaatgtctccctgcatgcccagagcatacattgctcactctcctcagcctgggacgtccatcacagcactgctaataataagtcttagaaagagcctgaggatattgattaaataaagcttagtagaaatagtagctgacagatagtgctttctatttgccaggtactgggtctaagttctttacatatattaacttatttaatacgacagccctttgctgtaggcactgttattgtatttattttatagatgaaaaaaatattcgtcaatggcatacatgttactca

SEQ ID NO: 92743 - DNA, 1015 bp, Homo sapiens
aaaaaattagccgggtgtagtgagtggcgcccgtgagctgagattgcgctattgcactccagcctgggcaataagagcaaaaccccatatcaaaaacaaaaaaacaaaaaaaaagaaaaaattcagccataattacaccacccagagaggatccttattatatttccttctagtcctttcttatatacatatgtagatacattacatatacttttggatcttgtattctccatcttatttgtaaatagtattctacgtaatgacttcatatttccttggcacatgaatggtttaaatcacttttatacatgaacaaattcataaagtggatatttttcagatttagaatacgtttttgtatcagtgttacaaaaggaagtggtggcttatgagtaatatatatatttataaaatttatatttacttaaagtttcattgtagtttagcaggtttttaactttctttattactttacagttctgaagtttataggttaaacttagaacaaggacgatacctgaatcctctacaaactgatgctgcgtgagtagttttagtaattctgctatatacattttgaccaggaggtggagccagatgctcagtttgttaacaagtaacataaactattgcaattaagcaaaactcccagcaacttagttaaaaagtactgttgaatttattctcagacaaaaaattcactgaaagatctggtgattactttaaaaattaaatgaaagctttttttcatctactcaactttaagtcagttaaaaatactcagtttattattattacttgtagtgttctttaaatttacattcatggttttgttttgtgatattttctcctgtggagaacttttgaattaatttggagtgccatttttaaatttttatgctctgctagcggacatttaaggtttttaaaggtttccttttatcatacattatagtctacacatatgtactatgcagcaaaaatttttaggaatgaatccatcatcatcatcatc

SEQ ID NO: 92744 - DNA, 1094 bp, Homo sapiens
tggtctcaagctccctacctcaggtgacccacccgccttgtcctcccaaagtgctgggattacaggtgtgagccaccatgcccggccaggattatttaaatgtgttcccaagtgaaagagggaactgatcattgagggtaccatgagagtgctctatgttatgacatgctggtgccatgtaaatgaagggcgtttgtttcaagtctttaattagtatgtaaggtttgcagaaaagctatcaggatacaggaaggcattaaggagccgatggagtgttttcattcttaatcccagtggagtgtgtgtgcatggacatgtgtgtttagatacagaaagtgagagagaggtaagggttttccttggtttgccagttttttagcgataatgaagtaaacacctaactagaaacctaagcaaactaatttttttgttttattttcagattgtcttcttacataatgatagatacattgaatttcattcgcaatcaggtttttactacaaaaccagaataccaaagtttgggagagatttctcttaccactatccatcctgtgacttgtactttgttggtgcaaggtattggatccagtccctttttctccttttcacctcctaaaacaaccaacttctgttcctaaatttcgtgtacattttctctgtttaggtaacttgctttaataaaaaagtgatacgtggctcttgtaaaaaaaaaaaaaaaaagaaaagaaaacacaggataggcaaaaaattctattttctacatattggtttacttataagtaccatatactgttttaacaactgttgttttgcttaatacaatattttctaatgttaaaaatatctgtgatagttatgtgcctcattgggaaatactgatgggaagtgtgtgagccttttcagtttagcccggttgccacaatttatgagacatagtattgttttatttatctgtttatcttctagacttttgtctcgaccttaagtttgcttcatgtcagtaatcagtttctatctgatcactttgtgattaataggtcatatgtggttatggactctagtttaaaaaaattgggagagggttttattgt

SEQ ID NO: 92745 - DNA, 1543 bp, Homo sapiens
tactttttagaaacaggatctttttctgtcacccaggctggagtgcagtgttatgatcacagctcactgcagcctcaactacccaggctcaagagatcctcctacctccgcctcccaaatagctgggatcacaggcatgcaccaccatgtctggctaattttttttctgtttttttttttctttcccatagtgatagggtcttactatatctttgtttattgaaaacaatagaaactctgtgtgccactaataatggctatttttcgctctttttctttatcaggtagactatgaatgggtaaaaaatgacatcttttttgttaagcaacaatttttttgttctttaatgtatatttgaaagtctttaaaattattttgttttcaacatctcagagtgtcagaatttagaagtcattatattttgtgaatttgcattcagttctacaagaaatctagttgatgtgtattgagaaattatgaggcttttaagtttttgttggtgttttgggacaatatactatgacaattttcttcttgtttcacgtagaggcagaaaaaaactggtatgtatataatttctgtgttgaattagaatctttgcatcaggtttgcgttgttactaagaatattgtttgataattgtatttttcctatttcttgtttttcagttgtcacctttgaaattttgtctgatgactactcaaaggtatgttttatagcattggtttgtactgactagacccaagaaatgagtgagtggaatttattttaatgataagcagttttataatatttttattgttaaactaaaatggctgtgtagttctattgttaaacaaaaatggctgtgtagtaaaatgtaacccatcattttttattaatattaatacagtgatacggatagcctttggccaatctaatatcaaaggtaatttttcatatcgtatatgaaaccttatttgtatttttaagaattggcagcagtcatcttttatatcatcctgtattctagatttgtgattctgattattacgtttaacctagatttatttgccaggttgctttcattttcttatttatatgtgaaatgtaaactagcagggttgtgtgtttaatttttttttaactttgcaaatggttgtggtatattctgaaacagttcaaaatatagctaagtagatttatttctcttttttggtgccattagtccatctttcaactctttttttttggagacagggccttgctctgtcacccaggccggaggggcagtggcgtaatttcagctcattgcagcatcagcctcccgagttcaagtgattctcctgcctctgcctcctgagtagctggaactacaggcatgtgcttccacacctggctaatttttgtgtttttagtggagatatggttttaccaggttggccaggctggtctcaaactcttgacctcaagtgatccacctgacttggcctcccaaagtgttgggattacaggcgtgagcaactgcccccgacccatctttcaactcttataatcactttc

SEQ ID NO: 92746 - DNA, 1396 bp, Homo sapiens
ctccagcactcacctgtgctccccctgtacttttactttatagtacgttttggcagctttccatgtcaatggttactactgaggtctgcctcatccactttatgggctatgtaatattcccttgtgtggatttattgtcatttattcaactattttcctgtcagtggacattttattgctttcagttgctgaccatttataaataatgctgcagtgaacattcttaatatctttggcaggcttgtggatatatttctgtgagttcaatttatgtaagttgaaatatagattgaaagtatggaaacatcgtgtgtttttagggattgtccttcaaagaagttgtatcaattgtatactaatcaacaacagtataggggaatattttatactttcaccaacacagatattaaccgttttttaatctttgccattctggtggacaaaactgtttcattgtttgcatgtattttgttagattacttgtaggtttcttagttattttgtttggttttctatgacttgcttgtttagcttttgctcagtttttccttggggtgtttgagaggggctgcttttacattcctttcttttgatttggttacaattaatcctgcctgtctctgaacaagaagtacactcaatgtatctggatgttttgactatgaaagtatgtctttaggttttacatcacattaattttttgtaggaacatataaacctcgggttcgatgttatgacacctatcaattatccttgaagtttgaaaggtgtttagattcagaaggtgagtaaaaagctaaatttgaattcatgaaaatggctttttatgttgtctgcttttctggttttaaaatgagaatggtttgtaattagttttttattgctgtataacaaattactgtactacaatcccgatggcttaaaacatccatttagtagctcacagttgtgtagatcttaagtctatgcaggttctgtgctcagacaggaggtcagggtgttgaccaggtggagctctgacttggaggtgctgggcaagaatatgcttccacgtgttagtttgtagttcttttagaattgactggcagcttttcttgttttcagagaatgcaccccccccaaacccccaaaataataaaaaataaaaaagaatttgcttccaaatacactcaggttgttgtcagaattcagtttgttgtggttataggattgtggttcccatttccttctggctgtcagctgggggccactctaggcttctagaggctgcatgcatttctcatcacacactcacctccaccttcaagccagcaacagctcatcagatcctccctgtatttcttttctttcttttatttatttatttattacttttttaaagagatagggtcttgtt

SEQ ID NO: 92747 - DNA, 1051 bp, Homo sapiens
ttgtttttggggctttaattttttttagagacagggtctcgctgttgcccaggttggagcacagtggtgcaatcatagctcactgtaacctcaaactgctaggctcaggcaatcctcctgcctctgcctcgtgagtagctgacactacaggtgcacaccaccactttcagctaattttttttttattttttgtagggacaggatcttgctgtgttgctcaagctggtcttgaactcctggcctcaattaatcctcctgcctcagcctcccaaagtgcagggattataggcatgagctactgtgtaccctgctgttttttattgctatgttctttgaaaggcttacaagtattactttggccactaggggaaaaaagtggtaaaaaaaaaaaaaaacactaataaaagtagagcctctatttcttatctttcatccccaagtaacagaaaaaattaacacaaccactaaggataggtttgaatctggcatgatcataaacccaatgcttccaaaaggaatcaagaggccagtcacttccgtaacaaatcaatactttgcacatcccctgagttcattcccttagataatctatttccccaaccagaatgaaaggtcttcagggccaatcttactcaactttttagccacaaggcctagaacaccaaagggaatctgagaaagaagtagggatagataccgagattgaaagaaaaacctctaccaaattaaatggagaagcaagtgacattccaactccatttcccctaccaataccagaaaaaggcctctaggaaagtcaaaccaggactctggactctacaattgtgctgtccaatatggcagccactagtaatgtgaggctaagttaaaatgaattaaaatcaaattaaatttaagattccagctgggtgccgtggctcatgcttataatcccagcactttgagagacaggcggacaactgcttgagtccaggagtttgagaccaatgtgggcaaaatactgagaccccatctccatttaaaaaatattttttttggccgggtgcggtgg

SEQ ID NO: 92748 - DNA, 1102 bp, Homo sapiens
ggtttttggctgttactaataaagcactatgaacaatcgtatagaagtctgttttgtgggtataagctttcatgtctttggtgaatacctaggagtggaatttttgagtcctaggtaggtgtatgtttagtgttctgggaaacttctaagtcgttccccaaagtgatcatatcatttgcactcctactaacaatgaatgagagttttaggaaaggtcacttataacatgattttctgtataatgtactaatttttaaaaatatctctaagattttacattaacagtatttatcgttatcaaaaaatcatgaaatgtagaaaacttttagtgtgttggagtgttgaacagtatcacccaacctttagtggttgtgattttggcgcgtaagtcctgtatattgtccaaacattttttgctgataacagtattccttttccaaccactttctttttggtaataccttttatacatacacaggccagtctcttttgctttgtgttaatgattatctcagtactaactaacactatctacatctcttagccttcagttttatgttcagaaactggtaaaaagaattgaggaaatctaagatacatggacacccttactgaagactagaagaaactcaaattttcttcattttatagatccagagatattaagtgacttgtctaggctcacagatctagtacttaagaaagctaggatatagatttgttaaatgacactttcttttatgaaatcgtcctctattcccatgcaaaattaatggttccttttctccttctcctccctctccctctccctcttctccctctccctcttctccctctccctcttctccctctccctcttctccctctccctcttctccctcttctccctcttctccttcttctccttcttctccttcttttttaagagtctcactctgtcacccagtctggagtgcagtggcatgattttggctgactgcaacctccgccttccgggttcaagcgattctcctgtgtcagtctcctgagtagctgggactacaggtgctcgccaccacacccggctaatgtctgtatttttttagtagagacagggtttcac

SEQ ID NO: 92749 - DNA, 1180 bp, Homo sapiens
gcccagtgcggtggctcactcctgcaatcccagaagtttgggaggctgaagtgtgaggattgcttggccctagaagtttgagaccagcctgggcaacgtggcgaaaccccatctctacaaaaaatacaaaaatacctgggtgcagtggcatgcgcctgtagtcctagctatttgggggggctgaggtgtgaggatcgcttcagcccgggaggttgaggctgcagtgagccatgattgtgccactgcactccagtctgggtgacagagtgagaccctgtctcaaaaaaaaaaaaaaaaaagtggtttaatgtttatgctcttcctcctgtaacactggatgtttgatacactgttgtggaaaattttttttcaattaatgatgctactttttttattcttgaaaagtaaaaatgaaatacttagcttagaaaaacaacgtatgagctaaggaaaaaacctctgctgtttaatggttgggctgtgctggtgacctttcccaaggccaggaagcatttgggatgaatttcacctgtttatagttgtggtgactgcttggtacccatttgtcttcttatgatagagaataagcacatgttagttaaactagttgtttttttctctctttttagatgtccgtaggagaattgaacttattcaggactttgaaatgcctactgtgtgtaccactattaaggtgtcaaaagatggacagtacattttagcaactggtaagcatctttttggttatgattttcatgcattttgtaccaggaaatgctgcgatgggaaaggtctttttttttttaaccctaatattttattataaaaaatttcaaacacacagaaatattgaaaaaattgtatagtaaacacccatttaactactacctaaattctgcaataaatagtttactctgcagtatttgatttatcccatgcatctgtctctttgttcatgtatcagtccatcttgtttctttgatgcatttcagtgtaagttgaagataccagtatacttcaccctgaaacacttcagcaagtatatcattagctggagttcaatatttatcagtatttacttatagcctttttcaaggtaaaaacatttatattggtgaaatgcacagatcctaagtttaccatttggttagttttgacaaatgcacacgcttgtgtaact

SEQ ID NO: 92750 - DNA, 1386 bp, Homo sapiens
acccgtgggccttttaagaggttcttctctgaagacccttcatcttccttatcacaagtttaagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacgaaggtcagggtaggagtcagactgaggagaacctggattgtagcaggagtagctccagagagtcgctcttccataaaatgagatgttgaccttccagggtgtccccttctgcagatctaacagtggctttctgtcgtctcccagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttga

SEQ ID NO: 92751 - DNA, 1141 bp, Homo sapiens
cctcctgccttagcctcctgcgtagctgggactacaggcgcacgccaccatgcccggctaatttttgtgattttagtagagatggggtttgcaccatattggtcaggctggtctcgaactcctgacctcaggtgatccacctatcttggcctcccaaagtgctgggatcacaggcgtgagccaccgtgcccagcctccttcctatttatctttttgcttcttgtcctcagtatccattgctttccccaggtacctagcgccccctgttgtccctctctcgatgaccttgctcctcctccattagtccagcaaatgtttattagatgcctacagaacgcgagaacatgcttaataacccaaatgatattggtgggatttcaggtaaaaagggaaaatccatatagaaactcatcttttgtttttatttgtcattctacgaaatatctgaagcgtgatcttttgttctctaagatcttctagttagatcgtaagcaatttaaaagacatatttgccctaaaaaccagtctggttttctaggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcaggtaatttgttttcttaggttgtttgttgttttgtctgtttgtttggttctgttgtaggtttatatttggaactaggtatatataagccaggtaataaatggaatttaaaatgcaaactaattccagagaattgaatgtttatacattagagtttttaaattgtctccctgttcgttcttttttccatggaatactctgcttgcgggatgaggagaaagcattgctaccctcgggccgccctgtgtgccattctgtgcatctggccctgggctctttctcattctcataaaggtctcatatgggctagaggcagccctgtctgtccatcctcaccctcatatgcattgtaatcttgaccttggggaaatgtggtttccatttctgggcacttggctttggaatgtagttatttatttgaaaatgggcgtacttaagttactccaa

SEQ ID NO: 92752 - DNA, 5487 bp, Homo sapiens
aaacttaagaagagaaatcgggctggacacggtggctcacacttgtgatcccagcactttgagaggctgaggtgggcggatcacttgaggtcaggagtttgtgaccagcctggccgacatggtgaaatcctgtctctactaaaaatacaaaaattagccagaaatcactcgaacccgggaggcggaggttgcagtgacctgagatggtgccactgtactccagcctgggcaacagggtgagactccatctcaaaaaataataataataaataaaaaaggaaaaggaattggttttccaagtgttaagtttagtgcaaaatgcattgtggggagaaagtgtgttctgtcagagatacacgtgtcagaactgtgtcacacctggtgaagccgacagtgaggtaaagacacagtcttgggccgggccagatgaggcacttgctgaaggccgggctgaggaccgcctaccttccgtctcctgtaggtggcagaactggtgaagccattgtagatgctgcgctgagtgctctgcgccagctcgtgaaggatcgcctcgggggacggagcggaggatacagttctggaaaacaagtaagaccataaaatgtcagtttttaatgtgtcataattttgaagccagagtggataccttgtataagatagttgttttttaacagtatgttaaagtggtgaactctcaattaaagaataatagaggattggatccaccgatcccagagggaaccagccctccagcctgctcatttggcctcctcagaattgctgttgccaaagccagtcagtcccagggcctcttgccacacctgcagtccaagtaccaggcccaggagccacgtgctggcatcccatggcacttgtaggtccagagtggggatgggatggacgggttttcctctaggtaggctttggcaaaccgtgatgagattggattacctcttggcctgtatctgtggcagtcagccccaaatccatggaaaattctacacaaatggatagggaagaagagagagagagaggagcagattggtgttttagatgcccttatgtgaaatgtgaagcttacactgatgttcttgtgaaaagacaaacttgaagatctatcaatattaaatgggcttttacttttaggagaccagttacactagcttctttatacaggctcagagcttacccagagatttcatgctcttgccttttattttaaacttagacatttaatgagcatagttgcctggccccctgcaccctgcctggcaacagaaagcaatgctgactgcttcttagatttagtactgaagaacattcttcgaaaaaagaaaaggattaagtgttatttttagctctgttgactggtagggactttgtctatgaaagatgtaacataacatcctaggatgaagcagcagctgtacttgagtctgaattagaacagtgttgttcaggtggttttttgagccatgttgaggtttctctctaaaaatagctggtgacagcattcaggtacaggttatgtgttgtactgaatgtattgataattacttgaaagtaaaagactatttgccaagcaaaaattacagtgctgaggaatgtacccaatttgaatacaaccgttttcactattttattcactaaagaaaaaccctaaaactttgttaagatgtagcagtagtgttattatttaaaacaggaaaagtgttcttcttggcccaattgtttgatgtttaatgtcataaatgacagggcagaagtgatagttcaagtaagaaggatgtgattgagctgacagacgacagctttgataagaatgttctggacagtgaagatgtttggatggttgagttctatgctccttggtgtggacactgcaaaaagtaagtgccttctactaagtagtctgttcattcacagtgttttcagtacattcattagcttattttgaaagagctgaagtagataatagatcaccactaagatctcttccagcaaaactctgactctaagtgaatattaaacattgacattagcgccaagagcttccactctcctattgccaaagattaacaagggactggctcatgtctggatttaggggcagtggtggaatgggaagctcatgtgaagggtagcattgtatctttagtaaagccacacacaaaatgttttctaggtgtgacataattggggattgggcagaaatgcacagatcagttaaaaagtataggctaggcatggtggctcacacctgtaatcctagctctttgggaggccgaggcaggcggatcacttgaggtcaggactttgagaccagcctgggcaacatagcaaaaccccatgtctactaaaaatacaaaaaaattggctgggtgtggtggcgtgtgcctgtagtcccagctacttgggaggttgaggtgcaagaatctcttgattgtgggaggcagaggctacagtgagccaagctcacaccactgcgctccatcctggataatagaaggagactctgtcttaaaaaaaaaaagaaaagaaaagaaaggtgtttgggctgcaagttaaaatgcaagtatttggcctggtgaggtggatcacttgaggccaggagtttgagaccagcctgggcaacatggggaaaccctatctctactaaaaatgtagaaattaacagtgggtggtggcacacacctgtagtcccagctatgttggaggctgaaatgagatcacctgagcccaggagattgaggctgcagggagccatgattgcaccactgcactccagcctgggcaacagagagagactgtgtctcaaagaaacaaaacaaaacgaatatttttctatagcctagagccagagtgggctgccgcagcttcagaagtaaaagagcagacgaaaggaaaagtgaaactggcagctgtggatgctacagtcaatcaggttctggcctcccgatacggggtgagtatacttataaggctcatttcattgtgaaatacatggtgtttcgttacttcttccaatactccaggcctccctatgaggtagtaaaggagatgtttaaaccattttgtaagtgaagagataaagtcactttattgtcataactaacaagtctgaaactcaggactgtcaacttttccccctaatgtcacactgcttctggtatatacttaatgtgaggtttcagcttgcccagacttattcaagttgctcatatggctgttgtgagttggtccatttgttctagggcaggtactttgtgttaattatataccagggcttgaatatgattggctaaacttcacagactgttaaaactccctgattgataattgacctctgtgagtcattcctttgaaatctgtgcagtctggagaacagttttgttacattaaattacctataaggccagagtggtggctcacacctgtaatcccaacactttgggaggccaaggatcacttgaggccaggatttcaaaaccagcctggccaacatggtgaaaccccgtctctattaaaaatacaaatattagccgggtgtggtggtgtgtgcctgcagtcccagctactcaggaggctgaagtaggagaattgcttgaacccaggaggcagaggttgcagtgagctgagattgcacctgtgctctccagcctgggcaacagagtgagactgcttcaaaaaaaaaaaaaaaaaattacctataaggtggttttagaaactgtaaagattgtgttattttgcattaagtgttaattggattttatcctctgacctttttttaatagattagaggatttcctacaatcaagatatttcagaaaggcgagtctcctgtggattatgacggtgggcggacaagatccgacatcgtgtcccgggcccttgatttgttttctgataacgccccacctcctgagctgcttgaggtaaaccacttcaactgcttgtagtccagaaagcttttttagctgatggtgaggaatgttaaagcagtgtgacacactgttcattttatgcccttaaagatactctctttaaagtggtttctatactttgaaatggaaaaaaagtctgataaattgcttttcataacttttagcattagaataattacactgaacagaaatacgagcttcttaaagatagagtgtattcaatcactcttgcttatcattctcaaagtaatagaacatttatcaagtactaatcatgtaacaggcaccgttctggtgtctttgtatagttttgttttgttttgttttgttttcatttaattctcacatgaacactgagaggtagatactgtttttaatctccattttatatatggggaaattgaggcacagagcctcaagtgtgtataaacatataagacatataatacatgtaagtataatctatttaaacaagtaagtggcagagccaggctgtgtccaggcattgcgatttcagagatgtttgtatgtgtgctaatcaccccacctccaccaccacagcttccacaggcttaagaatcagtagcagaaaaatctcctcttagagaacatgcctccaggtgtttccatacgaggaagtagtcgtgggagaaatgttttcaatgaaagtgacggtgcgaaggtcttgtttgccagcttacctttaggtgttgtatcatgcagcctcctgattgtcccttgtcttttgggtcccacagattatcaacgaggacattgccaagaggacgtgtgaggagcaccagctctgtgttgtggctgtgctgccccatatccttgatactggtaagacagacggaaatgatttcccttagctgttctatgctagatgctctgagaatactttctaaatggattaattttatggactcctttatctttacctttaaaaaactttgtctatttaaatcaggagctgcaggcagaaattcttatctggaagttcttctgaagttggcagacaaatacaaaaagaaaatgtgggggtaagttactgagcttactgtctgagtgtcatctgaacagctgattataggctttcttgagagtggttcccccgtgtttttgtaagctgtgttctatgtttgctctgctatatgttttttttttttttccctcctgcctcagcctcccaagtagctgggattataggcgcccgccaccacacccagctaatttttgtatttttagtagggtcagggtttcaccatgttgtctaggctggtctcaaaactcctgacctcaagtgatccacctgcctccacctcccaaagtcctgggattacaggtgtaagccaccgcacccggcctgctctgctatatgtttttattcaggatgtgaaaactttatcatgggaggaaaagaaggaatgaagggctgtcagcacagcatgcatttttctcataggaatcatgttttacatggtgattggagtgccaggttagcaggcagacacataaggagtagtgcacctgaattctactg

SEQ ID NO: 92753 - DNA, 1711 bp, Homo sapiens
gtaagtaataaaatggtgagttcatccaggttgctgatcctattttacttatttatttttatttttattttttgagacagaatctcactctgttgcccaggctggagtgtagcggcatgatctcagctcttgcaacctctgcctcctgggttcacgtgattcttgtgcctcagcctccccagtagctaggattacaagcgtgcaccaccacgcctggctaatttttgtatttttattagagacggggtttcaccatgttagccaggctggtctcaaactcctgacctcaagtgatcctccctcctcggcctcccaaagtactggagattacaggcgtgagacaccgtgcccggccttgatcctgttttatttgtgcttgtcctctttgcaggcatctcattcaatagaccattgatggggttttttaattgaatttttgaattttttgaattgagaatcaaaggctttaatggttgctttgtgttgtcttcccccaaaaggtgtggtcactgtcaaagattaacaccagaatggaagaaagcagcaactgcattaaaagtaagtttcttaggaatgcaaaaggcttacaaaacttttttttacagtaagtttctaagatgtccatattcacctgtgtatgtttaagtaataagtatgcagatggtttaatgttcaatgggaagctagtttgcatatcagagttgaaaatactggttctgttgtcaaaatcatactgagaacaaggggataatacacatttaaatgtttacattgcctgtttttgtttattgtttttcccagataaatgacagttactctcagccctgccaattctgtgagctgcagagttccctccatgggctttgatttcccccatcattccatttagattctcttctggtgttcaaggctaaagcccttattgactgattgcaaactgcaccctgtgctttattacctttttctgagtctatgtgaagcagataatgagttcttgtggagtctgctttagcggaaggaaaaattgttatttcttttacatttccacaggatgttgtcaaagttggtgcagttgatgcagataagcatcattccctaggaggtcagtatggtgttcagggatttcctaccattaagatttttggatccaacaaaaacagaccagaagattaccaaggtaaggacttttcctagctacttcattcccctggtagacaagaacctactgttctttaacaagcttgagaacctgctctacctgcaaggttctcaacctcattgtacctgaattatctataaatggtacacagtgattcctataccctccgagtcattctgaagatgaaatatgtgtcacacaggtttgtctcatcacttaacgcttgcttaggtctatgctacattggcaatgatagaaaatagtgttctgtgctaccctgttgtctttctcattacagtcacttgtatttaataaagatctacatgtattttcttgctctaatctctcttccctttactgtaggaaaagggtctaacataacactatggaaaaggagactgtaatttgagagtcttagtctcctaaactgtcaataataaatggataccacaaattctgttttgtagataagtaaattgttagtgtctgctgtgagccactgaggcaactaaagaaagaattcaggtttcaccctcccaagactaaatgtta

SEQ ID NO: 92754 - DNA, 1690 bp, Homo sapiens
cacaatctagtggaagagacaataattattttcccttcaaaaatatatttgaataaagataatgtgctaataattgcaactgaataacatgaggaatgattactacgtgattgcccagggttacacaggcagaagtgacctcccaatttttcagcgtccatgccataaaatgacagtagtactgcctcatggagcggttgtaaagaacaaagacgttgatacatgaaagccactaagaataatgcttcagcctttttccagtgcagcccaaggagtgggagtggggaccgtccgttcctttcttgctcagcgttgcagcaatgggagtgaaattccaggggctccaactgcagcaggaagggcagaggggccagagctaggccgtcctcctgtgtgaagggccctggtcagttaaagaggactctggttccccagggtttccagtcaaagcatgaacagtgctgttaatggtgcacttttgtttttatcttcaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtaagtattataaaatagttgtagattatttatagtactttctgaaattggagaaaacgctgtataaaaatctgattttattaagacatctagtttagcttagtgtttgtttaaaagaagtagagaagagggaaatgggaaatgcaaagtatctagtctgttgttaaggaagatctgtcttttgatgaggtgatgcgtgtggaaggaaaactgcttttatgaggaaggaatcttgagcaaagaaaatggaggggccagtgattaacttcactctgtttcttgaagagaattatttcctgaaaaaatgtagttagaaaatctggtttaatttaaaaattcttttcttaccttacattcaatgctggaagaacccttgtggggtaaaaatgtaatcaccattgaaactaacagcacaaaattatatacagtcaaaagtacaacattgcactagttatttgtgtgattaaagcatttaatgcaaaaaaacaccaaatagaagagtggaaactgtgcaagatgtatatgaggctgtctctgctgtaaaccagcaggccacaagtatcctgagaggagaaccaaaccctagccagctgtgtgtctgtgaagaactgtgtggttatctgaaatcccaaggagtcctttgacatgtgaacaaggctttgtaagcttaagtgagggatattagaacctgatgggtacattttagggtatgcctgatgaaactttttcctttctcactttaacttttttctttgaaactaagttttagaaactaaccaccagtcctcatggaccattttacttcatgctcagtgtagcaaatggaggtaaaaacgctctattttcaaagtggatgttgccacattgtgcgtcctgtccatctaatgcctttactgttttaaaggctctggtatatatgtgttcagtccaaatgctaattctgtgtggattagctcaattatactagcaaatacataaatagtaattgtacaaactgttgtattgttaaacgtctctgtatgtggtttttacaagcttatcatatatggcatag

SEQ ID NO: 92755 - DNA, 1061 bp, Homo sapiens
gtgtccacggaatattcgtcgggcacaagaggaattccctgtcagctcccaggaccgtgggtgccctgaggccgagtcacgctcccccgggataaagagggtgggggcgcacacaggcaaggaggaggcggggtgggggggtgcagaataaggaactaaggtaaaaacgcccagtactggactcccctccgagcagcaccccgagagggcccggaggagctgaggcggtgcgagccgagactgccagccccgcccccagcaggccccgccttccgctgctcgccaccgcccccgtgaaaaaaaaccaaaccggtaacctctacccggccgcctcccattggatatgtgagtgagcgatgtccgcccggaccaatgagccgcagccacggcttggcgagcgccttccggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtaggtgcgggccagcggagggaggcgggcgagctggggtcggcctgaaaggtttcgaatctctaggccgttccccggcgggccgcggccgcaggcggccggaagtgggcctggcgggcgggaggcgcgggcctcggcgtccggaggagctgctaggttgccccggcggaggtgcgggtgcgcgggagactcgggcgcccgtggggaggggcttccgcagccgcggggggcgggagcctcgtgcgctggagccgggcgcggggtccagggccgggcgggagagccgcggagcccagccccggccggatcccggggagggggtctgtattcccggagagtcgcaggggagcttgttccgggctcttctcgaactcgtgcgtggggacggaggttggcgggcgtcctgcactgctgcttgtttctgccacctgctttatgcagctcctacttttaaaaactgaaatgttaagccgggcgcggtggctcacacctgtaatc

SEQ ID NO: 92756 - DNA, 1062 bp, Homo sapiens
gggcggctcccggcggcggctaaactatcgggtggcaagaacgcggaaatgcgaagcagctgctggtggagcccgcaggccagggtgggactgtcgcccggggcggggctaggaggggaggggcggggcgaggaggggcggggcgaggcgaggttggccacgggattgggctaggtgaggccgaccgggagggggcgaatctgggggcggggcgagatgagggtagtccgaggactgagcgagcccgggcgggcccgtaggcgaggcgagatgaggctggccagggggcggggcgggcccgggcgggaggggcggggcggggcgggcccgggcgggaggggcggggcgggcccgggggcggggtgcgtccaggggaggggcggagcgaggcgggtccggggcctggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcagggtaaggcccggggcggccggggctgcctcctgccccctcgcagctgctgccggctgggagcccaggagagcctcggctcgaagtagggcggggatgatccccgcgcgccggcgtcgcagctgggcggccgagggtgaactagggagcctaggggctcggggtgctcttcccacggccacccgccacccgcgtacattgtttctcaccaagccccgcgtggcacgaattgattgcgcacgcccattttacagatgagaaaacagacccagcggaggcagcccttggtgcgctagtgacaaaacctgctggccctgagcaaggccatttgcacctcgaggctgtcatattcattgtccctaaactcaccacgcacc

SEQ ID NO: 92757 - DNA, 1037 bp, Homo sapiens
agctgccggggtcagtgggagcccaacatggcaggcaggccagaagcgtgggcccagaaggcccagtctcatattcttgctcagggatttgccttctgtaaaaatcctttgtaagcgaccatctcaaggcactctatagagatcgtgggtattgcactgtggcccggtgcccagtaagttctggatgctccaaaaattgtacagatgattcaactgaattccatctattttgttctaaaccttcctctttgacactggcgtgtccacacccccactgcaaggattcggcaaactgacctcagtgttctggtgcctgccaggccccgacagctgcgttttggggcagccgtgtggacatgtgcccttctctctccagattcctggtgtttctgcggtaccagtgttactatgggtatccgccgctgacctacctggagtaccccatcctcatcgcgcaaggtaacagccccttccctgtccagcggactgccacgggtctccccttcccccctcactcggagcctctctctttcagatgtcatcctcctgctctgtatctttcattttaacgggaacgtgaagcaggccactccttacatcgctgtgtatcctttctgaatctgagccagaagtgggaacggggatgttatttgtgaatggtatgcattgtgaagcaggctcctttaccagatgtgtattttttggttaaactaaaaaaaaaaaaaaaaaaaatcccaaatgcaaacgtgtccatgtacaccagagatgccctcagtacagcccctgctgctcctccgagaccagcatgccctgggcggtgccagcaggccgagtggaaggcagatcggtagagtccacccctgctaagagcagcatcgtccaactgcattagttcatgtgagacatttcttcctgccctgataatgtcctccgaggattggaagcaataataatgagagtatccggcgcctctcaagacgttagcttagaggctaaaccttgaggtctgaggggcagttgttggcccagaggcttgc

SEQ ID NO: 92758 - DNA, 1106 bp, Homo sapiens
cgagatcccgccactgcactccagcctgggcgacagagcgagactccgtctcaaaaaaaaaaaaaaaaaaaaagttattcccaggccgggcgcggtggcacacgcctgtaatcccagcactttgggaggctgaggtgggcggatcacctgaggtcaggagtttgagaccagcctggccaacatggtgaaaccccatctctactaaaaatacaaaaattagttgggcatagtagcgcatgcctgtaatcccagctactctggaggctgaggcaggagaattgcttgaacccgggaggcagaggttgcagtgagccaagatcacaccactgcactccagcctgggcgacagagtgagaatccatctcaaaacaaaacaacaacaaaaaagttattcctggatatactgatcactttcaagaacagctgtcatagataagaaataaatcacaattagaacaatcttgatcttttaatttctaatgtataggttttgctgtttacttgtggtttgactttcctttccatgctgagaattcaagtcctgtggaaagacccaagcctgtcttccttcccatttcccacttgatcaaagtttatgctttgaccagaacaattttagtcctatcatcagagctgacaaaaagtattcgagcaaaggtataacctccaggaagagactaacaaacatatctctgttctgaagcactatttctcaaataataattagctcatttaaaaggtctacatgctggggacattttctgatcttcacaggtgacaccatctgttctaatcattttccaaagatgtataatatatgcttgatttgggagttgaaaacagcctaaggaattactaaattcttttgtggttaaccatagtatttcctcctccatgacagctttttcttttaaagaaacagaacaaaaacatagtccattggtgacaccacttccctgcttcaaagcctccagagccttcctactgttttgtaggcagttcttgtaggccctggatacttgggccactgccagtctcgcatccttcctctcctgaaacccgcttgtcactgtccccctgctctccgcactctagccctttgtcct

SEQ ID NO: 92759 - DNA, 1046 bp, Homo sapiens
cagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacccgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaatatgactattttatgtaaggtatagtttttaaacaaactggttaatccttttagaactactgcttgggaccaacaggaagagaaacatggtatctaaagacaaaattattcattctgtagttgttaaaattacagatgtcatatttttaaacatgcaagttaatcttttttcatttgcagttataatctgaccattagcatcaatacaaattatatgatttttagtccaacaaatgttatatttagataacattagtactttatcactgcttaaagcaactcctttaagagcatacttaggtgacagggtctctgtttttccccc

SEQ ID NO: 92760 - DNA, 1106 bp, Homo sapiens
caaatttcaaccaggagcctgtctctgatctgatttgggtgttttaagacgcacgcaaataatagaacaaactcatttgaattggtaaggatagggaaaagaggcaggatgtctgttttgtcaggaaatagtgtgctgattgattgataggtgattttctagaaagtgtttctctggcaatcagtggaaccttttctagggcacttatttgctatgtgctcttgggcaggttattcactctgagcctccgtgttttcatctgtaaaatggagatatagattgtgtctactttacaggatcactggcagattaagtaagtatgatgtgtgtagaatgtctgagatggctcgagtgtttgttgccttacaaagggggaaaaacagagaccctgtcacctaagtatgctcttaaaggagttgctttaagcagtgataaagtactaatgttatctaaatataacatttgttggactaaaaatcatataatttgtattgatgctaatggtcagattataactgcaaatgaaaaaagattaacttgcatgtttaaaaatatgacatctgtaattttaacaactacagaatgaataattttgtctttagataccatgtttctcttcctgttggtcccaagcagtagttctaaaaggattaaccagtttgtttaaaaactataccttacataaaatagtcatattaatgattgacagttttaagactcagcagaattcaaaatatgaaaatttattttgcataggaaacaataatctctggtaaacatcattactgcatctaacaaaacaatgccttcaattaaagggggaaagtgagtttttaaacattagggttaatttagaagaaaatacagtatataataatctcaacatcatgtttagggtaaaaatgctataatgtgaaaaaagtccctaagaactggacagaacctacctaacaacaccatttaccgtgtatgttttcaatagacaaaacatattttgtaccaaattccaacagtggtaattctatagttgtggccctttaaaaaatggcagcattgtacttgaatcagaaagcttactgggatttcctcatcgaaagtagagattg

SEQ ID NO: 92761 - DNA, 1019 bp, Homo sapiens
aggttagttttaaaggcactaacctttactttggctttactggtatgcttatccattagttagctggaacattttaaaactttcatatagatttttaaaacttgtttctagagaacatggttttttaaaattaatactttaaaaacattcactgtacattaatttcaacagtaataccggcaccagttttcctttcacttctgtctcgttatccccacaaaacaaaagtaaaaaatccaataagaaaatcccagtattcatgatttcttagttccccataggaggtatttatggttctaggagaaatcaggtgtgaaggaacaagcaaattttagtcttatatttatcttggaagcttcagggcctcaagaaaaacgagaaacgagcacaaaatcaggttgttttatatttaataagtgttgggaagaaaacacattgataggtgcatgcactcatgtatgtacatgaaagcggcaatgcggtaaaaagcgaattcttacccaaggtcagaattttttattaagcgcattttcattagttggacaaacaaccttataaacccttatgtcaaaccatataatgtgaagaatctccatgggagagatttttttttcacccttcagaattatctttttcccctaagaccttcatatgaatcttccttgtacagttggtcacaccatgattccccatattctctaatatatacagcattccaaatttaaacttttgccttttttactcaaatatttcagttactcatatgtaaacttgaaattatttcaccttaataaagtttattaaaaatatatatatatatatatatatatatatactctccaattcagaataggatagaacctcccataatgtaacaaaatctttatataaaatattaattcagtctccttttaacaactctaatgaatggaaatatttattctatataaatttatatatttttcattttttaatcttacttaaaaaagagctatcccccaaaaccagagctgcagaac

SEQ ID NO: 92762 - DNA, 2893 bp, Homo sapiens
acaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgt

SEQ ID NO: 92763 - DNA, 1028 bp, Homo sapiens
gtctcactcttgttccccaggctggagtgcaatggcacgatctcggctcactacaacttccgcctcctggattcaagtgactctcctgcctcagcctcctgagtagctgtgattacaggcacctgccaccatgcccagctaatttttgtatttttagtagagacatggtttcaccatgttggccaggctggtcttgaactcctcacctcaggtgatctgcccgcctcagcctcccaaagtgctgggattacagacgtgagccaccgcatctggccaggtggctatttttaaaaacaaagatgatagcaatattacagtttaggttattgaattagaaagaaaagaccacatatatcccaactctaagtccaatttagccaagatgacttgctaatgctacttatgtacctgtggcttttcccttgtccctagtttttcatatgcaggacaaagctcttggtgacacattgagcaggcagggtcctactggaattcagaaagctgctttcttattctattactccctttttaccccatggtttttggtgctatgatggaaaaactgagctgacaatctgaccactttggtgaaggggaacattgacaaatgtgctttcataattctcaaatcaaactgggcatcaggatggttatgtgtttatctggggtatgggagtgaggagggagaagcagattgtttcttattatcccaaatatgatcgctgtcttcaaatatctggaaagtgtacttggccaacatgattatatgcatttatatataaagggcaaggcttccctatgtgcgtccgtcttaattttaatcttgttgttatccatgaagggaaaattaaaatgcttacaagcacattcaaagtatgatttctaagtcataacattaagttacagtttctaaagagtgttagagtataaatttacaaacctcctattgcagattgcttgatttggcatttaaagactgggattggtcatttgatgatgttgatggtggtggtgatgatgatgacgat

SEQ ID NO: 92764 - DNA, 1050 bp, Homo sapiens
ggatatggggggactactgtattaagaaattagcattaaattaaaactataacataaaaccatttttcacctgccaaactggcacgggttaagaaacgaaatgggtacttttgtggactgctggtagaactccaaattaaatgcactctttccaaagcatctttgacaataagtttcgcaggcctgaactatatccctgttaatggtggagacagtcaagcaacaggcaattacagtactatgtaaaatgctgtttataatatagggatgaacagagcgcttggggaaacgagggaagcatggagaattctgcctgaggacattaagaaagatctcaaacaatggaggatggataattttacaagcagacaaataagggaaaatcagttccaagcaaaatgtcatgtgcagaggtacaaagtcatcagaattacttatgtatttgtaattttgtgttggcttggcgttgggagaaggcaagggtagggagtggtaaaagatgatgtgacactagagagaaagtctgaacccaactgaaaagctccatgtacactgtgctcaggagttttgatttataagtagaagtctttcagtaagggattggtattcaggcttaatgagatcctgaactgagtacttgacaatgaaaacgaagaaaataaacctggatttggaaagatttcttcagttgaaataactagaattagatgactgattcgaagggatgagggagagggttgtaagggaagtctcgtcatacactacagtcgcatctagcgattagacttaaatttgagattgtgacactggcacacacttcaaaggttttgaaagggtatgcaatgcagctttctcctaacctatgctaaagctgaggcttggatgccctggaaggcctgctgatcacaatctcccaagcagtagagctgaaactatggctataagttacattatatataagtctagagaagtgagtgtgtgccaggttgcgatatgtgttcagtgagtaattatatctgtttgtgtgttttctcaaatgttgtgctgtgt

SEQ ID NO: 92765 - DNA, 3992 bp, Homo sapiens
ttattctaaaagtccattttctctgaacacgtaattatttaaaatatttactccttgaaaatgtgcacaatgtggccctcttccaaaggaaaaataaaggagtctaaggcaggtgtaccagtgagaatagagagttgctgctgctgccttttttttttttttggcaacttttctcctgaattttataaatgcatgaatttaatcaatggaacatttgactttataaaagtatagactatctgtttccaatatgatataacctggattttgttttgcattgcataactttttactactgatcctgtactattactgtatcctagatgatgtatagtgataaattctaaaggatatattttatttgttttataaatttcatattaaaattttattaagttctttgttatctaaggagaattgttatctttagcctcacatgttgtgcttatttgtagaatcaagattagaaggatggctttcattgcctgtacgaaacaacactaagaaatttggatgggttaaaaaggtaattgatactttggaatatgagccttttgtttttgtttttgttttaactctagtcatttggcttttgtagttgtaggatatacatgactggtacctttagacacatagaacttgtttatacttcaggatttgaaatgatatgattttatttatctttgtaaaaaatttttgtcctcataccttgttaataataagacagattttattgttaggaaattgttgattttgatacttttgctgttttgttgggaaaagaactgtgaatatagtaaaaaagacccacttatttattttcctctgttactatgattattgatgttattatgtttatttttgagaaggttactaatgatgttggatcccaaagctaagtccaaaaaaatttgactttacttctccccacagtttgcttatttaaaatatctattaatataaacaaaatttattgttattttaaggaagactgtcctaaagatatattaaatactttttagttacttagtattttatgatttttattgctaatatagaatttattttcaaaaaaatcaataaataaggtatataaaaacttgaattactgatttcttttctccctgttttaacagtatgtgattgtaagcagtaagaagattcttttctatgacagtgaacaagataaagaacaatccaatccttacatggttttagatatagagtaagtgtttttgttagaatatttagaaactatatcttttaaagtataagagactaacaatgcaatttattagtctcatagtatagctcctactgtaatattgttacattttcctgtgatttgcttcatacagatgaaagtctgggatacagggttagttaaaacatctttatttcatgggcctttgatacattattttttgaaactaattagaaaatttctgacatagaggtttctaaaaatcttaattaattatagaattaatagaacaaaatattctgagttcctaacatgggtcaaagtagtcagtgtttaacgtctgatgtaagtatagaataattaatatataatttgatccttgggtgatattttattcctttattcaaaattttttatagcaagttatttcatgtccgaccagttacacagacagatgtgtatagagcagatgctaaagaaattccaaggatattccaggtaaacatagttttgtttatatttggttggttggctttgttttgtttttttcacatttagaagttctcaagtgacatgacatgttaaatctcttcattctttgaccctcttcaggttacctttatgtttcagtcctatttaaagatggtttgttgctttgtgacttttgtgcttaattctgtttgggaacgttttcattcctttctccattttatttgttaaagcttgcggtgtgtttgtatcatgtttctggtctttgctatatttttgtttaaggttggttatgacttttttttaaacatgaatttttccctttctgtttttgtttaatctcagctctctagaaagttagaaaagtcagttatggaggtaaattttgtaccttgtagcccttttacctccgatttaaagtgaagccacattcttccctttactacttccattttaaaattagtcaaaccaacaatgacttactgatttccttctatgtaagagtcgttgtgcttggtgtactgtgtggaagttggctccttgttttctggatgcttgtcatgtttatttggagtttaatacacatcctttcctctttcttttctctctcaactctcaaaatataggacttttaaaatgaagctgtgctcatagctgttacccagttttctgttaagtattacaaaacaccaattagtgtgattgccacatttcttcaagtgattattttgaacagtctctcccagaaaaacttcctaacacctatgaagttaccttttgctgacctattctgatagtgctgctaaagcatgggtgttataaagaaaataaggaggcagcatttgaacaggatcagttcttttgaaatgcaaaccaaagtgactgtctgatgacttttcttatataagctcttgattaagtttgcgtaatcaagagcttaagtttgtacttcagatacattttcttctctttgaataatttaggctaattttattttacttacactatcagaattgttcctacataaaaaaatagcatgtttggaaatcacttattgttcttttggcattcatagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaaggtaaatgataaattacttgctccatcgatattggttatgttcagatcattttaagcacattaatttttttttctaatttttctttatagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctaggtaataaactaaaatgtggtaaggaaaaaaaaaaagtctattaaaatattttgctatttatgttcaaactacaaattttcctaattagttttcctttgctttgtattttagttaactatggaataccaaatgttggaactgtcttaatgtgcatgtcatgttcatcgattcagatgaaagtaatataaacttacttactaaatcacacacatacagtaaattcaaccaaaaatctttaaagatttttgttatgtttatttgtacaataaatcctcacttaacattgtccataggttcttagaacttacaactttaagcaaaataatggctggtcctggaattaagttgtttccttcaaaattgttctgttataaccttgatgagaagaaaatggttttgttatacttcatttagcttaaagtcatactttccaagaacctgtcgatgatgtccagtgaggacttactgtataataatataattttcagcttttataagcacttgagtaatttaataacttaaaagatagaattaacattgtacacagacctcacattgtcaagtgcacacactgtgtttcatattataagcttttattatgttgggtgacttgggaggcaggtttaaaatcagcttaagttttaaatcaaatctataaa

SEQ ID NO: 92766 - DNA, 3581 bp, Homo sapiens
tcatgtgtatataatgaaatacagtcatgggtggaaaggcaaaacacgtaatttacagtaaaacttccttcaggccaggtgtgttggcttatgcctgtaagtaatcccagcactttgagaggcctaggcgggcgatcactcgaggccaggagtttgagaccagcctgaccaacatagtgaaaccccatctctactaaaactataaaaattagccaggtgtggtggcgcatgcctgtaatcccagctactaaggaggctgaggcaggagaatcacttgaacccaggaggcggaggttgcagtgagctgagattgcgccactgcactcctggttgacagagcaagactcacctgggtgacagagcaagactctgtctcaaaaaaaaaaaaaaaagaaaaataagaggtttaacaatattctaggatgtttctcatttgaatcattttataacataaattgtgtaaattgggatgtgattattttttcctctttcatttcttagcttgaggaaactaataggacactaactagtgatgttgccaatcttgcaaatgagaaagaagaattaaataacaaattgaaagatgttcaagagcgtatgtattaacaaaaaatgtttatttttaatatacctaatgtttatcagctgctgtaattaccaatgtaattttaacttttttccatgtttcagaactgtcaagattgaaagatgaagaaataagcgcagcagctattaaagcacagtttgagaagcagctattaacagaaagaacactcaaaactcaagtatgtataatagaatctaaatatgattttgaattttgtctcagtttatctcttttacattttacttctagcattacaaattggtagcagtagtcatcgaatgtaccaatatttgtgaagtcacaattacctgatttttgccaggttgagagaagttagatttgattaatattgttaaattctatagcaactaaaatttttcttaatatttccttttggaatcacattctctttcaatttattgttgtaatttaatgtgtttttctacttttaagaactgttgggattgaccatttgctgacaacctgaaaagtgtcagttagttcactctctgccaactcctacagttgcatatgtactgcatgaacaggtggggtactagatactcttcactgttgttgcacatagaatattttattaatttgatgtcactgcaaaatgttcttcctccagaataaaagaagaaaggtctgcctattaaagtctctctagaactaaaaagtcaaaatggtagaaagcaacatcagatcaattctataaatatttaaattataattctcagaaaacacgagtaaaaatctaatggctcattggatggagaaggatgatgagtagtaaaggaggtgtattatttaaatattatagaaagtgtttctttgtagccctgtatgtagggaaggagagtatttgtgattgtataacttgttgctcttgatgagatactgagaaaccataaacgtaatttattttatttatgtattatatttatttttacattttttaaggctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcagtaagaatactttttggactctagactgaagacttctttttaagaagtagaattattttcatgtctgtgttttactggttatagaccatttctatttaataattattattgaaccaagaagcaaaatgttgagttatgttgcatccaattaacttattgtaattaaatttcttatagcaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccaggtatggatttgttttcagcactaatatttatcttaaatataaatcagttgattgttttaagtcttgcgactgactgctctgaaggaaaaatgtttgtaatttctttaagggaaaacctactccttggagtaaggattcaagtaacatttcaaacttattttatttattgattttttttacaaagtttttcataaacatacaaaagaaaaactccacatgtctagtttttaaattattatattagctctatttttaagctttcgtttcattttctcttctttctgcattcttacttccttttatgttgggtgtttagttcatatcactcagtcacacactatggaatccatgtcattcacctaccagcgttcctctacttctctcaatattgccactaagccttccagttctcacacgctccttgactctgattctgactcagaagaagaatctttgccttacttacccatttcatcggaacctaatggtacaggtgatatcctgaaaatcttctcatctttggagtttttcccactacccttaattttagtccttttgaagattttttatgtaacattaactaataaccactaactctaatatgttgttgtagactcagttaaaaataaactgctgcatgaataaagaatttgtttttaaggtattttctcatggcattgctgttataattgatagatgccaacttgcgagaaatggagtaatacattatattgcttaagagcgcatggtttcactgcttgttttagccattttcaaccaagaagaaattcttcctgaagtttcataacaagagtggtggtacagaaaaagtacttcgactgattcaaaggatatgcttaaggtttttactgagtacttactgacattatcctaggcatatgtccttcataagaaacatgaaagaatttggcccgatcgttaccctgaaagagattacagtttaaatgaaaacagcagagagttccgtcattcagagtcagaggcagccctgtgtgatctttcaagactgcagtttcctcatctaaattaggaaaataattcctgttctgtgcggtttttttaggattaaagagaatttgtgtaaagcatccagcacgattgatacataatagaagttaaataagtgatagctacttttactattagaataacttccccaaatgctatttcacatatttatttcattaaaagacattgatcaaatgtcattaaaacaaattccgaggattcatacacattccttagttgaattacaatgttactgattttgatattttggaatttagaaatcttttgattattttgctgcttattaaccaaattttatctaaaatgtacgtaattggtcaggtgtggtggctcatgcctataatcctagcactttgagaggctgaggcagacagatcacctgaggtcaggagttcgagactagcctggccaacatggtgaaaccccatcgctact

SEQ ID NO: 92767 - DNA, 1029 bp, Homo sapiens
tcagtcgaagtactttttctgtaccaccactcttgttatgaaacttcaggaagaatttcttcttggttgaaaatggctaaaacaagcagtgaaaccatgcgctcttaagcaatataatgtattactccatttctcgcaagttggcatctatcaattataacagcaatgccatgagaaaataccttaaaaacaaattctttattcatgcagcagtttatttttaactgagtctacaacaacatattagagttagtggttattagttaatgttacataaaaaatcttcaaaaggactaaaattaagggtagtgggaaaaactccaaagatgagaagattttcaggatatcacctgtaccattaggttccgatgaaatgggtaagtaaggcaaagattcttcttctgagtcagaatcagagtcaaggagcgtgtgagaactggaaggcttagtggcaatattgagagaagtagaggaacgctggtaggtgaatgacatggattccatagtgtgtgactgagtgatatgaactaaacacccaacataaaaggaagtaagaatgcagaaagaagagaaaatgaaacgaaagcttaaaaatagagctaatataataatttaaaaactagacatgtggagtttttcttttgtatgtttatgaaaaactttgtaaaaaaaatcaataaataaaataagtttgaaatgttacttgaatccttactccaaggagtaggttttcccttaaagaaattacaaacatttttccttcagagcagtcagtcgcaagacttaaaacaatcaactgatttatatttaagataaatattagtgctgaaaacaaatccatacctggaaacccatcatctgcctcagcatcccctggtccactgcctatactggaactatccagaccaatatgcaaggcttggagttgtgaccgcagctgctcaatgtcactgtctttactgtccaatgtcatctgcagttcaattcgaatctggctctcttcagctatttgctataagaaatttaatt

SEQ ID NO: 92768 - DNA, 2093 bp, Homo sapiens
ctccagcctgggcgacagagtgagactccgtctcaaaaacaaaaataataataattattattattattatcatcaagggttccaaatgagtttttgtttacgtttgttatatctaatgatttgtattgtgttagaaattaaaactgagaaaactttaaaacacaggaacacacaaacacgttattttagccatcagaatgatgtaattacaagtcatgtggcctcaggaaaagtacatacggtatataacgagggaatgagagttttaaaaaaaaccatggtgctcagtattatgaaaatgatttgaccttatgggttctgtggaagaacctcagagactcccagggcttcccccagaccatactttgagagctgctcgtttaaaatatgtgtaagttatttaaacctttgattcattgtcctcacagagaacgtcaggatgcagatgggcaaatgaaagagctccaggatcagctcgaagcagaacagtatttctcagtaagttcaagacacattaatttgcaaatagcaaacagagttttggttgggatattttatttataccatacaactcatataaaaagagcagctgggcaaaagaatgtagatagtttaagagaaatttattatcattgctagaaaaataattctaagcacaaaacatacctggtgaagctgattaacagcattgttttcaggaagaaaatattttcataatgcaagaaataaaattgtaataaaattatcattttaatagttgtgctttttttgagatcagttttaaaaatatgaagtagaaactcctgttttattgatttaagccaataacatttttttgtctaaattgttaatgtttttccttgcctccttattcattttacctatctgtgctattaaatgagaaatatcactgtgatatccagttgaaaatcatgcttcttaattattacctgaacttgtattagttaattgatgactagaaataggaaagttcattaaactattcatttgctcggggacttagcagtaagaaaatatttgtatgtgttcattctcctttttgtctgaatagcttttgaatgtagaagtaatatttctgatgatgatacgcatttctgttgtattttgctatttagaccctttataaaacacaagttagggagcttaaagaagaatgtgaagaaaagaccaaacttggtaaagaattgcagcagaagaaacaggaattacaggatgaacggtaagtatgagacccttgtctctttttgttcatagctgtatactttgctcctagaacaatgcctggtaatcaccaaataaaaaattattgatgaagtgaattagacaaaaactttcacttcatagtgaaaactgaaccattaaaatgatatattgctaaaatgtagggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctgtaagtcaaattcttggtgcttttttggattatagttaaattgctatatcttaaaccttctttagacatactaagtatcacagatctaaatgaaaaattatatatgctgactacaagatttttaatctagttaactgccaccttctcaatgttgtcagaggagcttactaaaagtgacttcacctgttaatgaattcaaagttaaaggtctaaagtgaaagggtcatttttttttttctttttaaacagaacttagttcagaagaatcttgaaactaccaggaaaacagttccgtgcaggttgaaaaaattgcaataaaaatttcagagagaggtcaaatatcaagtagttaggtttaccctatcaattaactagacctattgaaatgctgcggtaattaaaaagtctggtattagaacagggatattcaatcctgttcagtggaaatgaaaagggaggccagaaagatttctgcacatacaggaacttggtatatatga

SEQ ID NO: 92769 - DNA, 1670 bp, Homo sapiens
aaaatattaaattgaaaattaaggccaggtgcagtggctcatgcctgtaattccagcactttgggtggccgaggcgggtggattgcatgaggccaggagtttgagaccagcctggccaacatggcaaaaccccatctctactaaaaatacaaaacttagctgggtgtggtggcacacgcctgtaatccgagttatgtctggaggccgaggcacgagaattgcttgaatccaggaggttacaaagagctgagattgcgtcactgcactccggcctgggcaacagagtgagactctgtctcaaaaaaaaaaaaaagaaaagaaaaaaagaaaattaatagaatataaggcagcatcatttattataatttttattagtatggtgtcatttaatgtgcttttacttacaaatttatgatatgcttcttttatttgtaaatttatgattgtgtccatttttattatactagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgtaagtattaagtgtactaatgattaataataaactaatgaattaataggtttattcatgaaggtctagtgatggtttcataattttaaagtttttcttataatagtctgcaacctgttggtttaactaaattttgatgatatactaaaggaatcataatttaaacatttttaaagttatatttaccttattatattttatttaaaaaatacaattataatattattagaaatacaaaaaaaattttagtatgaaatgaattagctacctaagggtaaaaaaatctgttttacatcaccatattttataccaacttcattgattagaaaaatggaaataatttacttatataccaagtacacaatttatttcttaggttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaagtaagttaattgattgagatgttttaatatgcataattatccatgtataagttaattttggtgtatctgtggattttcttttgagcattttactttctagaccatgttttctatttatttctgtacaggtaatgtgttgagtgtcactgttgtccttcgagattatattcgtttccccaacagtttttactgctgctacctaattacaatgtgatgatagaggaagtgttggtgatgaggcagaagaaaatatctgggattttcataccatgcttttagattcctcctcagggctctttctcaagcttattgtccgtgtgcctgtttgtttccttagtttcttagacttggaaatgtttgactgttaaataaacagcatgtaaatttttaatcatgtcataggatgtactctagtgtctacttgatttacttataaaatggagaacatattgttaaaatactttaaaaatattataggcac

SEQ ID NO: 92770 - DNA, 1053 bp, Homo sapiens
ctaaagcctttggtccttctgttgcatgtcattggctccttggattaagaacatggctcaccaaataattactagctatgtgaccttgtctagttatttaaactttctgtgtcttgtttcctgtgaagggacaattacagtattgttacgttgttgtgaaaatcaagtgcaataaaacatgtaaagtgtttagaaatgctattattagtactacatggggaatgtttcatttttctgcacttttgaagaccattcattaaacactaaatattcataggtttaatttttacctaatacaactttataatagatgataattagatgttgagcattaattatgaaaaagcagaggagccttaattgaatgtgaactgaagtactaaccagtatatcaagataatcctttaactgtgatgacttacatttaacactgaaatcacttggaactttgccttctgataagtaaaatagattaaaaatttattgtaaataatttagaaaacacaggaaagtataaagaaaaaagcaaagattactcataatcctatgagttaggatactattttgtaaattttctccactttctataccgttttgctttttaaaaaacaagacattgtgagcgtttccttggtcattaaaaattctgcttaaataataagcacttaccaagtgcttgccatatgccaggcagcatttaagtggtacacatgtattaaatcttcacaacctccctaggtgctgttatccctattctggagataaggaaacaggtccagagaggtgaattacttgcccagtcaaacagtgttagacccagggtttaagctcagaaagtttggttccagagtcttgtcctttaccacctccctaaaacatatttttcaacacctgcataataatgtgttaacatggaaagtcctatggagatcatagaatctacctggattgttttaaggtaaaaatagtaacactgagagacatagaatagcagtaagcagtagaatataagaaacctttgtttaaagatgtaagcatcttgtagaatataaa

SEQ ID NO: 92771 - DNA, 1054 bp, Homo sapiens
gtctaactagaatataagttcactgagtattttgatctctaacatgatgaagatactagccagatttggtcgaagccatataatactaatagataacaaagttaaccttcccataaactagactttatcctggaattgtcttaggataattttttcttttccaaactgactgtttataatgactctgaaattccagagaaaatcagtactttaagctattcttgtgaaaggcttaaaactcttgaacagaaatttattttcatattgaagcattacatgagtaactaacttagaaaaaatagccttttaattattgcatgtaattaaaatggtagattttcttagtaaaaatcagtgtagtttaaggcactaaatcaggatgataagaaatgaaatgagtactttatttacaaaaatctaattgtaagggagaaagttactgggccatatttccttgtctgtggcctagaagacagagttcaattattttcattgaggtataatttacatgcaataataaaatgtaaacatttttgacatttcgtgatatgctcacataactactgttcaaaacaagataaagaatatatcaggctaggcatggtggctcacatctgtaatcctagcactttgggaggccagggtgggaggatctcttgagcccaggagtttgagaccggcatgggcaacatagcaagaccctatctctacaaaaaatagaaaaattagctggatgtagtcgcgtgcgcctatagtcagagctacttgggagtaggactctcagtattcctgcaatgatgcaggaacattgcttgagcccaggagttcaaggctgcagtgagccatgattgcatcactgcacttgagcctcagtagcagagcaagaccccatctcaaaaaaaaaaaaaggactattttcattatctcagtaatgcctctttctattctcaatgcctacattatggtgattgttttttttgttaaatgaggacatttgtttagtgattattctctgaattgataaaaatgaaccaattcagtattaactaccatt

SEQ ID NO: 92772 - DNA, 1825 bp, Homo sapiens
atggcatatgagtagcagtcaaagatgagtcccagatttgtaggttgtgacaagatatatagtgatgctgttaataaagaataaaggaaaaatagctcatgagacagtgataaacccactttagtcctcttaagtttgagggtacctatgggacagccaaattagcatgtctgcactgcagtaggctatagtagtagaagttagaaatatttgagtcattggtatgtaagtagctgaaatcatgtgagtggaatagcccatctgggaaaagactgtgtgaagtagtgatttttttttttcttttttaggacagagtagattactctgttggtggattatgtggtttgagaaatcattttttgtatgaaaggctttatttggaaaaaagcctttatcatatttatgatatgaactataaaaatcaaagaattagaaaacctttggggtttatgtagaaaataggaggagtattggggcttagatcaccaacatttaagggacagctgggaaagcttcaggagcaacagaaaggatgcaagcagaatggagagaaccaactaagtacaaggtcggcaatgccaagggatagttttaaggggggcagtgagttcaaataagactgaaaagggtctttagaatttgatattgagaatagcattggtctttttgttgagattaagtgagcttgatacagatctcagaacagcagagtggtggtgtagactgttgggtacagtgggaagtagagaagtagagtatatagattactattctaaaaggtttgagtgaagacgggaggggaaatactgaacattctagttaagcctgttaaaaaacaagttaaggttgagcaccatggcccacacctataatctcagcactgtgggaggctgagtcgggaggatcacttgagcccaggagttcaagatcagtgtaggcagtgtttaatgagaccttgtctctacattaaaaataaaataaaataaattagccaggagtggtgacaaacttctatagtcccagctactttggaggccaaggtgggaggattgcttgagcctggggaggttgaggctgcaatgagccataatcaaaccactgcacttcagcctgggtaacagagcaagactctgtctcaaaaaaaaaaaaaaattagaaagcttttgaaattgtgagctagtctcttttttgttgatagctgcattttaaatatttaataggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaaggtatgcattttttaaagagggttttccagcagcgtcttcctaagaattgattctgtgttagctttttggttttgaaacatttttttttatatttcattgtcaaatattgggaattggagggaaaaaaactattagggaagctttacatagatattctattatttttcctttgtatcattacagtaatcatttctaagatagtaagacccaaacacaaaattacatgatcagatttttagatcagagataaattaatatttctcaatattatatacctggtaatatctgtaccactcggtatacgtgtatcagtagtaagaaggaatatctgaacttcacacgctgtatacctgttactattgatacaggtaattcttgtaatacaagagttttgtattataaaattcttgccagtttatgcaaggtaagaatttaaaagtaatag

SEQ ID NO: 92773 - DNA, 3596 bp, Homo sapiens
ctgcgacttattagctatgccatcttggcctgattatttaccttttttgaatttcattttctgtatcaagtagatacaatgctaccatctttgtaggatttttgttaatattaacaagacaacatttgtaaagtgcctgatattttaccaaaggcaccacaggagctcaaaaagttaaatcctttaaaaagtaaataatgttccaaaaatggattatttaatagtttcggtaatttttgcttgtttaaagacttacatagctagggaaagctgctgaggagctggcttgtaattaattagctatcatttattcgaaagttattgattactcctcggtaatatgaccagcactacataggaagatataaaagaagagcttatattctttactttgagcatattcagttgagtactctgaatatttgttttagatgtattcatttttatccgactagcacaaataatgacaatattttcaagcaaataattcatagaaaagcagcagaagatatctgaggtggtattctttataatgaatttgaaactttgtgtcatagaacaattctgccaaagttagagcttcttatgcatggttacataagtatgtttcatatatacatgtgtactctgatagaaagcaagagatgggggagtttttccttttatcaatataagtcacattaaggaggtacaaatactgtaccattatagaggacattatgtttagtggaaagacaaaataagcttatcattgttttctttaagcctctcatctttaaatatgaccaaaatacgtaattacagtttcttgttttttgacagattcagaaaaaactgtatacattagaagaacatcttagcaatgagatgcaagccaaagaggaactggaacagaagtgcaagtatgttttgtagataattaaatattacattataaaatttaagtttaaacatttactgaaaaaagagcggccaggtgtggtggctcacacctgtaatcccagcactttgggaggccgaggtgggtggatcacgaggtcaggagttcaagaccagcctggccaagatggcgaaacccagtctctactaaaaatacaaaaattagctgggcatggtggcgggtgcctgtaatcccagctacctgggaggccaaggcagagaattgcttgaacctgggaggcagaggttgcagtgagctgagatcatgccactgcagtccagcctgggtgacagagtaagactccatctcaaagaaacaaaagaaaaaaaaagaaaaaacagaaacggagagctatggcctggtgcagtggctcacacctgtaatcccaacactttgggaggtcaagggaattacttgggaggctgaggcgggacagtcgcttgaacctgggaggctgaggttgcagtgagctgagattgcgccactgcactccagcctgggcgacagagcgagactctgtctcaaaaaaaaaaaaaagaaaaaagaaagaaagaaatggagagctacggccgggtgcggtgactcacgcctgtaatcccaacactttgaggggccaagggagctacttgggaggctgaggcaggacagtcgcttgaacgtgggaggcaggcattgtagtgagccaagattgcgccactgcattccagtctgggcaacagagcaagacttcgtctcagaaaaataaaggagagctaccaagtaattatgtaattacttttaaatttatagactatgttttattgtaaattagaagttatttactgtttctttctgaaattctttagatctgttaatactcgcctagaaaaaacagcaaaggagctagaagaggaggtaaagttgccccacttttttattaacatttttgttagtaaaaatctttgatgtctgacttacctaaggagctctcttggtaccatagtaatacgtgccttgaaacctaccttgtagtattggtggataggactaaattatagggaaatcatgttataaataggcttcattctgttatgtttttgcaaacttgagttaattcagtatgtgtaaatatttcaagggaaaaaaatgctattcataacattttaggccaaagtattaaataatgatagttcagtaattgtggaaatttacaggaagtttgaatagtaaacaaaacatttacggtctttatgatttaagagtagtgtgctagtttacaatcatagaaagcattattacagttttaacaaaaaagcagtgaaagcctttttgagatcttttttatctgtttggaatagcaagtattttttgttttgatttcatttttatacatacttttttgataataactttaagcattatttcagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatggtttgtggtgtagaatattaattactcatcaagaaaaaaattaagtgtgtgtatgtgtgttatgctaagcttgccactgaaatgctttttatcatagttaacagcttaaaagatcaacttgaagatttgaaaaaaagaaatcaaaactctcaaatatccactgagaaagtgaatcaactccagagacaagtaggtggatctaatttgtagtaaagatactgggttttatttttaacgcgataacattagttttaattgacagtgttgcaaaaggcctttacctctaattttagaaatcatttggaaaatatttttaggtttttgtttattttaaatagtttctaatgggggaatacattgacttattttcattacatacatgtgtgtttgtttgttgttgtttggttttgaatggaataacagctggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtattgaagtcgtggttgcacttgaattaattttgatgattcttattttaaaaataactttagatgatggatagtgtgctggattggacatttctgaatatactattatgtaaagttagaatattagaaatacactgatacaaaattttaggaacaaaagatttaatttcaaatagtatgattttaagtattaaactcttcaggtagtagattggattccatttgaattaactataaagcacaataccaacaagtataaaacttctgctcacaaacaacagctccaaaatagaaggtggcttgcaaactttttattcctaattgaatgtatatactttgtgggtttaatgttttaaaaaaacgttgcaatttttaggtagaatatgtggcctagaagaagatttaaagaacggcaaaatcttactagcgaaagtagaactggag

SEQ ID NO: 92774 - DNA, 3386 bp, Homo sapiens
taagtttaatatacatgtagagatatactttaccagaataaatatggatagcttcaaacataatatatgcattctttttaggaaagggagagatttttaaaataatatttctattagggaagttttgaataactcttctctgccgaaagttagacctatgtctgtttatatcctgaagttattgtcattcagtcgtggcacatgcaggtgaatttttttacttgatagtcttaacgtactttcatttgatgcaaactatagacagaaacattttacttttcatgacatttattgtgcattacagttttttaaatctgtctaaagagatcacatactgtaacttgggattgcttatttttgagaaacatttaagctgaagcttttaatacaaatatctcaaatttacttgagatctttattttggttaaactgttgacatagagttaatctttttattttataatttttaaataatacaatctttaactgcattgtttagggaggtacgacttgggagaaatggggtggaagaaatcagacagcatcctttctttaagaatgatcagtggcattgggataacataagagaaagtaagtcaataaacctaaatattttcattccatcacattctgaaactcataagttgattccttttttgaaataacaagcatatttgataacacttaatgctaactcatttttaaattgagaaatttcatttcaaatttgttctgtggcaatatttataacaatattcctcaatatctttgcaaactattagcaatatttctcaacacttttacaataaacattacacatttcttaatttgccaagttaagctttgtagatctcaataattttcagaatcaagggaatgcaatcctttaatttaaatgcgtttgacttgataaatcaacaattatttatggagaccatactctgctaaatattgctgtaagcatagtaacttatttttactatgtatatatgacattgattcattttaagggtaagaaatatttctgtttcgagattgtagaaaatggaggtctctaaattctgtgcaaattattgctgcttgtaatttttaacaactagaataatatgttgctttccttgtttaatctatatttaaaagtgatctaatatagcaataaattacaaaattttaattctgtgaatcgataaaatggcaaatgcgctgctacaaatttatatagtgttattaaataataaataatacatcataataaaataggatggtttatatattttggttgtgaatgaaataatttatttcttttcttttaatagcggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttgtatgtggtttattatttgttaaattttactgtttttagaatctagctataagatgatgtgttattttgagactcaattataggagataaagtattaatttgttttttccaaaaggactatcatcagaagaattcttaattttattttattatttctgaatgttatatgttattcatttataagttattgcaagacaccattctacattcttttggggatatacagtaaaaacaaatacctatttttgaagaagcttgtcatctcgtgaaggatataagagaattatatagtcataaagaagggtaaaatgtgacagttgccttaagaaagatgctgagagaatctgggatggttcagaagaaaaatagaagtcatctctttggggtgggagtagggagaaataggtcagacctctgggaagaggtggcattttagccaagtctaacaagaaaaggttttgagtggctgaaatgtggggaggttaggggacagttgtgaggtgttgaatagtggaagcaaatgtttggaatgtgagcatacattgggagcagagcactcgcattgagtccagtagcactcaaacatagagcaggtgctactatgtcattacagtttggaggactcgatgagactatgtggttttcttgcctgtagtctctgcatctagcagaaagtctgacacaagatcattcaataaatattggttaactgaagtgagtattggatgtaagattagaaaatatgttgaggccaggtgtggtgattcacacatgtaatcctagcactttgggaggctgagatgggaggatagcttgagcccaggagttctagaccagcctaggcaacaaagtggaaccctgtctttacaaaagaaaaaaaaagccgggtacggtggctcatgcctgtaatcccagcactttggaggctgaggtgggcagatcacctgaggtcgggagttcaagaccagcctgaccgacatagagaaaccccgtctctactaaaaaatacaaaattagctgggcatggtggcacatgcctgtaatcccagctactctggaggttgaggcaggagaatcgcttgaacccaggaggtggagattgtggttgaaacgagatcgtgccattgcacgccagcctgggcaacaagagcgaaactccatctcaacaacaacaacaacaacaaaaaagccagatgtggtggtttgcgcctgtaatcccaggtactcagaggctgagatgaaaggatcacttgaggccaggagttcaaggttggaatgagctgttccagcctgggcgacagaatgagaccatgtcttaaaaaaaaaaaaaaaaaaagtgagttttggggaagaataatcaacagatgattgttgtgtgctctgctaaggggcttttgaccgcctggcattgggaagccactgaaagctgttcaatagttgaatgaggcattaaagatatttgagaagcccaggagttcgaggctgcagggagctatgattgtaccgctatactccagcctgggtgacagattaaaaaaagaaagaaaaatgagataataagatgaagaggtgggaagtatagtttcatttagtgagtctggtgcaaacaaaattaaagactagttatcccgtaagagggaaaggcaagaaaagtttagcatttgattgattgattgatggatggattgagatggagtctcacttcgtcgcccaggctagagtgcagtggtgcgatctcagctcactgcaacctccacctcccgggttccagcaattctcatgcctcagcctcccgagtagctggtactacaggtgtccaccaccatgcccggctaatttttttttttttttttttttttttgtagagataaggtttcaccatgttgatcacactggtctcgaactcctga

SEQ ID NO: 92775 - DNA, 1435 bp, Homo sapiens
gtgttgtataacatatctctagagaatgatttcaaaatgctgatccagcccaagcattaaaggaccctgactgatctgaccccacataggaactctttctcttggactattcagtaaaacatttcctctcttaaattaaaaaaaaaaaaaactcaacaaattcgggagttatcattgattttattttgcttttaagggatgagggatcattggtggtgttaaattttaaatatattctttgatttagaatataacaatatgtctgttgttttgactgggactctgtgcccgtagaatatttgttcttccctgcatgtgacaaatttaaacttaacatatttaagtactaggtgaaaagtgtttcctttgcattctctgttacattcagtatcttctttcttgaaattttaggggatactccattttatgcggattcacttgtaggaacatatagcaaaattatggatcataagaattcactgtgtttccctgaagatgcagaaatttccaaacatgcaaagaatctcatctgtgctttcttaacagataggtaatgtacattgaatttctttgtagagaagccctttatgttaaatttatagaaataaaagcatgcctagcttattaacatatgaaatcagtctgcctctcattacccaagtagcatctaattctgggttagccttttccttctgctaagcctggtgttgggctaccttgttgttatgtgtgtacagcccagttgtaatcgaactctaaccttaaccctcatgtctaaaaaggaaaaaatagaacgtggtaaaacaatggatttgaaagaaataaaactttcgtgttgttcacattttatcctccaagctggttattccatattactcttatataacttttgagagtattttgtgtagataaatactcaacaggttataatcttaaaaactatttgtgttagacttgggagtgcttccttcccaaccctttttaatttgcatttgaatatgagcaagactatcctggaaattccatacttttaaaaacaaaatagatgaacaaaggtgtgaaaacctgcccccaaaagataagctagaaaactatttgatttctcttctttgttcaccccattccatttttttctaatgtcccgttttatatttgtgataggagtcatcctgtcaaaggaccaacatatacaagaggatgctcacaccctcgttcaaacttacacatcagctttatgatcttggggaaattatttttacttttttgggaaataattttactcatccataaaacagtggtctcaaattacaaaactaagggcatttctagctttaatatgctaagattccttagcacatcttattgcttattaatttgttacaagcattactgcagtgactatcctcacacattcatctctgcatactttttatag

SEQ ID NO: 92776 - DNA, 1246 bp, Homo sapiens
gccacagctgcatatttctaaatatatagcttggaagtatagctttcacacttctaagatcttttaatttaaacatttgatctatttcttcattttttttcttggtaatacaagagccaattctttattcagtctccaaactggggccctttgttatcttgattacttcagtttattctggaaatatgaaagcttcctttctctaatgattctttttcctgggtcagtgtccttaagaccacattttgtactaacctcataactgtagtgtaagaaataagaaaaagaaaagttgttgatttgcatggaatctccattttaccaaacttttttcttctttcattgaggaagcctcctgtattttagagttcacagtttattcctatctcccataatttaggcattttaatgcattttccagtgtatttattctctgtatcctgaagtcatgtcagcagtgaagttctgttggttagcaatatgtaatcattgtatatctagtaataaatggattcattgcatttataagtgtgtgtttttacactgaactgttttttctttatctctcctgttcatgcagacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggtaagtaaatattttaacttcttttttcaaaatgcttcttataatactttatttcagtcaagaatttgagaatataaggaaattaattgcctttgtcgtagggaagaattagatttctggaaactttgaattagtagtatctgatagggcagactgttaattggaaaattaataccaagcctgatactggcatggtgattaaatagaataagtagaatgtaaaaagaattaaaaatatatcagacatttttgaattaaaatattagaacaagaagcaagtttacagcttcagtgggccttcattctaagattttccttcttttttttttttttttttttttctgaggcagggtctcgctctgttgcccaggctggagtgcagtggcatgaatgtggctcactgcagccttgaccttctaggctcaagtgatcatcccattttgcctcccgagtagctaggattacaggcacatgccactaaacccggctgatttttctcattttttgtagggagtggtctc

SEQ ID NO: 92777 - DNA, 1027 bp, Homo sapiens
aataaaaatctttagtcctacccaagtatttattctgcaagtggttattcacactgatatgcagcttatccttccagtcttcattgtgtagaactttacatttagttgatttggatttcactgcatttcttgaacaagtttataccaggttgttcctgtttctttatgctctttttttctatctaacctgtcataccatcctctctcctttaaaccctagcttatccgtcctttacagcctaactttatgccaattctttcttatcttgccctttcttctccttcctctgaacctttgaatgctaagtaatttttcctttggttgtatgtgtgtgtttgtgtctgtctgtgtgtgtgtctccagtaagttggttttagtagctaagtctcatataattttttaaaagcttaatttctgtggatgtatgtgaaataaggaaattttctttaacctaataagcctctattgattttttcccccaacagaagtctagactataggacagtccatgataaaaattaattgtataccctgccttttgaagtcaggcactgtcttgttcataatttgtcctttgtaataatccacacaaagtgttactcccatggtttgctcaattatttccataacatttatttttaaatttctattcacactaaaatagcttttattctctatttgctatatatgtgggaaaataaagccattgagttagttctgccaatttgagaatgaatgaaaagatcttttctataacaagttttatataaagttacataaattaggtttacaaaatgtgttcaacctccttttctcaaggtagccataatactcaatattaggtagtttgtatagcttccttatgaggaatgtgggcaacacactctttactgggcaggtaaaggaaataaagggcacttaatctctcaaatcattgcaagttggacagagctagaggtaaagaaataccatttagcaccatacttctctagtcatttaattttgcagcatgcagacacacacacc

SEQ ID NO: 92778 - DNA, 1087 bp, Homo sapiens
gttttcataactgtatagcacccaaacaagatataaccaacttaaaacatttccttaaccaacttaaaacatttcttttgtaatcatttatgtagctgtagagtacttatcaagagaaataaaaacttagcttagttatcttcctcatagactgttgacaagcatttgctaccaatcaaaaccggttcatatgtataatttaggtgaagaaggacacaaaatctaaattaaggtaaataggtattttcaccaccattgttacttctgcatttttttctttaagaggaggtaaaagtaagtaaagaaatttatgttacaacctcctcgtcactccctctgcatcaaccacacagaataaatttgggaacatcatctgttccgatgctttacctgttgatcaattcatattatgattgataggttcagtggcattaacctcgtagctaattatgatactgatttattttggttgtaaaatttatatatcttgcccttttctctgtaagtgtgcagtaagtaattcttgatggagagggatcggttctgtttcctttgtattaccctgttggtcctaggagtcgacttataaatgttaatatatattgacagcaaactgtatttcatcttttgtatgttttttataactttccagtatgcttataaagccaatcttatttcttggtagttacctagtcaaatgtttattttgagttaaggtaattttctctctacctcttaacttgttcatgccacctgtatgacattcacttttattgatcattctaccttcatcagcattccaacttctaagctcatctcagattttacctcggctttaaggttccttctgataatcctgacctgactgatcattctttaatgtcataatgtccataatttcctcacatagtcagaatttgtgctatactttatgggccatttttgtctatcttaatctatccagctagaacttaatatccctatatatttttggtctttttgatagagtctgttatattctgcaacccttaatcaatgtttaataggtggagttttttattgtacccaaagctccctcttgtggtat

SEQ ID NO: 92779 - DNA, 2420 bp, Homo sapiens
gctgagaaataggtgataaataagttaaaaatgggatgtaagatggtaataagtacgatgaagcaaaaacatgacacagagaatggaatatggaatatgctggcagcagaaggggatggtgagctaatatgtaatatgctggcagcagaagggaatagtgagctgaaagtttaagtagattgatcagagtagacctcattgagaaggtatgatttgaacagggatttaaggaagtgagggattgagccagctacaggaggtgattccaggcagagggaacatgcagagatgatatgggaagtagttagggggttttaagcagaggaatgacaggaaatggtttatattctagaaggatgactaggctgtggataagagagagtgacagcagggaaacaagttgggaattgaaataaaatatgttgaaccagggtggtatcagtggaggtagttagaaatggttggattctgaaacttcttgaaggtagaactgacaggatttgctgataaatttgataagttgtttgagagaaaaagaggtgccagaggtttttttagctagagcaactagaaggatgaagctaccattttaccatttactgaaacggggaataactgtgggaggaataaattcgggtgaagattaggagtttcagttttaggcatcctattagacatccaagtattcgtgttagcagttgttacttatctaataaatgttaactgttataatcattcattaaatatttattggctctctggtgaacaatttgctatgttcttggaattaaaagggtggtcaaaaatagacaatcttcttgcctttatgaaatttgcagtctaattggaaacatagaaattggtcaaatgacctcatcattggtagtatttttttcctaaaacacaaacaaacaaaaaaaccctttaattagggcacctaaagagaaataagagtgacttaacaaaatcataggtatcccttgatatctaaatttattaggttcttacgggcagatagtgagggatgtgtatacattgatctttcagactacttacataaatggttttttttcagtagacatatattttaagtttcttatttaacaatatctcattcttaaagttggttagcttaattaatatgagagaatgaagcttcacgaatttaccttcatttagttgaaatgagagagttgtatattgaatttagtgtttaaaagtattacatatttcatgaaatacttaggttgttagaaatgttctcctttgtttctttcattaaaaatgttttgcttttactttttattagctaaggaccatttttttgtaactgaagtctttaataatagcattatagtatcatctatttacctttctctcataacatgaaagtattaatttttgtgttttcaaaaatcaacaggttcgtcacaaggcatcgcagaaggtttatgctatgaagcttcttagtaagtttgaaatgataaaaagatcagattctgcctttttttgggaagaaagagatattatggcctttgccaatagcccctgggtggttcaggtaagcatactaacttttataagtttatttcctttttttatgagtgctttattattcatgagttgatttttgtgtgccaagtcttatgcttcatttacatggtaacagtgcagttatttttaggagatttgattcaaaacatttgtttaatgttccaaaacagtatgtccacatagatatgacatgtaatacttacttaaattgttgtatggaagcaagtattacttgcagctttttcttcttgataaagaattggcttgaataccagtatgccattgtttcatacccacttattcttgtgatttacatagtaggaacatagtaaattcattgaatcatctggaaggatatatacatattaatattccaacatggcacatgtgtacatatgtaacagacctgcacgttgtgcacatgtactctagaacttaaagtataatcattaaaaaaataaaaagtttgtgtggccaggcgcagtggctcacacctgtaatcccagcactttgggaggccaaggcaggtggatcacgaggtcaggagattgagaccatcgtggctaacacaatgaaaccctgtctctactaaaaatacaaaaaaattagccgggcatagtggcacacacctgtaatcccagctacttgggaggctgaggcaggagaatcgcttgaacctgggaggcagaggttgcagtgagccgagattgtaccactgcactccagcctggcaacagagcaagactccgtctaaaacaaaaaaagaagcttatgttacattaatcagcctatcttgaaaagaaaaaaaacaacaaaaaacttcctacaataaacatttagaaaattctacaatattgtggctccta

SEQ ID NO: 92780 - DNA, 1048 bp, Homo sapiens
gaaacaacatcaaaaattacaaattatgatacctaccaggaagaaaacaaatagggttctatggttgagaacagtgagttcttagttcagttagggtggtcagagaagacctctttgaggagttttatatttaaactgaatggataaggaggtagtgtccttatgggagaggttgaattaggtactatgatgggtttttaaatacctttccagtacccataaagatcctgaggaaagtttcgttatattagaggaactgagagaagataagtgtgtctgaagtatgaacaatgggaagaaaatgacaagatttaagtcgggaaggtggacataggctagatcatttaggaccctgtagacaatggtaaggtgcttgatttcttcttctttcttccatcgctgaatagggtaactatataatttgttgtacaaaaactggcatactctgagtaaaaaggagcaccaactggatggaatactgggtggacagatgtaatctagccctgtttggtaaaatcatcctaattgtgtacataacatatgtagaaatagtatagattctgcctgcagattacctttaaatattattattattattattattattattattattattattattatacttttaagttctgggatacatgcacggaacgtgcaggtttgttacataggtatacgtgtgccatggtggtttgctgcacccatcaacctgtcatctacatttctcctaatgctatccctcctctagcccctcaccccgtgacaggcactggtgtgtgatgttccactccctgtgtccacgtgttctcattgttcaactcccacttatgagtgggaacctgcggtgtttggttttctgttcctgtgttaatttgctgagagtgatggtttccagcttcatccatgtccctgcagaggacatgaactcatccttttttatggctgcatagtattccatggtgtatatgtgccacattttgtttatccagtctatcactgatgggcatttgtgttggttccaagtctttgctgttgtgaacag

SEQ ID NO: 92781 - DNA, 1988 bp, Homo sapiens
aggagaaggagttgaagaataaagggaaatctacagagatgctgaggaaaataataataaaataacttggaaagagacatcctcaaaggataatcagtggaaaccagctttgctaaagtaatagcactttattgtggtacttgtaacatgactgctaacgaattataaaggtatggtatagatatttggcataaataagcttattgcctcttaatgtttgctctgtagattaagttatgtcaaagaccacaagctgatggttcccagctcttgatttatgagccaggaactgtcctgtcaaagcagtttaagtgaaattcaggccctatgaactagaacatgtagccaaaatattctaaagttttgtagatatcctacagatatatgattttgttgaattagtcaatttagcattgtgccagccactacgcagtctcacaaatgaaagtatgtgttatattcctaaaggagcgtatgaagtagacatgttcacaagtaatagattattttaagtgctatggaaacacatagaggggagcatttttgcatgaagaatcaccaaaagtgaagtcagtcagcatttttctcatattcaaaagccatcttatgcctatcttgtgtgattttattttatataaatgaatatctttttccttctaggtatatttgtttttctgtttagttatctcatatgtaaatgctagtttaaatatttaactgttttctaccagctgacaaatatattttagcttctgttgatatctttataacagaagtttaaaaactgttcttgtcatgttctgagtcaagcataggtaataatactgtataaattaaaattggctcttaatgttgtatggattgctttctctaatgaagttaggaagcattcaaaatttgatttgttcttaaagtaagtgaagatttgaagagtggtgtaaatatatatagaagaaggactatgttagcacaactcctttttttttttttttttttggagacagagtctcgctctgtcacccaggctggagtgcaatggtgtgatctcagctcactgcaacctctacctcccaggttcaagcaattctcctgcctcagcctcctgagtagctggaatcacaggcacctgccaccacacccagctaatttttgtgtttttagtagagatggggtttcgccatgttggccacactggtctggaactcctgacctcagatgatacacctgcctcagcctcccaaagtgctgggattacaggcgtgagccaccacacccggcctaagcaacttctttttaacactgttgacatattttaaactatatttaacaacattgctggaatgactatttgagataacctgctaattgaacacaaatcagttgaaaatctagtctatctgctgtaagagggttttctagtttcaagtctaggataattcattccttaaattcccactccccacctgtgttttcatagtcctttcctgtgcatttattttcagtattctataaattttacaacagtatacaaatcaaaggaattgttactccagcttggtcatttaatataaaagatggatgtaagccatgattcttgtcattacttacttggctctttgcatttaggattcttgttatatacagttactgtatatcaatccttcaaatttcaaaaaattttttttacaagaaaagtatattttaaagataaaattaatccaaaagtagtgccaaataggactgcttattagtatagatttatgtatcactaaggataattactaattaatacttttacacaatttaaaaatatataaacaccgttagctacataaacttatttagacctaacaacaaccttatgatgggtattatgatactagctttatagattgcaaaactgagtctcagagaggtcaaatgacctgcccaaggagaaagaattaagtggcagagcaggacctgaaacccatatttgtatgattttg

SEQ ID NO: 92782 - DNA, 1931 bp, Homo sapiens
catagatctctaaaatgtgtgaaatcagaatgtttgattccctctctaactttgttcttcctccacaaatctgttccttctctttctgatcgtagtaaatggctcttgcatcaacctagttgttcaagtcaaaaaattaggagtcatcactgattactcttttttctgtcaactcttatagttaatttttcagtaagtcctgtttctgctttcataatatttctccagtccatccacttttactgtcatcaccttcatcaggccactccatcgttatccagttatgtatgaacacctgctttgcattctattttccacttctgctaacagtgtttcaccattgttactattaatcttaggttgtgaagtgctgataaagacagtgtcaggactctgcttattacatctataaattcacactatccaagctcagttagactgacattactatttagcagaccatcttcctcctgcttgaaatatccttgcgttctcatgtattactcctatccccattcctggtttatgtgtagtggaattaagagtggagctttttagcatacatgtttttttttttttcatcttttttctttatttccccacctccttatattgagttagataaaaaatgggaattctacatctgatctgactaatataaactgctgtcaaggtgaccttataaaatatatttatgtactatctctgctgtatattcaatggatctttttccaaccaaatgaactatgaaaacttcatcctggccctccaggctgccttttaaggtgttgccaattaaaaaaaaaaaaactttaacccttatcttccactgagctattcattgtagtcaggctgctcatttcagagcatgctctttgtttttttttgtgtgtgtgtgtgtgtgtgtgccttgtgctatagtttatatatatactttgatttcttttttttttttaataatgtaaaactttggatgcaggaactgtgtctttcaagtacttttggcatttacatcagggattcatagctgttctacatagttcacttgtatcgggaagattatcttacttagtcaggaacacagttttggaggaatatctgtagagcagcaggaagaaaaggagaacccttactgtaggcatttgtcagttcaacccagacattggtaactaatgtgtgtgtgtgcaaccagatcatatctggagttagatttttcttgtctttcagtatgctgtatagcacagaaacttgaatgtagaaagttttcattgaagaattgactgtgatccttcctgatcactgggcttattgcttcctgggcatccactggcttttaatttagttttaagccaggcttttaaagtagaaccaaccaggaggcaaggatgttgggggcatgattttccaatgctactcatgtaaactcaactttttaattccttttttggaataaaacaggctcttcactgtttacagggttatttctaagttgcaaaaattatctctcaacatgtttttgtaatttctgtatcccccatttgatcttggctgccacaaacagaaaatgtgagaacattttttttgtgtatctatggtagaaacagtaactgctccaggtctgtcaagtagattcattggatcttcttataaaaataatatatttttgttaataaaaataaatttgaaaatttcaaatgaggtgttttacttagaatgatgttcaaaagtttttgtccataagtgtttgaggaggtccattttaggattttccaagtgtattagtctgttttcatgctgctaataaagacatacccgagactgggcaatttacaaaagaaagaagtttattggacttacagttccacgtggctggggaggcttcacaatcatggcagaaggcaaggagcagcaagtcacatcttacatggatg

SEQ ID NO: 92783 - DNA, 1849 bp, Homo sapiens
tgataggggcagtcctaatattctctgacagaggttaggaaaccagttaaagctgttggatatggaacttatggacactatcatatcaaagtgggttggcattttcctggtgaaaatgacataaataaaattaaaagacttttttaaatgaatgcttggaaattgtaaaaactgtcatttcctctttttatttcttaacaggatggcttaaattccttggtccttgatttagattttcctgctttgaggaaaaacaagaacatagataatttcttaaatagatgtaagtatgtttaaacttcatatttgatcttataactctacttttgataagagatttttgtttggttattatcagcctataaatttattaatttaatcaacttatttattaaacttaagtcttttgcttaccatttgatttattcaaaaattgttacttttatttttaaagcaattgcagaaccgaattacaatatgcaaagcagataaagttctaaattttgaaatacattattaagactattttaggacaggttatttatagcagtttgaagagaagttttaaattaatatttacaattccaagacttaatattgcccagagaattaataagctttatacttctgtaattgtggacatttcagactagttaataataaataatgtaactattattaccatatgtgtggtaacccttaatctttgccattattaatgttgcaatgcagaagtaagtgaaattgaattccaagaataagaaattctcaaaacaattaatgtatacattgtatcatcacagtaagctctttactttgaaattggcagagactgaggtattttcccaattaaacaatcttatctatagttactatttatatagtatgattaccacttttcagagaagtaggccatcaaaattcattactaagattagccttgcaagtaatttcatggcaactttctgccatgattcagagtgcacaccaggattgcttgggtcatcactgtgtcagctatcatctaacttgctaagcaacagaatcagaaacagaatagctgtaactgctactttttggcagtcagtggtgttcatttatatgtgttaataaaccatagagagttttggttctttaacgttaatgtatatcttagatttttaactaacagcctttaaaaactggcaagtttagctaaaaactgtcttttcttgaaacaaaaatatatttataaatgttgattatgtaaaaatataaatatgattgatattataagtatggtgatctttttatggtagatgagaaaattgtgaaaaaaatcagaggtctacagatgaaggcagaagactatgatgttgtaaaagttattggaagaggtgcttttggtgaagtgcagttggtaagaaagtgttttgttcttattgttctctatgacatcatggttttgtgaagcattatcaatagcagctgagtagatctaatttctatgcccacccatgccagaaggtggctttgtgatcttggtcagtgtcctcatctataaaaggaagcctttgttgtctactctgggtctcttccagctctgaaacacattgtagaaaataaggccaatatagcttcacatgtgatctgcctagcagttactattccaccagaactgttgtatttttatttagaatgttcagattaaaaacatctgcttaaggaactgagatttatttagatgtataagaaacctaacagataaattttaataactgaaattaaatctgaaatttattttcgcaggccatactggtaccaattggaattataagaaatgttgacaataactattacctttatatta

SEQ ID NO: 92784 - DNA, 1041 bp, Homo sapiens
gagtgggactgcagggtcatatggtaaatttatgcttaacttttgagaaactgcagactgttttctgaagtagccctaccattttacattctcactagaaatgtataagggttccagtttctccatattatcacaaaacacttggtagtgtgtgtcattgtaattatagccattgtagtgcattttaccaatgacaaatgatgttggccactgttttatgtgcgtgttttgcttgttcttttgatttttgctaatgtgtcatgagtgtggcctaatttggatcattatatttaagttgtttttgtttttatgctaggaaataatacggtaatcaactggtgaaggagttttattttgtataccacaggccaattccagtgtttggaattccaaaaatagaatacaaatacagatcagtgccctctgaatgtggaattatcctactgataagtgtttatacctgaaaggcctagttaatactaagcatttttttaaaaccttgttatgatactttttgtttccaaggaatgaatgagtcttgctgatctgtgtaggctcttttttatttttttaattaaaaaaaggttttttttttaagagatggggtctcactctgttgtccatgctggagcgcagtgtgatcatagctcactgcagcctagaactcctggactcaagcagtcctcctacctcagcctcccaagtagctgggactacaggtgcatgccactgcacctggctaatgggaaggccctaataatggcagtggagtctactagttgggttatttctgtttctgttgttgttgttgttgagacagtctcacactgtcgcctgggctggagtgcagcagtgtgatctcagctcactgcaacttccgcctcccaggttcacgtgagtctcctgcctcagcctcccgagtagctggaattacaggcgcctgccaccaggcctggctaattttttgtatttttagcagagacagggtttcactatgttggccaggctggtctcaaactcctgacctcgtgatccacccgc

SEQ ID NO: 92785 - DNA, 1028 bp, Homo sapiens
acttgaagagtcattaattaaaatacttcccagataaacattttgatatgtgttcctgtcactaagttcttatctatccataggaaagaagataagtaaacatctatatatgcagggaggatgggtttagaagtagaattaatttggagatcatgtaggaaaagcaaattgtgatttggatattttccggattgttgtgaaacagtttgtcttggaaagaattaggtgaattttattcagtgttttaggtgaagtaaagatacctcatgggggctgaacagctttttattatttatatgtgtcattttttcccccttctccttaacttttttctggttaaacacatttacttctttttatgtacctagttatgcctgtgttggaattgcactttatgagcagggcagatgaaatgctggtggtgtgttcacaaggtgaaatcctttaaaatagtgtattggctgttattaatagtaaggcaatatttttcaatagtactaaaaattaagttaaagggcatgagatttttttgacaggaatcaagtgtgtcattgcaagtcacgatgacttgagaatttgtcaggtattaagcattctggtttctcatgtgttgatttggctttaaactgtttcatgtttgtagtatttctttttttttcctaatacatgcaggtgctttttttgtgtgttctctggaccatatttaaaacagttacagaaagaatggaatttagagctgtgatagtttttcttctatatctactagtggtattcatttagcagacaaagaagagtgatacatagtatcttacttgtaataagcctttcatattggttgaacaaataaatacagccagcagatgtagtgcaattggcaaaatgtgtttcagtctcttattagctcttagaatcagctctgaaataaaagtctggtggttgagaatgagcaggtattgaatatatagagtcaggcatcattgtttactagcattgctagttctttttattttcaactgttttattgaggt

SEQ ID NO: 92786 - DNA, 1553 bp, Homo sapiens
ggggcctgggagcttgctcgttgcagctcacacctcagatcccctctccgcccagccctccgtgcccgtccgcccgtggggagggggaggtcttgccccaccccgccctgcttccggcagccggggccggagaccaaacgattctgtcaccgagttccaagagtagtgacccgcctttgattcctccctctacctcctgctggagccagtgtcatccccggctgctcctttcttgcagcactgggaggaaaacacccctcttctccttccgcctgcccactctggggaggtgggtggaggactggccatgcttcatacaccaggttagctgatttgaaagtgtcatgctacgtggggacttggtgcgagcgagggagaaagaaacctgatgctgtccctgttgcgagtactcactggggtacatgacaaagagccgccctcactctctccttttagtctgaaatcttggaacacacagctaaagttttgctgttttcacttgcgtttgagcattccatacttgctatttagtgcattttaattgctgtaaatttaattccctgagattattgcgccagagccaaaaaatcagtctgaattgtggagtggaataaatctgtcctcttcattgcgtctctttcctataacgacctttgaaatccagattaatagcaccgtaaaggctgctaattggctcttggttaagaaaggagcatgttttacaaaatagaaatgcaccgtagaatgctggcttatttcttatttttgttaggatagatgattgtatttcgcaatttgagtagtgtgcagtgtagatgcatttatgggaaaagggggtgtggacttttaccctggggaggggaagaaaggtgaaaacgatactctgtgtattaaattgactctggaagactagaactagggtgggaggtccttagatccgttagacattctgtgctggaatgcagatgtttagttctattccctcctggaataaaccttactgtatgatgagaaaaactgcctcctccctttccagggacggacggactggcttttggtcagaggcggttggttatcctttgaggtttcaggcatcgtttgcagagtgactcagtcctgtttggtcaaaatgcaggaactgactttagctatatagtgtctttctgcacagtgtacagaaagtaatgaatgatgtgctatattgtgtcacatgtgtttgatgttttactgtttttcgggttaatgtgttgttcctatgttttaatgggagcagtctttgaaagtctttaatcgggagtaagattgcttgcatggatggcatagcttttcctaggctaaagcggagactctgggctgcactcccagcattttcactttggtattttgctagcaaaactttgacctaaggccagaaagtttagttaaaaatagtacagcaaatctcaagtattcatcaggttcatgctaaatcctagatggaaacgttttgcaattcactttgatatcttagatctttaatgatattaatcataattattagagttattctgagc

SEQ ID NO: 92787 - DNA, 1070 bp, Homo sapiens
aggcaggcagatggcttgagctcaggagttcgagaccagcctgggcaacagtctgtgaatccctgtctctacaaaaaatacaaaaattagttgggcatagtggcatgtgcctatagtcccagctcctcaggaggctgaggtgagaggatggcttgaacctcagaggcggaggctgcagtgagccaagaatgtgccactgcactccagcctgggtgacagagcaagactctgtcttaaaaaaatagaaatttaaaaagtgtggcaaccctgggttggaaccttgtgttttcttaaagaacttatcctggcctagaagtctggaggcctgaatgccattggtgtaacttgtcagattcatctgacacttgcttggggagatgtacttgagttacccaatgtcatccagcaagttggaagcaaaattagacagggaaaagacctggccgagtagaatttcagcatctgtgagatatgaaaatttgggaatttcctttggtttggacaatggctgactacaggaaaggcaacctctagaaataaattcagaaaacaattctttcaacctatgtttccccagggacatcccggcttcgacaatgtacttctgtgcagctccaggaatgcctctgcattcctcagcagagtgggaatttccagtcctggttcctggaggcgcgttctcacctctccctgctgtactgcctcccactcaggaacttctttcccgttggctgtctccatggtgaaaccaagggaaagagagagtttagatggttgccatggcaacaacaaaggcgctgtggtttccttggtgataccgggaaggtagaggcggcagggctccagggatctgttccccacaccagttaccctgcctagctcacatcctgggctgcctggattaggaccatgcatgacaataatagcaaaaccttccagatgacagacactctcagggccagtgaggcagtgctctgttcggactgtgggtccaggcacactcggtctggggcatgttatttcacccttcaggctctgttgcctcatctgtaaaatggggctaatcatag

SEQ ID NO: 92788 - DNA, 1070 bp, Homo sapiens
gcagcctcaacctctcaagctcaggtgatcctcgcacctcagcctcctgagtagctgggactacaggcgtgtgctaccacgcctggctaatttttgcattttttatagaggtggagtttcaccacgttgcccaggctggtctggaattcctggactcaagtgatctgcccgtctccacctcctgaagtgttgggattataggcatgagccactgtgcctggcccagtttttctttttaattgtaatttgttgtgatttttttctcctaagtaaatatccccttttatatttgatgtgtttgtaaatttgtattcttctttcttaaaaaggaccctccacactgaataagcttcaggccccacaacacccagatccactcctgaatgaatattattattactagtcaaagtattattttatcacatccatgagggagatagaattgcctctgttttacagaaaagtaaaggccaggagatgaagttgcttactcattctgactctgaatgcttttcccgctagattctggaatcttcaggcttcttggcgctcagcctgttcgttgatccccctgctgcttctaccacccagatcccagcagggaaagccagagggagactaaataggaagaagaagcctctctgaataagctgagaaggttccataacgtcccactcttccgcagcccgtggtcagggagctggggtgggggtgggagtggccgcacagaaaccaaaaaccaactggcccaaacaaccagcttttgcaggaaggcagaacaggcagttaggggctccggatcccaggccaggaccctcggacctcagttaacggctagtgtagctgaagcctgacgtcaccaacagagacaaggaggagagtagggaaggattacatatctgtggttctgatttcctgaaatagtccagccctgcatgaaaggtctctgtgcagagtcggagtctaatccaagttcaggatggccactaagggcacctgatttatcacttatctttagccatgggccatgaacattcctttgctaatcaaggctgttaacaaccccaaaa

SEQ ID NO: 92789 - DNA, 1098 bp, Homo sapiens
cctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgg

SEQ ID NO: 92790 - DNA, 1016 bp, Homo sapiens
actctagaagctgagcacagatgttctctagcccacttgtagtaccaggaagtcatagcaagggcaggtgaggctctgagaccgtctgagaggctgcatctccacagactcaccctggtataagatcacaatgaggtgtggagtgggagggagcagtggtgtatgtgtgtctagcccaggcctaactgcattaaaggggagaaaacagactttgttatagttgaagcagctcccaattaaagcaatcatttataactggggctgttccttaagaatttagcataattcccagtagaagcactgaagttgcctgataccttacggaaaaaaagtattttgattaatcctgaggaaatctgaaatcaaaggatgtgaatatcataatgagttaattagtcctttataaataatgtaaacgatttttttgacattttacttgagatatattttgatcttttcctgttctttcaactggacaaaagaatggcccttccattatctcaagacctgttcattggtctggaaatccaagcacatatttatcctgtgagactctagggtattctggagttctgtgtcatcaaaacactgatttttgactgaaatacggcctccttgaagggtcagctcctgagtagaaaaagacaggctcttgagtactgaggttttcacatgatagctctgaagccattactgcaggatcacatgtagctgtcttcagcatgggaattggccagtgctgtaatgtgactacagctaaggtgattttctcaaatgtctcgaaatttttgcagttctagtgagtgaaaaaatatgatttattatttcattcatcttgacgattcctgtgtcctttgctaggactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaaggtaaata

SEQ ID NO: 92791 - DNA, 1050 bp, Homo sapiens
gggctctttcaaaaaaattcatcagacaacttacactatgacatggatagagtcattaaaaggggaaaaaaagccgccaattctctgcctttgctttgtaaagaattccttaacttgaagaccaaatgagaaatttaattttaaaaatcatgtgtaattctattcctgagagtggtatggatgcaaattaatctcactgctttgtccgagaagatacagtagacttgtgaaagtccacatgttcggtggacactggttgcatatttcaaatcctcctttgtttaaatctaaagcctttgtttagagccaggataggccagtgaattttttctccaatttaagagatttatttcatagaaaccagctttgatttggtcaatgtgtaggcatttctgtagatgtctgctatctgatcaagaggaaacagatgatttttaaaaatgagttgagaaatgttatttaaaattttacaaatatgtttattttgtttcccagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggatgtgagttgctttcaaactttttcgtggcttttgttccttctcatcaagtgacaattccatgcttaaactagatagtggcagtgttttgacaatataatacaaaggtacgacttcttgttagaagagaattctataaaattttcttgcatcatcctagagagtacataaattttttaaaaagtatttcctcagttccaattgattattgatattgggaaaatttgttaaggttgtaaaacagtggttttcacacagaagtgtagtaaacacctagaggcttactgcctctggagttgtaattcggtaggtctgagggaaagcaggaaagtacattctca

SEQ ID NO: 92792 - DNA, 1076 bp, Homo sapiens
agccatcaaaaataaggattaatttagaagataatgtacaatatgtgtccatgagaagtaagttgattcctgaataggttttaggttttgttagtttgaacttcttatgattaaaatgatttgtttaagtgtatgagttgatgagaaactgaaatacaatttgttatgtgtacactgaaatgtaaagttgcaagttttagtaacaactcctgaggttatgggttgaatcatgtgcacaaatgccagtttattctccatagaacagtctgtatttaaggctattttctcagaattcctcctgggagagaaatgtactctttccttcttgtcccttatcttaggttaatgtttagggtatctgttagaggcgataggatgtaaatggctctagttccctcttctggaagtttccatgatagaccgccccacctcagcttcctaatctcagtggatacatagtgcatcgataagtcagtgtgaatcttagaaatactcacccttagttttgcctcagtgcctgccccagtctcacccatagttggtcactgagtttggtcagcttcacctttgatgtgtttcttgcatctgtcccataccaccaatttataataatatctaacatttattgagctcatacagtgcctggcactgcattaagctctctgcatggattgtcacaatgacctttcaaaatataggtatggattagaattcttactttataaaggcccagagaggctgaggtgagttgctcagagtcagggttgaatctcttacctctctgacgcaagagcccagagtctttaccacaacgttgaattgcttcttctcgttcagggtctaacttcctctgtagctgaagttgctgggtctccttcttagaaggcagtcagcttccaggctttccaacctggatgctggaaaaatccagggggatttgtctaatacagaaattggattatgatatcattcaacctaagttcttcagtgacgctcttttacatgtagagaaaaccctgattccttgtatatttgattttaagtgtttgcattaaattcataagccacttcatatt

SEQ ID NO: 92793 - DNA, 1738 bp, Homo sapiens
cacgccattgtactccagcctgggcaacgagatcgaaactccatctcggaaaaataaacaaacaaaaaaacaaccacagaaatctatgatttagatatagttactctgaacactttggtctattttttcctgttataaaaatgaaattctatatgcttctaaaagttagttaaaattatattagatgatataattttatatctcattttaatgtaatatattatggacattgcttatttcaatatcaatatttctttgacattattattttaaataacaatttcatggtctattgtgttgataaattgtcatttcagtatttcgctagtggatgcttgagctttgcctatcatttgtacttttaatgttctaatttggtaaaacgtcattgattgatggtagtacacatttctcaaacttgactgctcttaggaagtgacaaaaatattgaatttcagggacgtgaaatgaaaagagatgaagccttgcctcagtcctcttgatctcagtgggtataatctagctgactcttaactgtctctgatgccactgttcaaccccgtaggacaacgcttgctttttatttatgccatcatattatgggcttcttaggaacagatatttatgtcttaattttgtctgcatcccttgagtccccagccaaggcttggcaagccatagatgttcaaaacacactgttttcctgagggagagggtatattttaggggtagtgtgagagactgagcccttcagaaatgtgcaatgacaaatcttgatccaactgattccgataacttctttttgattatggaaaatttcaaacatatctaaaacatgtgcaaaaatagaacgattgtgagcctctgtgttcatcattcagcttcagcagttgtcaagattttgtcaattttgtttcttgtgtttcctccctccccacaccacaacccttttggatcactttaaagtaaatccaagacattatatcatttcatgcccctggtgtttttgaccacgagtttacatcagaatccaatgagaagggaatgtcttctggggctcaacaaaaggcggtggactgcctgggaggttgtggcacaggaaaactggtgacctgggagttggggacctaccatacttatttagttttgacctcgacagaggtggttcgcctctcggggctcaggttctcatctgctccttgaggaggttggcttgggtaacctaaaagcttcctttgacgttgactttactgaagcatatgctctgcctgtctactgtggtggttctcaaattctagtacctggaccagcatcagtgttgtcagggaacttgtacaaaatacagattctctggcccctccttagaccaactcggaaactcggggggtggtgaccagcagtctgtggtttaacgagcctctccaggggtctctgttgggtggtcaaccttgagaaccatgaatccatgaaggtggccgaggagtctgtaagctcttaaaataaaaacaacagagacgaaacctcctggaaagtgcgcatttacttgcttgcagctctgtaagtcaaccgaacgttagacttcttccctctgtgcagaatgatactggctgtggaaggacagtgagatcttttgttgatcaggaactctgactgaaagttaaagtgattcataaagatttgggaaagaggccgggtgcagtggctcatgcctgtaatcccagcactttgggaggccgat

SEQ ID NO: 92794 - DNA, 1007 bp, Homo sapiens
gccacaccatgtttccatgatcagatgtcagtgttgtgtcctcagatgtatgtactatgtaactgctgtcttggggagaagtttgaccctcagcaatgtttgtcaagccaaagaggaggggtgttgattacagaggactctttagagggaaagaactggaatgaactttggaggtttcagttgggccaaaggaatgccactgcaggtttgggaaggcacatgctgaacccagtgccaagagatcctttgcatcttttggggctcagtctgcacaacccctctgtgctcagtccattgctctctcctctttgttatagcatttatcatgtattggcttaggaatatggcatttccccctactaggttgtgagtccctctgaagttgagagcaggcatcagtcatctctgtatgcccagtgcttagtgctgtgcttggcacagagtgggcacttaagagctattagttgaatccatccgtccacacatgtatccatcttcccatctcttcctccactatccatccatccatccatccatccatccgcgcatgtgtccatcctctcatctcttcccccacctgaccatctatctatccatccatccatccatccacacatgtatccatcctctcatctcttcccccacctgcccatctatccatccttccatccatccatccatccatccatccacccaccccccatccgtccatctatccatccatccatccatccatccatccgttcatgcacgcacccactcactcattcagtctttcagtaggtgttctctgaacagtacaacataccaggtattatggccagtgcagagggaacagagattgaattggatagagatgatgtgctcaaagaacagagtctaggcgtagtgagaggaaaatgtgctaagtaggaaagaatgaattaatgaaaatgtcattaactgcaagcctgaggctctccaagaagaaattaggttgttattgttgtgttttttaaaagtcttga

SEQ ID NO: 92795 - DNA, 1039 bp, Homo sapiens
ggtttcccactcctgggctcaagcaatcctcccatctcggcctcccacagtgctgggattacaggtgtgaaccattgtgcccagccaatagctggtgttttcttgaagatttcctgggcctctccagggggtttttgttgttggggcatgttccatggtattcacagcagagttgtttgaaggggcacgtgctcgcttatgtggcttaggtccacgctacctgtagtccttcggaggcaagccaggctgccagctgactgtcttccaccacaaagcctgtgttcttctcctgaccctttgttctttgcacagcgtactgtggctccagtccaagtacacaaacttccatgtagtttaaaaagaatcagtttaactgttggtggttagacagattggtatgtacctgtgtggagagcactgtgacccagcaaaacacttcagggctaagaagacacgaaacggtggcatttgccatctgacccggcaggcgctggggcagatgaagctccagttggaagggctactgctgaattttttttttttttttttttttggttgttgttgtagctctgggagcagatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaaggtacggtttatttgactttgcaagcgagcacctgctttgggggttggagaggtttgtgttgacttacgaagacagctgtggcctgtgttcagcagaataatggcaaagcattggcccttctaataaggtgcaggggagcagtaaaccgagacaagtccacttaatgaacgggtgtccttatttttattgtttgaa

SEQ ID NO: 92796 - DNA, 1030 bp, Homo sapiens
ccctcctggcctgcttccagtaccagccccattgtaaaccaagttctcactgatttctcccctcttttaagttgtagcacttatggacaatagtgcttttttgtcacttgtcatttataatctgaaattcttttcctgtgaatgctcagatttaactagaaattaatgattacgcactgactatactccgtctctcttactgtccgtaacgagcaatcagtttttctaagtgcccattttacagttgagaacaccaaggcccagtgattaaatcactttgcgtggggttgcgcatgctgtttacagactagtacagccaggcttttgtgcattaaggtgaaggctgttgttcggccatcatcactgccctgatgggcactgcttcagattctgtagttgaagagcatcacacaccagcctggagagaagctggtccaggccttggaatgcaggcgttggatgtgatgtgttagggcgtggaagaaatcccacaggcagtctgcagagttgaataactgcagcagggatctagcaaagagaccacggacagagaacgagtggtcagggccagcccagggaaagaaggaccatcccaaggaggcctttgataggtgttgtctccactccatgcggcatttgggaggattgaagctttagtgtgtgaccttgaactaggctcttccctgtctgggtctttagttctccactggtcaaatgacggattccagtgggtcagagagctccagatgtacctccgcggcaggaccggtctggcccaaaccttcctcacccagcaggtgtggctttgcagtcagggtctgtctgtaagatagagcactgccatggtatctagaaagtccccacactgtttggttgtggccacaatggaataacaaaaagagccgcagttggccgggcgcggtggctcacgcctgtaatcccagcactttgggaggccgaggcgggcggatcacgaggtcaggagatcgagaccatcctggctaacacggtgaaaccccgtctctactaa

SEQ ID NO: 92797 - DNA, 1054 bp, Homo sapiens
aacaaaaaaaaaacgttgacagagggccagagtgtgcattacctcctatggcaagtatttggggcagtggttctcatctccccagattgagtggttcatccaagtgatcctcaaccatgggtgacttttgtcccctagggaacgtgtggccataactcaagacaagtttgattgtcatgactggatggtgccaccagcatctggggtagggaccagggtatggccgaatattctgcagtgcacaggacggccccgagcacaaagaagccccctgcaaatgtcactggtgccaaggctgagaacctgacttaagacagcttggcttgaacaatgccccacccaagcccctgaaccctaaactatggccagaaagaccagcttcacgttgctggtctctgaagaagtgattgggatgcagctttcagaaatgttgggagcaggctgccctcccacccttctttgtctcagctttgcccttcatggccacagtcagcaacgcagggtgaggaggaggctggatcctcagcggcctgccatgggtggagggcaagtctggggtgtgaggtgtccctcccttgtctgtgtttgttcccatcttgtcttccggacgctcccgggcaggtcctgggagtagaaggaagaggccttaggctgggtggctctgggcacgcccccctcacacccgactcttccttcctctctgcttttcttgttttgttcagtaaatgcctcctgagcccctactacttgccagtcatttctcaggcccagaggctgcagtggttctgccccgtgtgggaccagttcaccgtctttgatcacctgctgggtccaagcacctcagaggttccccacctcactggccgctggggatggcctttcccagaggaggaaataagggtggaagatggtatcatttctttatcttcaagtaacactctcgtctatggctacgggtagctgtagggtgacttatttgtgtaatttttccctttcttctaaatactcaccattgctcccactcttgacaaccagagctgccccttggcacgta

SEQ ID NO: 92798 - DNA, 1015 bp, Homo sapiens
ccgcgaccatcggctttaggtagctctgcctgtcctggccgtcctggggatcctgctcttctttgggccaaggccagagggggcatgggagctgctgggctggggccgctgagcctcctggagtctgatgtggcttccatgagagtcaggccaggaccacaggtgcctcctgagtccgtgggtctgggcccaggccctggtgctctatgagtgacacttgggagttaccgtatgtgccaaggagcagtgagacacctgtggtaatggcgagtgacctgtcctatgggctgcacagctggaggatggtagaattttggagcaatagtgggcagtgtgttgttggggaagaacatgggcttctgaatcagaaaaatatgaattcaaaacctaccgctgtctcttgttagtcaggggaccttggccaagtctcaataaatgtttcttcatctggagatgagaattctgctccaagggttgttaagagggatgaggtgctgtatgaaaggtcagagcacatctggcagctcactaatcggtaccggctgttctcatccaaatcagcctcattgctgaggctcgtctgctcagggaaggcttcctggaggaggtgataactgagctgcaacttagaagctggggaagcatcatgtagagatggaaagggacaaagggagcaaagagggaatgaggaggtgaggatatggatgagaggggtgagtgaaggggctgagcagacctcctgccagaggagggtttgagggagctgtgaacgggcggagcaacctggggacctgctcgtggactcccagtccagtgctctccccaccatgctcatctggagccacatcataagccattctcgtctttctttcctccatcatgcactcagctaaattggatttgaagatctaagacatcaaactggaggagcccttagaaaccatctaggccagcgctgttttacagaggaggagacagaggtccagagaggcaaggcaggtctccatgctcccac

SEQ ID NO: 92799 - DNA, 1035 bp, Homo sapiens
atatattgtcccaactcaccttgccagacagccctgggagaatgcagggcagaatcctccctgcttggagtcagggaggcaagacctggcaggcagcacccagtgaagctctggaaggtgctctgcccacaaggtgtcccattggtggtgctggaggagtgacaggtggcggctgcttggctctgggcaagtccctccctccagccccctcacttgtaaaaaataagaggattggacgaaatgaaccagcaagtggcacagccccattggttagaaaaggtgactcctctcatcctaggctccaggagggtgagcaggtgcactcaatgagcaaggcttcccaggacagggcactcgagggacctggcgcagctcacctatctccttcagtgccctcacccccagagaacccacatgtatgggaccgtaagctgtgcacaagactgggtgccaagtcgctgctgttcctctgcaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctgggtgagtcacctccacctcctggcccagtggcagggagtggccacagcccgagcacagacctggcctcggccctcgtgggggctgacttgggctgctggaattgaaatacatggggagagcttatggcttcactggcgggacgtcatgaagtcactgtgggcgtccccacactggggggctgaaagtaggttgaggttgatggagacatttccagaactctttatctgccattctaggcacagggatacagcagggaattgagcaaagaccctgtccttgaggcgattctagtcttagtgggagagagaagcaataaaccagtggaaaacaggcaggtaaagatgggtgcatgcattagtgtgtgtttgtatggg

SEQ ID NO: 92800 - DNA, 1035 bp, Homo sapiens
gggtttcactatgttgtccaggctggtctccaactcctgacctcaggggatccacccgcctcggcctcccaaaatgctgggattacaagagtgagccaccgcactcggcctaaatattctgattctcagatgaactcatgactagataaatctggataaaacttccagaatttatttttcagatacagatttggaaataacatgaaaatattgtctctggccccccaaaaatcttgagctggaccaagcagttggtatttactaggtgcaaacctgtagtataatgttactgagcatttcatagaaaacggtgccctctcttggatttcttctttttcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtaacttttgtactcttaactctgcaccttgtcttcaatggctgtagtcaccgggtaccctgaggaggggacctttggtcctagtccttatttgcccatgggtaaactgaggatcagagagggaagtgactgcctcagccacccagggaagtgcaagagagctgggatttgatccccgggggctctctttcccctatacctgtttgggtagaggcaagacacatccccctttcttttagatgaattgcggacattttttagcctttgtgtttcttttctttctttctttctggtttttgagatggagtctcgctctgtcaccttggctggagtgcagtggcacgatcttagctcactgcaacttctgcctcctgggttcaagtgattctcgtgcctcagcctcccgagtatctgggattacaggtgcccgccaccacacccagctaattttttatttttagtagagacagggttttgccatgttggccaggctggtctcgaactcccgacctcaggtgatccacctgcctcggcctcccaaagtgttgggattacc

SEQ ID NO: 92801 - DNA, 1003 bp, Homo sapiens
tctcgctaagattgtacatcatcccgaaagaagcaaggggccgacttggatgccgcttctgcccttcccaacagcgccctgtcttgtcattgcaagtagaatccgggcagccgctttcctctggataaactcaccttttcccttcccacacctctgccgttgtccacgcaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttcttt

SEQ ID NO: 92802 - DNA, 1040 bp, Homo sapiens
agctttgcgccggggactgggatgagagcctttctttcccccggagttaggattccagcgctgcagttgaggaaactgaggctcagggaggttgacctctgtgcccaaggtcatacagttgccgggcggcagggcaggctgagcccaggttggaatcccggttctcatattacagctctcccctgcgaggcctctgcacctttcttgcagcctaggaggtgctaggcctagtgagctccgtcagctgctcctgcacgtaattttattatgggcaaggccaggaaaatgcaggatgagaagtaacgttttgggagtaacttaagtgctgtggagctagagtaggtaatttgtgtggtcagtagttgctggagaaagcagatgtcaaccctgtttttgatcagcaagcaggaaaccaactaagacaactggcagtattaatttggagatgttttagaacccggcagtttcccacaggatagaagtgttttgggaaatcaaagcttgtagccgtttttttaattgggggtgttgtggtatggtggtctaggggtagtgattgtgagattgactgtttatcctttgttccgtaatttgggtcttattaatgaaagtaagcagttgaggaatgtatagtatttgagaaataagcacatccacacatgaacacttttcttgctcccagattcttgttgaaaggtgtaacagttggatttatgattatatactttgatagcacttcacgtttgccagcatttgttattgagtgtttttgtgcatgggttgtgtgttttggcgcttattattcctatttgcatgtggggccctgtggtcctgtggagccaggcctggatatagccctggactcgggtcgggaggtctgggctctgcctgagctctgtgggaccctgagcgagttctttcacccacccaggtctcgcttatcagcagttcctttcttttagaaaagcacagggggacaaggggcggacctgctgagtcttgtggtgtgggagagaacgcgagggttcaggtgagagacc

SEQ ID NO: 92803 - DNA, 1013 bp, Homo sapiens
cttgagatcactgagaattacctcccattgttaaaattacataaatgcaggattgagtacaaagtggcattcaatacattgttggctttctgatcttctaccagattgggcagccacatctccaggtcaccatggctgtggcctctagctgggccatctgctgtggccctccccaggaggtgcttggcctctgaagtgaatcctggaggcctctggcaaggccctgcttcttatacctgaattaacgaggctctttttagaaaatgtgttcttttcttaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcaggtaataactgtccagggtggaggggctgtgccagaatcagacagttaactgttcaagattatttttatgaacttttcccccataattccttattcttttatgtgttttagaccagtggtccccaacctttttggcactagggaccagttttgtggaagacagtgtttccatggaccaggggtggatggttttaggaggactcaagcatattacatttattgtgctctttatttccattactattacattgtaatatataatgaaatacttatacaactcgccatcatgtagaatcagtgggagccctgagcttgttttcctgcaactagacggtcccatcttgggggtgatgggtgacagatcatcaggcattagattctcacaaggagtgcgcagcccagatccctcacatgtgcagttcacaa

SEQ ID NO: 92804 - DNA, 1029 bp, Homo sapiens
gatattcctgaggaaaacctctccctggctgtgatttaccctcagtcagcctcataccctaattcggatagagagtggtcacccactcccaggtaagctgttccctgttcccctggcccagtgcagaggcttagaagtcagtgataggaagcaattctaagaaaagaatgaaatagaaatgaaaagtgaaaataattaggaccaggaaaaacacggtgtagagtcggaggtacagattaggatcaaacacagaacatgttcagatcatacacttatatctggtgtcagaatccatctgcagatatggctgttagctccctggaggtgaacttgaaaggaaaaacatgtaaattacatcatgctaattgttaataggagaaaacacagtggcagagcctttcttgatacttagccctaagtaaaattcaaaaacagacgttgcttcaggagctgctgaggtcgttcagggctattagaatggtgcctccgccacacttaatccattctgccgaattcaagaatatttatttccctgaaatgaactcacaagttgccctagaggaaaacttggagaactagagctgctcactgtgcagatgccatcctgatgaccccagagatgtttacatcagtgaaacctctgggaatagtgagccccctggctagttttcaaaggacttggggaagagggtagagctaaatcctgtgttctcaacacaggaaataatataacccccattgggatgaaaattcattcttgggtggtgacaaaatcttagacgttataatggtttgtggtctctaaggggccacagcattaaaatctcatggtgggtggagttgggctattaatttctcagaatgctcaggggcatgttgataatgaaaaagagactgagaaacgctgatctaaatgccagtgacatccttgggttattcgtatacctcatgctttagattcgcttctggttcatggtgccagcccttagaaactctgggttcctacctgaagccggtcttatcaaaacg

SEQ ID NO: 92805 - DNA, 1032 bp, Homo sapiens
gtgtatcacgtggtggtatccagtagcctggtagattgcaaaaggactgcccctcatcttgcagttgcggccgagggaggtctgtctagttcttgccctccacagtcttccctgttccatccttcggaaaggtagaggagttattttccccattgggatatattcaataatgaaaaatttgatctaactcttactataagtctattttaccattaaccaaattacttatgaagaaaatacctgtagattatatgaagtgaaaattttgatttaacttttacaaatcgatttcactaaccaaattacttatgaaaaatatgtatatagattactcttttcctttcgttataagcatttgtagatgatcagatttttttttttttttaattcctaaatttgactctctggaaattatggttaagcatataattttacctaattctgtgaagtgctttgaaaatgagaataatgaaatatagcttgggaatatgatcttctgttttctgtctcgggttgtttgacaaataagtttacaagatatttttggaataccactttaatttattataaacatttaagtagtttattgggctgtctgaataatggagtcagacactttccacagcatttctagaacagaatcttggagaatggcctgggctgggtctcaggctgaggatcaaaggttggtgtgttcactcgatgtagtcatctcagatttctgccttcattccctcagttttgacctacctactttgtggacttacatggtttactttgtaagccttagcaaatgaagctacgattaatttgtacgtggaaaaccttttgtctttttgattaaagatccagacctcaggatgtacttcattcagaggctacatttgcagaagaaaagtccgtttaaaatgaggaaaacaaagttgttaatagttaaaactaactagccttattgggactggcaaaaatactgaaaactttgataaggctaataaataccttgtttatgaacatcagtcattgaccttgtaa

SEQ ID NO: 92806 - DNA, 1090 bp, Homo sapiens
tcactctgtcacccgggctggagggcaatggctctatcttggctcactgcaacctctgcctcccaggttcaagcgattctcctgcttcagcctcccgagtagctgggattacaggcgcatgccaccacgccccactaatttttgtatttttagtagagacggggtttcaccgtgttggccaggctggtcttgaactgctgacctcaagtgacccgcctgcctctgcctcccaaagtgctgggattataagcgtgagctgccgtgcccagccaggatctacattttctatcacagctaaatgcaaattaaattaaagaaatacaacttacacacaatcttgctgtcttgaaactgtaaacaaaaatagcttccagctcttgagtctgctaggtcattgatgagtggagcaaagccacagggagagagttgtggactcttggcccattgaaaaagaagctgagttgtaagagctggaatccacatgttcttgtgtccctcacacagagagacatctgggagagccctgggagagggaaaggctaatagaacagaaatgaaagatttcagcctaatagataaacaaagtcagaaaaccttaaggttttgattcatcaagtagtaagtatttctgggccctcattgttggtgggaccctgaatttgaccctatggagatctccaaaataaatagagaagcagctgagggtagcggagagaatgagggcctgggaggcagcaggttattctgggtttgagtcctcactgcaccgcttgctaaaaaggtgaccttgggcaaatgagtagacttccctgaacctcagtgtcttcatctgtaaaactgtgagaaaatgacagaattgttgtgaggttagaagggctaatgtaggtatgtgaagtatctggcacctgtaggccctctgaatatttgcattctttctccttggctgtggtacatgcacgctgagccccagtttccctatcttggatatgcagtgggtttacatgtaggtacataactggttcagcaaatatgtttctaaaaacatgaaatgaacacaatcttttctttcaagaaattttatttggtatgc

SEQ ID NO: 92807 - DNA, 1060 bp, Homo sapiens
ccttacaggtgaggccagatcgtcacagtcaggagaccccaggagagtccccggaggtcctgattagggctctgagggtgcatgttgaagccagtcaggctggcatcaagacccagggactcttttcctggacggaggagattctcagtgtctgatgtctgctgggtttcggttcggttcagggtaaataggagctcccagggaaggagtgggcgtggctctgggccagggagatggtcagaaccgcggtcaaggcttaaggtacagcccagctgccagagcccgtcaaagaactgagggtccggggctgaggtctgggcctcctgaccctgccaccttctcctttgctctgatcctggtggggctgccccaccatgatgagaacagtgccctgcctgcttctgattgtggtggaggcagccccatttttgaaagggccctgtgctttctatttacgacattatcagtccccatgaccaccctaggaagcagatgtggttattatccccatgctagaggagggaactggggcctgggaggtgaaccgcttgcccagggttacccccgtaatcgtgacttcagccgagggagcctggcttctgcgccatgcgtagccatgactctgcctgtgcagatgcacgtgtgtgctgttttcacccctactccctgtgtgaacgtatgtgcctcaactaaggtacacgtcccccaacatcctcagccttgccctggcctccctgcattgctgcacagacgccgccttccaggtaaaatggtgcggcctttacaaatacattttataggattgtctgcacagttggaatgcacaaactctcagaaaacacttgtgagtgagcaaatgaaaggtaggcctaattttgaactgaattttctttttgtttttccctgatcctctgcaattgctgtcacagatgcattcctggagcaagctgtgtcatatcaacagtttgtggacaaccccgctattatcgatgaccccaatctcgtggtaaagattgggagtaagtaagtacctcttgaaagtcactttggcagtagcatg

SEQ ID NO: 92808 - DNA, 1032 bp, Homo sapiens
ttgactactttatatgacattggaaaggttttcagtctgagcctcggttttttgacatatatttcattgttttgtgttagatattataactggacaacagcagcacccctcctcctggcaatgcaggccttccagaaacctttgccaaaggtgagctttaacatgagaaagaaaaggggatgctagaaatgatgggtagcttaatctggggtggttggaatttcacttttattttggaaactacagagttaattccactgtgctcttttgaagttcatgagcatacaggccaggagtttctgatctctctcttgcaccttgcacgtggttgcccctcttccttatcaaggcaaaacctcccaatcatggtcgagcggaccgaagattcctttctcaatatctgccatgcaaggggtacaggtggaggctgagcagacaggtgccaggacctcagagcccagtgaggacaaagggagatgattgtcaccctggaaaggtggagcaggcatcagggtcaggtgcaggtgccctgtgtcaagtgtcaagtgtcagtgtcaagtgctgctcagccaggaagccagccccatgcctgagtctctgaggccagagccagtacagggcctggacagctcccagtctgcaggggagagtaggtaagtggccgtagggaggagttaggagggcagccacgccacctgccagtctgcagtgttctcatcctaccccaaacaattcactagacagtcagcctggagttgttaattttttcaatgatagatcttcctgctagattatacgttctttgctgcagagactgccttaggcttgtttgtatcctttgtgcgcttagcaagcttttgtatggcttaggatgttgccgtcggtcagccagttcaaacacttgagattcttgaaggtctaattggactttgttgagtctaggcttgctgcttcctgggtttgtgtgtgtgtgtgtgtgtgcctgtgcctgtgtgtcagtgtgtgctcatgtgcatgtgtgcatacgtgcat

SEQ ID NO: 92809 - DNA, 3038 bp, Homo sapiens
ttttaagctacatagtaaattacttatctgtctgcttcccttagactgaatctttcagcttaaatctttcttttgttactagctgaggtgtcagcttcttgaaagttctgtaaactgaggaagggacattacctaacttttaccttggtcctggaattaacctcaagatagataggtattttgttctttggaaaaacgtagaaaattatcaattcatatttaatctccccattaaacccatttacctaaaagtatgaattttctttttaatactcgagattttaaatcaaatgtacctattaatgcaaatgtttagaaatttacccttagtaaaaatcttatgcattttaccttttgttgaaaactgttttatcctctatcccatattaatcatttcatattttatttgataatcatcatattgagagtaatgatatcttaaccagttagccactttaatttgaaaacttccagtcttactaatcactaatgatttctaatgctttctttttttgttgttgttgttgtgttgtattttatttgttgtttgtttattcctttaacatcttcttaagtcttcatgcttaagttaccttcatgtaattttggacgccattaggttttgcttctctaaaatttttaacgcacaaatagtatgttgtgttttctctgatttttttttaaatcttactttaatttgcatgtatgtttcttttggtttgaatgtgctaagttgatctttttttgttccattatttatgttaccatccatttaaaacaggccactgtggaatctatcatgagggataaaatgcccaaaaagggaggaagatggtggttttcatggaggggaagaaacaccacaatcaaggaggtaagcccagaagacaaagcagtgctcacacttagcaagtgttggttttgtgtagtgagattggttttcatgtacttacatcagagaaatgaagataggccctagtgctgagtttccatgagccagctctgccatgaagtagggcgagtgctcgtggaacgtggggaaggtggggaggaaggtcaggagccagcagcataggtgtcacctcctggctctgtaactgttgggagactgtggtccagtcactccctcatggtaagatttcgtcatctataaaagaagggattcagcctgggaattcagtttcttaagaaattaaatatcttccttctgcttgtggagacaatttttctttttctttttctcccctcccctcccctcctttcttttttggagacgggcttgctcagtcacccaggctggagtgcagtggtgcaatctcagctccctgcaacctctgcctcccgggctcaagcaatcctcccatctcagcctctagaatagctgggattacagccatgcaccaccacgcacagctaagttttgtatttttagtggagacggggttttgccatgttgcccaggctggtctcaaactcctgggctcaagcgatctgcctgcctaggcctccgaaagtgttggcattacaggcgtgagccaccatgcccaggctgtgaggacaattttaatgaggcatactcacagcagttgactaattctctgagtcctttcactgaaatggcatgtctaaaggtccatggctttggcgttcatgtctatgagtgcctgtgatttctttcagatcttcgttgccctctcctctatttcttgaagcgcttgctttgcttggctcccaggcccctgtgtccacctgggtctcctcctcccagcaggctgctcctgctctggcttagtcacctctaggagggtcctcaaagctcatgttaggccaccttttctccttttacttcttacttttcccttctgcccatgcgatgactccatttttgtctccaaaccagacattcttttctactccacatccacttatcaagtagtcgactaagcagacatcgtcctgtggatgcctcaacgtatttcaaacttaacgcttccagaattgaactcatgggattcttgtgagttcttccatcattggggccatagtcagaaaatggcaccactgtccatctgtgggtgagattcatgcttttagcctcactcccacaccaggtcctatcagttttccatctgaaatacttctctgacgtgtccatgtctctccagctctgctcccacaaatctgcattaccatcatctctcccagaggtgcttccagatggtctctttgcacccatcctcacccttgcttcttcattctctgtactgcagatgcattggtctcttcaggggactgctcctatttttgttgctccttaaagccttactgtggttccccagggctcttataatgaaggcttgtgtccttaccacggcctacagtgcttgtgtgttctagctcctgcctgcctctttaatctcatctttgctgttctctgctctttgtgcattagcttcaatggctgaaggtaccttctaccctgggggctttgcacatgctattttcattacttagtattctgtggacccctctcccctgcttcgcttagctaactagcagatccagtagccctttccctgcagatgagtctggtctgctgtcctctgcctgtgaacttttccttcataaattttgtcatagttgataattatgtaattactagcgtgactatttgatgaacctctcctttctgtctagacccgaaacttcatgaggcagagaccatatatggctttgattgctttggtgttcttggtctccatattggacccagagtaggggttcagcaaatatttgttgagggcacgctgattactctgggaaagtagtatgaagaagccacagggacaacagtcaagttggttattttaatcataaactgccatgaactctatttatgccattagttgaaagggaaaatgtttgctggaagagttttatcaagatataattgttctttgacattttctgttagcatatctgaggtctactcatcagttttactaatctccaaaggttaccgataaatgagttcaaat

SEQ ID NO: 92810 - DNA, 1010 bp, Homo sapiens
ttactaagtgattcatatagcattgaggcattttcaaagatagtggtcctgggaggcagagctgatactactgggttggggattatgtcatagcaggattttcattgagtgaatagctaattacagatatgcattatgtgagctatttaaagaaaacgagcctaattcccaccctgcacctcccagctccccactaaacaaaaaagtctagaagagttaggggcactgacctgtatattctgagcagggaagtaaggcgtattccttgctcatgggatgaccctctgggggatcctgagagaagaattggtgagtctttcttgctttcactggcacctgtccgtaagtcctagaaaggccctaattgcttggagttgtatatttggcgagctttatatagggaactgatggatgagtgtggacttgtagaaacttggactcctagcgcttggcatgcagtctcagataggaagagaagagagacagagaagacagcatcttcctaggccaagagggagtttaaccctgcttgtcatgagtaggaacctgttggcttaaaatagtggtggtagctcatcaataggcaagtgaatgaggagaggcagcccccacacgtgtaatgcaagagatgcatgaatggggatgtagtgagagttcattgataaatttaacgtcttatggtaaatgaccacccgagagacgggactcaggagagactggattgacttagtcattgattaaaggctaatgcatttttcatggctacccagatgcattttctaattggtgatgacatcactgtgtgttccagggtaaagcatgaatcatcctccagtgatgaggagcgcgcagctgccaagccatcaaacgcaggccacctccctcttctgcctaatgtcagctacaagaagactctccggctgacttccgagcagcttgtgagtctcccatgcttggcgcggctgtgttgtgagcacatgaggtttctgcagactcctaaggctgtgtga

SEQ ID NO: 92811 - DNA, 2023 bp, Homo sapiens
ctggctcaagtgtgagggtgtttactaggaaaagataaggaagaggcccagacacccactcaggccatgtgtgggaccctgcagcctgggggtctctgtgtgactcactgctcccactggcgacactggggacacctgcagtcaggcagcctgggggtctgaatggccagctggtgtgcaccaggagtcctggcacagagactcaaaactgctcaaaagtcactttgtattttgaatttggtgtgatttctttgggtctagactatattcttctggatatgaggcatgactgataaccaagacttctctttttccaattcgtgtcagtataataataatttaaaaacatggttatttagggaaatgtattttcacacttggcttaaatttgtctccctgaatgatgatcttcctatttagtcctagagtggtaagtgtatcctattccaaacttgtgatttattacgccgtgtagccccgtcattgaatcctggctaatgactgtaatctgaaaatacttgatcaaattagcactatcctgggaagtagaacaactctgtagcaagtaggcaagttgcattacaagggggcctgagagagctgaggtttcattttgcctgtccagccccggaaagaaccagaacaaggaagggtggggaaagaaagaattatacaagggcccagggcagtcacttgtttttaaagccgaatcctgcttctcatagaacagaagccaaatgcccatcaatcagggcctttccctcaagcagacaaatactaatggttcatgtttttcagaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccaggtaggtcctgctgacttggggcccatggtagatttctttgcttcaccgtgggggtctctgggcctggtgttggcacctctgctctcctcatgggacttgcacggttcgaattctggtgcagttggagctccttacgtagtttcagctccttggtggcaatcattgtgtttagggcttagttgtttccttctggggtattattatctcttcgacttggttgcttctgtgggggcttctcaagaacgtctttttgaatggcctttacctttgattgaacaagccggtcacctcgatgcatgatcagactggaggcgtccttctgtggattacctgtccctccgtcagcatcaactttgatgacttgagccttgggctttctatccagaaagaaagttgtgggtcttgtttgtgttttttttttttttttatgaggcatgaatggtgcaatgaatctgaaagggatttttactttatttttctcttttcctcttcatttagatcagatactcttggccacattttgcccacccttgggaaggattggacccatcagggcatcgctaagctgtaccataaagtgagccagtgagtacagagttcctgtttcccgcctcctgtgaacgctggtgtgtgcaccgcactctgcatatggaatctttcctgtcccagcacggggtgacttgcagagagggctgcacctcaaccagggaggggcagtgggggtcaggggtagcagtggagtccagagtgaaagtgaatcccagcaactccaaatttgaattcaataccaagaaacaaggggcgaagtataggggaattgattactaggagaacacagatggtggcagcattaggggtgagactgaggtttagttcatcccgagggatggcagaggtagccagttgaagaaataggagcttatatgttatatatgccaagtgattttctgtagactaaaaagttgcagattccaggcaagttttggcggcgttgcagaccctgcgagccaaccagcagggcacatcatgtctacctggtctgtggagtgctccagcaagtggcccaaaacagaaca

SEQ ID NO: 92812 - DNA, 1350 bp, Homo sapiens
aatcagatcccttctgggtctaaaatttaaactcgtggttagagtctgctacagaatggaattgaatgaatttgaaaactagtagtttagatttgccaagttaggtttgaaagcctagaatgtgaatgagaaatataaccaaactgaaatatgtgaagttatatttaaagatgaggaactgtatatctcttcacataccaaatgtttcttaccagagacattgctgtgtaattgttaagaattcccttcatatttttggtcaaagcccagtttttctgagtcggtgggctaaatgggattactctttctaatgaggcatccttgtgtgcttagaatcactcttgactttatcctgtccccctcgggttcctaacttattaggatggagagcatttcctcattccatgttgttgggaggttggcccactgggtgacatcagcccaggccgacccttgtcttcctgccttgtccatttcagagactacacctcttctggtctggtctgtgcagacctggaaaagagcctctggcaggccaggcacggtggctcatgcctgtaatcccagcactttgggaggctgaggtgggtggatcacctgaggtcaggagttcgagaccagcctgaccaacatggagaaaccccgtctctcctaaaaatagaaaaattagccaggtgtggtggtgcatgcctgtaatcccagctactcaggaggctgagacaggagaatcacttgaactcgggaggcagaggttgctgtgagcccagatcgtgccattgcactccagcctgggcgacagagctagactctgtctcaaaaaacaaaagagcctctggccttagtggccccagatagcccgaggggttcctctttatctggaggagttagactgggggagtttggttctaggagattcctaaggattggttttctccatgtagcttctgtggttttagatagagagataagttctctctagggcagatttttactttcaagatggtccttaaactagttggattctaactgagtgtcaatagggcagttctaggctaacaggagtcctggggctgccccacaagactcctctcaccctgcagtcatgccagtacccaagcagtcctcaaggtttgtgcagagagaggggaggctggagccaaggccctgttccctcctgcagaaggcgaggcagtgccaggctgcttcctgattggcagaaaaacagcaggaacttgattcctttcttaacccttccttgcggtttctgccacctccactgttctaagtggctgactgtgacaatgtctcgttcccactcccctctcattccccaggctggagaggacctac

SEQ ID NO: 92813 - DNA, 1128 bp, Homo sapiens
gccaagtagatgcttgtcattcagaactgggacagtcatctgaaatgtcttcagaggctggggccacacagcgggagcagctcagttctttttccctttcgtttgcgagtgtctgtgcgtaagctctgcctgcttgggaggagcactgtgtgtggaggtcggtctgggggaggcgcgcagatggaactcggcctggccgctcagggagtgtgagagtgggtttggttccagtgcaccgcggccttgtagtcaagcctgcagggaggggccctgctgccgcagccacaaacctcagacaaataagccttaaagccgggaggtattttaaaaatctgtctgtttgtttgaatcccaaggaaagacataactcttggttttgtattaggagacgtcactttcccattttgtgcaagcacactgtttctcataagtcctttggaggtcctttattaaatatacacactcggcttcatttagtacattattttatacctcagaacatgcacacttctggagtctggattttggaagttcctttaggttcttagcaatttggaactagacagtgatcagtgactgtcaaggaggaatctggggatggctggcagtgggctgggtgtgccagaatctcagtttggaggtgcctggaggtctgaacatgcatattcaatatagcaatagcaactttcttttcatagtataagccacagaaactaacatgcaacatatttttgggcatgcaaataaaagagagcaagagaacgttgtaggaagcattgggaagccctgctctaattcagctccacagactataaagacgaagggctccaagagggcaagacaattgtccaaggttacagcaagcaggagagcccgggtctcttgaccgtcatgccaaccagggcttttttctctaagacgtgttgataatttgtcatttagatacatttgagcacccagtatacattattttaatgttgcatatgttattttatttaaattatccttaaaactgtggcatagtttttattttcctccctttacagtggaggaaattggcttagagaggttacgccatttgcccacgatcacgcagctagtaaatggcagagctgaacatcaaattaa

SEQ ID NO: 92814 - DNA, 3720 bp, Homo sapiens
ccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaatcaggtgtgtgaattttaaatagtttttggtaagttactaagttgttgacttttctggggtgtgttatcaagcatattctaaaaaaaatcttcaggctatgaattgttcactatttggaataaatgtttttcctgatgttttagatttaaatgggtaaaagaccagccttctctatgcacttgctggggacgggagggatgaagaaagagaggagaaggctgcacccgggatccctccctgccctggtgggatgattcaggagtagggaggtttcaatcaagtgaatttcatgaagtgcctcccagggcctggcctagaattggtgtttagcacatgggggttccccagcctcacagctgctgtcctcattttttcgactcttctctgtggtaaaccccagattcatttttcattttgaatgaatcaaaatccttgactagtgcaatcatataagctgaaaactgtcataattcctattgattttacatgtcaacgtggctggaagcttcctattgatttacctgcatcagcctaagcgtttttggaataaatggaaaagtattggccccctaaatgcaacatagccggccaggatactaggcccaattcctaatgaagcccaaatccaaacggttcatctctaggtgcctgtagaattaatgcttttgcatcttaaaaaacaaaaccttctaattttgttgaacaccatcacggatttgttccaactcggacttcagtgtgcgggctcttttatctataaaataaaaatttgtctagactattgtctttggcctgtggattcccacgtgctggcggagctctgcaggcagctctcacgtgtgcggggtaaacgagctcgggggcttggatttccccagcgtctcagctgtgatcacctgaatgtttaaaaggctttacagcttggttctcaaacactgacacatcagctctcttgcatcggaagccgaggaaggttgacgatggggccattgaccatcagcattggaccccagagtgctctttccaggaagagggaatgcacgtggccctactacagccctagaacagcggaactgtcctggaggaaagttaagtcggccccttcttaaaaaattaaaaagctggctcctaaaggctgggtgcgttggctcacgcctgtaatctcagcactttgggaggccaaggcaggtggatcatctgaggcccaggagtttgagaccggcctggccaacatggtgaaaccccatctct

SEQ ID NO: 92815 - DNA, 1043 bp, Homo sapiens
aaagctgactttaatttataaatttataaaagtataaaacaatatatatcttctcactcatttttattttaaaaatagttactttattaaaatacgttatttatgttaatatgtaataggcttatattgtcatatttgcatgcattcatatatatttttaactgtctcagttttaattgctcatacagaacataattagtagatataacccatacaaacagaagctctttggggtcctcagtagttttaaagagagtaaaagcattctgtgatcaaaaagttcaaaaaccattgcactctaacaatctttgagcttgcaaaaattacctcaaaaagccattttcagtatggaatgaatgggtgtgatggcccagtttccaatacctaccgtcatttagcccccattccttttgagctagtccagagaggtgtggctggtaggcagagagttgaggcctacagagctctggtcatttatctaaaatatagttctaactctaaaatggacaaaggctaatagctgcacatttgtcctataagacagagccccagtattaggtggttgtgtgtatctcttttccatagcatcaaccctgtatctcagtgtaggtagcatgtcatcttctagaaaggtaacttgatacagacccaggcttgaagataagagcgccgggttctcttctcagactcaccattaaccagtcttatgacctgagcagtctctctctctggacttcagtgtccttattcacaaaaggcagatgtttggtaacaggaccatacgctctctaagatatttttcaacttggaaattctatgaatcaatttggagaaatatttgaaagacaataagaataacagttgacttttatatggtattttatacttgctaaattacttttccttccaaattcttggctggtgttaatttcacggcaattgagattaaggattccagaggcgatagactggtattgagttctgatgtgtcactaaccagctgtgtggccttgagtaggttatttaacccatctacagctcag

SEQ ID NO: 92816 - DNA, 1031 bp, Homo sapiens
tctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtaaagggccagtgggttgctttttgtctttggaaggggcccgagggagcgggagggcgccaggccctcgagtctgggagagggagattcgcgggataattaccgtggccttattaaatgggtttatttatttatttgctcaggttcggtaagttgcgaagtttttagaccgtttcagacaatggggcgggcggcagtgggggcgtttcggggagagcccggggaggagagggcggcgggactgcgcgggggccacggacacgcgtgcaccgaaggctccagg

SEQ ID NO: 92817 - DNA, 1022 bp, Homo sapiens
actaaaacaaattcatgtgagacaaattaactaagaataaatggataaagccaccaagaatagacattttaaggtctagagatttctttgaggtgaattatatggaatagaccataagataaggtactcgtttaggtaaaatagaaggtgtagcacatttaaatagaaaaaaaaaattctcaacacagcattctctaagaggtttcagttacatgatttctctgactttcaaaataagattcttgatctaatccaaataatcaggtttaatctacttgttcaggatttcaggaatagattaaagagattagctagatggaaataaattcagaccatataatggggatgatataaagatttatatttatccatccatgtttacacatacaaacacattgaaccattagactctacacgaactctaaagtcactagacgagctgtgagatcttctgttcaatatgaccataagaacatccttgattattttctggcccggatttcttttcctccatattctactgaccctattgtgaccctactgatttccgccctaaaaaatcaactccattgttgtttgtgtgtttcctgtccctaaatgtcagtttgtacgtaagaatgttctcaagttttaccaacactgttttgttataagaggttatttgccggcagcacttcataatctgacagtttcttccgagcactgcaggtttctctctcacccgcccccatcccacccaccccctccaaacagcctgtctatttctgtgtagtgagttttctgctgtgctatgataagggaaggaacttaattcctttagtgggaaagaacagttctaattcggatcaaattcgaaagtggttttcccattaaacagacaggtatattatgaatctttctgtgaaaagcccattaaacatctatacccacgattttggaacgtttttagaaatgttttctttttatttttaaatcaccaaatgtttcttaacaattgttctcaggtactaagacaaagatgc

SEQ ID NO: 92818 - DNA, 1047 bp, Homo sapiens
taacatttgttaactgattaaaacttttggcatacagctgtccttataagtaatggaatctcatgatttatgggctttttaaattgtttcattgttttcataatttatacattttattaagttaataaaactaattttataagtaatataacaaactattttattttgcctctccaaatgtaccaaaaaattgtattttgattcaaagatcttacttgacattaagctaaaaaccatatatcctttgataataaacttaccttctagtttaccactttacttaacattaggagaggcaaagaaggagaaggtaaagcaggataagagcaatttcctctttatgggagactctgtgttatatgtaaaattagtgtttattggattgaatgtaaatatttactgtatgcaatctatcacattataaagcaacacatagaaaatgtgtttttctaagggtttcattttgctactgttatgtaattagcaatgtcctcaacagtgtcactgcagtatcgttacaatcagcaacattaatgatgactctatgtataaactgaaaacactacaccagtgcacagttcacttaaagcaaagagactagcttttatggtattactttctatacgtatagttgattcataattttatgtgatataataaaaatatactatattggacaaagaaaagcttgatttgccatttttcagttatgtgaccttgactagtttacttaactctactcataggtttcaatttccacatctactaagtcatggagttggatttcacctgtaattcttcattaaagccaaataccaagaaactggccatagtgaaaatgaatagttatgccaaaatagggtctaatctaaaccatcattggcaaaggtagctttttgttggtagtattacttgattgaggtaattagtcataagaagtaaatatgaaaggtacttaaatttaaataacttgaaattttgggtattatatgtcttcagtatgtgacatggatacatatgctggcaacttaaaattttacctcattt

SEQ ID NO: 92819 - DNA, 1085 bp, Homo sapiens
actgactgggtttgagagagacatgcctttactactcagtccaattttggaaactgaggctataggagacctttcctttgaatgttctcacacctggtactccttggaagtaacaataataattattattattattgagagaagagcctttgtcttctcttaatcttagaaattcaggacagatgctaagagcctcccgcttgtttttcctaaagcagtgctctgaagtgctgaaatttctgtgccttctcccaatcctgcagagtcaagccagccatccacttgggaggcttgcactctctgcaaaaatgcatttgaagagcttgcctgtgggatgaggagtgagacacagtgagcatttggggtgcctgtgatccagctgtgggaaggtccacaggtgaagtatcccaaaatttctgattaagtccatggagtaggtaatagggtccatttcctctctctctctctctctctctctgtttttatttttttctcccagcctttctcaacctctcagctgtgctaattatctcaatattctggatggattaagaaatacatgaaccttttggaaagttaccttatggctaggggtctgggcatttattcaacacaatctcatttattattttctgtagaagaatcattgagtgagggttttctctgtgtagtgaactgtgccaccttagaggaagagtggcatgggtaaagttaaggttgttcttttactctcttcagtgtatctatttttataatttccccctatttgtgagctagaatttctcagctggatttccacactcctacaaaagtattcttgtctgtgagtggttgtcaaaattaatgcttctgcatgggaataaaaataaaaagctgctttttctgccatctttctgatatcttataacccatctttaatatgaagtccctaaaattctgctaaattaagaaattgctccaaatcacagaataattaagtggtgagtcaaaattttagcacagatttatctgactagaaagcccctgtttatcagccaagccatgctgtccttcacaaacctggttgctgtgcccattggccagtt

SEQ ID NO: 92820 - DNA, 1025 bp, Homo sapiens
attgtgaccgtttctcagactttccatgtttttgatgaacttgacaatgttgagcagcactagtcagatattttgtaaaatgtccctgaattgaaatgagtctgataattttcttattattagacttgagtaatgggcttttgggaggaagaccacagaggtaaagtgtcattccatcacatcatatcaagggtctatactattaccatgacttgtcactgacgatgctaactttgatcattgctcccaagatagtttctgaggtaaaaaattatttggaatgattctacatgggaaatttgtttatcctcccctatgtatatgtttattcaagtatttatttatctcagtttaaatgtacggatatttatgttacactctaagttataacatttatattttaaattttataataattttatttagttacattgaagtgaatctgtgcataaaaccttgattattttcttagtgattgacaaaattttcttgggttaaaggtaatacattcttgaaggcttctgatataatttgccataatgcctgtcctaaatgttataaaaatgtccactttactttgcctcctaactactttataaagggcaaagaaagtacctactctttctatatcccccaacagacatattgtagagctttttacatcaaggaggcatggcttgtgaattactctctcatccactgcatctactgtatgttttgtttttgtcttcagcaagacctctaactacacctgtttcaggaatgacatgtaaacctcatcatttggagacaacacttaatgaaaataatcccctctgggttaaattaatattttgctctcctttttcacttccttataaaagatatgtgggttggatagagacagtcatgggcgtttgtgtcaattttacacttagttcatgagagtgctggttatgttgcatttgtcacgacaacactctacgcgtaaatgggactgtttatgtttagaaggtgaggaaacagattccaaaaggtcaaggtgc

SEQ ID NO: 92821 - DNA, 1040 bp, Homo sapiens
tgtggctatttccctgatccacccaactgaaacacattttgataaattcttgaaatacctccagcttgctaaatccaaaggacatcttttttattccacatattgatttttctatttcgtctttctctaaacacacctggtttcaattacaccatgcactccaggcttaaccagaatgaaaatgtcactgttttatccatctctgttggttcccattttatgattatctttataggcttctccaacatttagccattagattttagagtcccttaacatttttccccagaccttcaactttccttctctataatctgtttccagacaattttatgctttcccaacattttaatcaccaccttgatgctgattactctcaaatataaatccacacttaagagcttcctttgattatcccttacctgtctagctacctgactgcttgatttctcaatttgaataaacataagtacctcaaagacaacatttctcgacccctatttatttgctttcttctcctgctttgcatgccagattggattccttcccattgtttctcatgtcatagcgtagcttccacatccagtaggtgaagcaagttacaaacctaactgccaccattggtacctcagtctttctaacactccatgttcaaatcatcatatagtcaggtgcacttcacattttaaaatagctctaaaattcatgcattttcaatgtctatactgatagaattttagttgctattcctccaaggtttattttcttatgttctatagcctgagagtaaacttcttatttatgaatttctttctatttatcttgttaaagttgactaaactgtgaatttcagggttgcttattattatcaattctggaatatagtcaatttctatttattgcctctgtatttgctttctctctggattctacttaattatatcctgaagactcttacttaattgtccatttgtttgatgtttttcataatttctgtttattgcttctttctgctacattctaaaatactttttctgctc

SEQ ID NO: 92822 - DNA, 1041 bp, Homo sapiens
aacagatccaattaaaaatgataaagttcaccaatgtttaaattagagctagctgaataaatattcccttcagcatttcatcaaagtttcaggtaaacaggcagactccaaggagagattataattaaaatatctatttttcctacatggatatatattaggtttctttttctgtaatacatgtttaaacatactgatattttttaaaacattatggtagcatgtagcataaaccccacctaaaggacactgaaagtgatgtggcatcagaatgaggttcactgtctactttcaggaagagataaactctgcttcttcatctagacttctacagcaacagtgtgtaaaacactacttgaatcctttaactggattgtcatcctttttctttaagctaatggaaacataaacttttggattcttatgccttaagattaaattttattactaaactctttactctctttttaaaaactttcttcttatttaaaccctttagtcaactccccagaacttataatacttttatctttatacacaccactgtaacttttggggtttccccgtgactcaatgtcaccattaattgggaaccagtatacccaactacttcacagattctttgcatataaggggatttattggatttattaatcaatttcatagggaatggaataaactagaaaacacatgtacatttttagcatttgcaaatgggaaaatgtttcagaatgcactactttagattacggtgtccgctgtgtagttctgacttcctacgagagactgaggtttcagtgagcttctaccaacctatttcactgctaagaaaaggacacgttgatcctttgtccacctggatccacggctagaagctaacctaatgacatgtcttctatcgttaagtttccttcccccagataggaaacctagcaaaccagagcagagcaattagtggtcctttatctcaaaaggatagcatgaatattcaggaatcgtgatatacagtgaatctgatgaggcttctctgcataaatatgc

SEQ ID NO: 92823 - DNA, 1044 bp, Homo sapiens
atttttaagagaccaggtctcactctcagccagacggtggccacactctggcacatagcagatcccaaacaaatgtgagacccttcccttccctctctccctgctcagtgccatgggcttgcctagagacacagaggaattctccttgctgaaaatgaacacccccatgaggagatctactttctgggatggttctcacccttcctccccttgtctgtctgacgcccacccctgaggccagcacacctcatcccttgtctgtttgttattctggacccctgactccaaaccatgggtaccccactacctctctgtttttgttgtttaactcacactgcgttatgtttagttgtttagttgtgaattgctgcttaacaaactaccccagaatgtagtggctgaagacaaccgtgtttattatttctcaaggttctgtgggtcaggaatcagggcagagtggatgaagctggctcatctctgtcccatgtgacatctcctgggactgggacaactcagacagcttcttcacttttctgcaccttggctgagagggctggcaggctgagctcagccaggacacggtgtctctttgtgtaatctcccgtggccactccacatgggctgtccttatagcctttctagcaaggtggccagacttcatgcatagaggctcagggctcccaaatcacaagagcagaagctcttaggtctccttgagactgaggcctggcactggtggagcatctgttcagttgcgttctattggtgaggtcaagtcacagggcagctcagatacaaggtggaaggggaaaaagtctaaacaagggcgcgaatatgggcatggtggctcacagaggccgcttttggataccaaccaccaccttcccttattcttcagtgatgacaatggctgagaacaaagctgctttgcctatgtctgacccacacaaagactttctcaagagtttcctcagtgatcttcattgataaagttgcgctagccccagctgcccctgaaatccctgattgatgactgtcacaggc

SEQ ID NO: 92824 - DNA, 1037 bp, Homo sapiens
gtctgaatggcacgagagaaaaatcaatcccgtggatagcaatgatcatcagttctttagagcaacccttgctttagtgtaatggagtcattcatcgtctggtttttggtccaaagtgttctcttctttatgttacagctaaagtcaggacctaaatggcaacacagctcagcagggcaaaacagattgcaaatcttattcttattgttttatgcttttgttgtaaaggattatcatttgttaccttatacgaaagcctgctctgtgaccacaggttcagttggtaaaatacagggctgagaataaaattcagatacacctgtggggatccaaacacattttcatttttctgcaacacagatagttttcgtgaagatagactgtcttaagtatattaaggagtcaattcattttgacattaaaatgatagatacattttaaaatattttatttgctgatttcctttgtttcagtgaatgacaactagaggttgttaacaatattagcaattgataatactttttattataattcagcctccactatatgctgagcgttgtatgctgcgttcatcaatacaaactctctctctctcacacacacacacacacaaaacacaaaacctgcaaaggagctataaatacatacattttacttatgaggaaattagggctgtgagagtttaggaaaataaattataccactatatctgtacaatgagcattacaaagccattaaaaagcaatattgtcgatgaatatctgatagcttggaaatctgtacacagtttactgtgaaccaagtgaagcaggtaccaacgcccatattcagtatatccagtgcggtaccatatgtggctttacacacacacacacacgctaccacagaaaaaggggtggaatgatccagccagaaccgtgccggtgagaagtacgtcgtggagttctcgctcacccctgctctgtggtttcagggtgtgaaggagctgtgtctgctgctgcttaaccagtccctcctgcttccatctctgaaacttc

SEQ ID NO: 92825 - DNA, 1061 bp, Homo sapiens
atatttgttgaataaatgaatatcaaatctttaaaaatttgtccaaggtcacccttaaaatggcagggcaggactcctgactttcagtctgatgttcttgccattaatgatgaaggattagaccatgccacttccccctgacatgcaagcaaaatgatttgcttggaataatgggaagatttccttatagagtggcctggtgcttttattttatttttattagtttgccatagtttgctgacaatgatttctgaccagccagttgcttctcatgtcacagcatgtttgtcccaatatgagcaagagatttgaaatgtttggatatagctccttgtgtcttttttcctaaaatgattaaagttgacagaacatccgttttaattggtcctgcaaatatttggagatgttgagagtttctctttatgaacaatgtgttccttgctttaaatatttgccctctcgctgttggcatcactgggggccaaagaaggaaccctggaatgtgtactatgtgcacgctaatctttaaaactgtcttgcaaagtggttaccatcctctctgttttaaatgaggtcacatgaccaatttaaggtgatacatggaactcaaaccagttctgtctggttctaaaacctatattcttggccttgtactacacttcttcctattttccagggaaatatatggcactgatatttgaatagcattggactacataaagcatagtcttttcctcttcccactatgactttacatggattaaatttgattagagatgagaaatcaggggtttgacagaatagaaaacattgcttcatcttttacatttgtcacgtctcgatacatggtactatatatgttaactgctgcttaattaaaatattgaaaaatgccatgcctattaactgttgtttgaacagggcaatatgtgtggaatattcaccaaatattcttcaagcatatgtcatttgacatgcactgtgctacactctagggacagaaaaatagacaaggcaattgatagtaaaatgtttggactttttagccaccagtccctagc

SEQ ID NO: 92826 - DNA, 1138 bp, Homo sapiens
tctgtggtggtgcaaactttttccggccccctaggaaatctctcccaagagtctctgaatgactctaatacaagtcatctcatatccccctcactctttttgttttctcgcctctctgctttccccttatgtaagagcattttccctgttcttggtaggtaatgatacagatttgttgaatatttggtagtacaaataagaaagccacactggcttaatgatgctactcatctagagtcttctccaagaagtaaatcagtgagtgtccccctcctcctttagaaagtaaagatgtctgtctggcattactgattgaaatctattttgaaggacaggtgcatttgatgggggaaaatgacttataattgtaaataacctcttgttacttggtgagtgaatgcagaagtattgtgtttagaatggaaacaccaacaacttctggaatgttacaaaactatgcccatagtttaaattgtctcttaaattattgtttttcaaaaattgtcttacctttcactagagtagtagaaagatcagggcactagtgggcagatacttgtgtgtgtgaccatcctccctctaccactagttttagaatttgggggaagattcttcatctgtgtgcttggctgcttggtgtataaaatggaagcttcaactagaggagatagaggatgttgtgctcccctcatcatttctctcacacacattaaactccactcttcatctccatatcccaaacacctagaagatccccaagtattgactgtatgagctcttgtttttttcattttctctctatccccttcttcattctcagagataactttgggtgatattaaggatagagacaagttcttacagagtaaggataagaatagataatgatattgcaatgttcagttaccaaaaaatgtgtgactgctactttcactgtggctgccaaccctcttaggcagactttgcatacatcagagagagacttaatatttaattatcctcgaggtgcccaaagtagtggccccacaaatcagtgtgttgctgggaaaccagccagctcctgcaaaattaaacacagagtctctggttcttgctacctcactggttctcggagagacagtaatttttagttttctaa

SEQ ID NO: 92827 - DNA, 1063 bp, Homo sapiens
aaaattaacaactgagttgctaaatttatgaaattcttaaaccaattatccacaacattttgtagtttcacttattcttaaatacaaataattcttttaaattgccataagatagcatttgacaagtatattaaataatacatactgaaagacatactcagtggcattgcagaattgtattcttctcagaagttaaaaaaaaaagacttgtaatcttattagggcatggaatttgatttaaggtaagttagactgggattcagcctaggtgatttatagctaaaagccttataaggatctggctacagcaaaacctgtataattcagtgctttagcatggatctccaggcccttgtgggagtgagtctcctgtatggataaccccttaagagttatggataaataatccattgacataatcaaataagatattcatttggggttacaagaaaagagattccagtatgagatagaacattgtacaaactgtccccttttctgaatcattttaaacttcacagtcctataataaccaagcattcatacttcacttttagagtagtataagatttgatactctaatggcatattgaaattctaatcatctggggaaaatgatagaaagaactggagctttggggtcctacagcactattattcatttgtgtgggcatattatatcacttccctgaagtttgttggttcagctgtaaaaagtaacttatgatgcctactttgcttaattattgtcagcaagtaatcagatatatagccgccccgtccgggaggtgaggggcgcctctgcccggccgcccctactgggaagtgaggagcccctctgcccggccagccgccccgtccgggagggaggtgggggggtcagccccccgcccggccagccgccccgtccgggagggaggtgggggggtcagccccccgcccggccagccgccccgtccaggagggaggtggggggggtcagccccccgcccggccagccgccccgtccgggagggaggtggggggatcagccccccgcctggccagccgccccgtccgggag

SEQ ID NO: 92828 - DNA, 1050 bp, Homo sapiens
ttgagcctgaatggtctcctgaatagagcacaccgatggctcttgactttcatccaatttgccagtctgtgtcatttaattggggcatttagcctgtttacatttaaggttaatattgttatgtataagtttgatccagccattatcatgctagctggttattttggccgttaattgatgtgatttcctcatagcatagatggtctttacaatttggtgtgtttctgcagtggctggtactggttgtttctttccttgtttagtgcttccttcaggagctctgacttctttcttgagcgagatccagaaaccctctcttggcgtctggatctggacacctttcccgtaacgctttcattctgcattccagccaagcccatgtacttctaggtgccccacttgctcctttgactagtgacctcttcacattcctcctttcttgtcttagtttctattcactcttgaggactctccttggagatgtcacctttcagcaaccctttcctgaccttgcatgcccatcacttccagtctgcagagtggcccttctgagggcttccatggcaccttgtgtttaccctgttgtagttgtaggatgatcatgcctctttgtaatgtcttttatctctccgtatttacaactagactttgacatacccaggggcagggccttgatctaattttgtcaccagcactcagcccaaggcagatgcacggtgtgcactcagtggatgtatgttgaatgaataaacagccatcagtagcttgatgccgttgtgccccttcctgcatgacttccgatccagggtggcattgtcccaatggcaaacatttggtctcagttttttgtttctttgtttcaactcacttaaagtgtcctttttaaatgtctcctagggccttcttacaggaattacttactgcagagtaactgggtaattttggagcattctgaaccacaactttccagggacatgttgagaacatgtaattttattgcacttgtaaagaatctttgttttctccgtatgttgatcagagttgttcagt

SEQ ID NO: 92829 - DNA, 1024 bp, Homo sapiens
tacaacatatgtgatttgatatctactgctatcacttaaaaacatacaagaacacatctacagctgtcagaaaggttgcatctttccttttcctcaaaccatttctactgtgtcttttgtcaaagagaaagccagatactttttaaaggcagtaaagacagattttcttaagtactaactactgcagagggaagagagcccagcataaaccaagctcagcttcaccaaaacaaaaaaggcagaatactttttcaacactggggtgtgtgaaaggaaaggcacaaggggcgttaagggaggtttggtccatgtaactgaaccatcttggtttgcaaattggcacttatctggagaagaaacaaactgctcatgtctttatgacagcaggtagttgtgcaagttggaacaaggcatccatggaagtgaggcccttaccctcccacagagagttggctccttgagtgtttatattgcaaagagactgatcccaggtccttcaggaaacacactaggtggtagaagatttacatctcaaagggacagagaaaggattataattgcaagctttctaaagtaactgctgtaaagaggggttgaggagcctattggcttatcaccaggtgttggctagaacaaacaatgcattctactgacagctttgaactttcttggcattttgacggggactggagtcattctagggacatggccttgctagaagccctgctaaaatttggtcaagcgtattaatgcaggggtttggatggagtcattttgtgtggagagtttgtgtagttttcactttcgtataattttattgtaatgcaattcaacgtctttgtgcttaaaatcatgtttctctgcatcagaaataatcaaatagaaagtaacatttaaaaaatgtcttgtgactctagggtttcaagggtttttttaaaaaatctatattcagttattttttcaattattgcagcatatatttgatcagagcagcattgatgtatcgggggaacccacccccaat

SEQ ID NO: 92830 - DNA, 1021 bp, Homo sapiens
atttataaacagcacttaacgtgctatactaagcactgagaagaaaagaatgactaagtgggggtccacagcctggtgaggagagtgtacaccataaaagcacacacagcatttggcatcagcacacagagagatgactgttaggctattagcaaaacataaagtgatttattgttttaatgaagttagttaaatatagctgagataatttgatgtctcttttgtggctccaatgtttgctggctcctgcaagccatcctgttatcatcagagcagatttacaggtgctttaaaaactctgagttataactcactagtgggtcctgtaattagtttgagcattgtggtcagcattaaagacacacaagcaaaacagaccactagactgtggattaggatcggaaacatcagaatgtatctccccttagtagggggtcatatcgtttcctgacatttttgtttgctttcagtatatgcaaatatgtctgtgtatatatatgtataataattgacttttgatacataatattgtttcttactgttggtcttgggcaaaaaagtttgaaagctactgtgtcaacttactggcagctgacgacatacatcagaggagtgcctgctccaggagctggcataagacagcataggagtgtttttcagtcctttaacataatgtcatttacaaccgaaatcgcctgtctccttcaaccccatccactctgtccagactcttgcagtgaccacctcactgtacctttgtttcaagtcccaggacccacctccattcacctcctaaactcaccattggccagttggttgggtcactcagaagcttaaaggctccagagctgcacactttctttgctattagaattaaccaggaaatgctcatgcaagatactggtttctttccacgaatgccgatgtctttcccaaacccacggattgagtcagtaagcctgataagagccagggaatttgcttttttgaggttgcacttaggtaatttcaatacaggtgg

SEQ ID NO: 92831 - DNA, 1038 bp, Homo sapiens
tgctggcttcttctgttagttaatctctgaaagttaaatatgcactatgtatataagctgctttataactaaaacttggttcaggaaaaatcacttaaacaggtttgaagggtaatcattaatttgattagtgaaaagtccacagtggtttcatggtatttctttctactctcttgaatatgggttctttggaatttttttctaaacaaagatttcaaagaaagatttcccttttctggttccaaagggaagataacagcttctttcttcagaatggaaactattaaaatgagctattgattactagcatctataaaagatcttagcaccttgtaatttactgaaaagggaggtttgggtatttatcatgagtcagtaaaggtattccagtatctgtcttgacaagataattgggtaaaattgcacagcaggcaaactaaattgtaggcacagaagaataagtgagtgggcaagagggaaagtaatgttgattgagagagactatattcataatcaagtcaaacatagatgaactaaagctgttatgatatagtcattgtccattttgtagatgagtctgtcttgaatactttgtttatcaaggtgttacgaatgaagtatgacaggagaactcttttcgattattgctgctgggagagagaactcatatctgtgttgcagaaagaatcctggttttgaagtggttgttgatatgggtgcttgaccttgatggttgctttgtgatgtcctgagcagttgtgtactttgagtccagacagatctggactctttatcttaaacaagtcatataacctctctgaatggcaatttatcatctataagttgataattacccaactttaacttagcaagaaagtaatcagcatgataaatacaaatttgttttctttcctccttttggcatgttgttctgcctgcaaatctttgtcaataagattccttttattgcgactacacagtttcttatttacttccttactacattgtttttagacttcattttgcaaattatgaagg

SEQ ID NO: 92832 - DNA, 1307 bp, Homo sapiens
tatgtagcatgtcttcccaggaattgggatggattgaattaatgctgttcaagtattaaactccctattagtaattccaaaatcatggctcagctctgtaacttcattaacacccagaccaactttaatataaataaatgtggctagttaatcacttactctcctttcctgtcagctgttggattctaggttgtgttctatttgaatgagtttcttgttattagagaagctgctaagaatcgtagaataatatcccattgagccccaaattagaggagtaaaaattggttggatgcctttttttatgcaacttgcactatttatgatttcaggaacagggtagaggttttttcccgaacttatccctggagaaaatacttttctcctcaggggtctagccatttatagtgaggttattgaactgcacctttgttattgagaacacttactgtagtccacagaaaatttatccagaggcaatggcgatgaaaattacttctagagtgagttactgtgagtgatcagatggttggcagacaaatctgatggaggtttataatagttgaaagagcaagaatatattgttttttaagtgttcggaggttttgaggttgaagaataacagagcaagagttcaaaaagctgtttttgggcctagttctgtgtcctgtctttgtggtctgctaactgggtaaagtgccacttctgcaactgacttttcagggccgttgtgagccttatgaaatggcaatagtgtacagggccaaacagttccttgcagacatggtcttcttccatttgttactcacttgctcgtgtttgtatgatgttggtaaaatgtcttcttttccatgtctttcataggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagagtaagtgataccctttgtttcataaggggatggatttaaactgcaaaagaataagttcagttaccaggactattaatttcagtcctttgaagttttacattcatggttgctatgaatagggctttccccaacttcatctagtcttatgtgggatgtgtgccttctccaaaccgatcagtagatgcagccagcattcccagctaaaaaaagttt

SEQ ID NO: 92833 - DNA, 1284 bp, Homo sapiens
ttgtttctaattccacagtcttttcacattttctctttccacctcctggatatgcgctgcaggaatgctaacttaggtagattactagccttggataaaagtattgatagaatttgtgggcttatttctcatgcacagcctgtgcatcttgaagggcagcatcgtcctgagccagcagaggccccctggagcccagcagctctctcagatgatccatggagctgcctccctcgcctgcatttttccttttaattttatgcattgatggttagcaaatggtcagtctgagagaattttctcttctagtatttgttctaattaactcatttttacgtttttaaaaaatacacatgtgaccccaaaactcaagtgttgaaaatagtatataataataagtcagtgtttcccatttgtatccatccagagatagttgatggctgtacatacttatataactattttttagacagatgtaagtaggctgtgcacattgttctgtatcttgattttttttccctcatatcttacctttgtaattgttgtaaatgtattttgaagtgtgatctttgcagcattcttttaaaaaagtgttcagaaggtaaaatcggttaaaaatggaaacgtcctttagttttatagactagggaagcaaactcagcgggggatgacattcagaattttatggtagactatttctaaaatgcgtttttttaagctactaattgaaaatactaagtagaaaattatctcaagcaaaataacaaccctaaaggggaaacacaccacctgtttaaaactttcgaaataatattaccaagaaatgtagagactattaaaccagaatagatttattacctctagtagtaagcagtagattaagtcattgagcattttgttgtcatgaatatttatgcacattttgtttttacggggatttgaccatattctttaaagaaatcatactttattcacctccctgaagaactgcattgccaagttttgaggggaaaatcaagtaatttaactcttcacaatttcctttttaaattatgaatggctttttatgctgttagtttttgcagcctgtgctattttgccatatcactttgaatactgaatatggaagattttgaagctgcccagagagctcttcataagcttcctagaggctaaaagctttcatacccatgcgtcatgtcactgaagtcagatgctggaaagagggagggaagtctgagtgtactctgaacaccaagacttccgagtgattctgggtgtgaagct

SEQ ID NO: 92834 - DNA, 1051 bp, Homo sapiens
aaagttactgtgactctgaatcctctcttgtaagttgaggaaaacatctaacttcttccgtagagaggttgtgagggggaactaattcaaatgattgctgagtgctcgttgagaagcagctaagccacaggaaataagataacagaggtttgtcagctcatcaagtgtgactatttaagtctgttcttgcttcttggtgaaattagtctttatgcttaaatgcaattgttaattcattaataattatgatttatctaaaatggaaataattgtctctgttgcactgtggttgttattggaagaaccttttatcaatcatttttagtgggaaacgaaaacatgttgtaactgaagaaaagaatttgcttactcaagcctgtggtttatagagggatggagggaacctactgggtactttctgtgtgctagagtgatgctctgcactttgcatactttacttcatttagtccttatttactgcttcagaccccaaatgcaaaatgctttgaaaaccagaaagatttttataatttgtttggcatcaaaacctgaactaaactgacatgaggctactttatagtctgcttatctcacttaatatgagtattcagatgttttgcagcagatatattaatgtctttgattattgggtgttcccacaccatacttagggtgttatgtaatacatgatatgtatatagcacaacctcctaaagtccaaaacattctgaattctggaactcaaaattatgtagtcaatcagttggggacctgagctttgatcccaggactttctggttctgacaatggtttccttcctgctgtatcattctgttggattttgtaggcaagagattcattatatatgtatagattttgttgtagttgttgttctaaaacatgcctgggattttggttttatctgggtattggtaagacacacagacatggaaacgattgtcacgaaggaagaagtttatattcacagatgcctaaaaatggaaggcaggacacacccaggtggggaagcatcctggtggtttagaggcag

SEQ ID NO: 92835 - DNA, 1075 bp, Homo sapiens
tggccatataacttgtttagacaatgctttatattcaaggtttgagaactagcattacaaattaaattcgtgcacactgctaaatgtagagcaggttttatttatttatttattttttatgtttaatggcaacgtccatgtaattcagtctctagccagtattacatgttgtgcatcccagtgaaacttacttaccatcttttctgaatattttgtcaaatattgcttcatatggtttgtggattccaagactaagaaacttccaagtgtgggttttgatttctactttattaggatctctgagtctgggtgagggctgctgagacagttttgatgcccagaggtagagtggagactcatgttctccactgttcccatcagttccctacaattcatgttagttaggagagccctgggctaggcacattatagagattaatgcctgggattattgtgtgggagaaaaaaagtcatgagataacttcaacaacaattgtgttagggatttgagaagagagattcctttcctttccatctcaaatcctgtggagagtggtatacttgatgcctgggatttttccagtcttgaagcagctgggaggccatgggtttagtgtggccagaaacagctggctgagtgcagtgctggagaccaggcatatataacttgtccagaagtgtcttctaggaaaccccctttggggaataagtaactgacagggagcttaagcatttgacgcagttttcagggaggatttctttcatttttcttccccagcatttttattgagaaaatttaaaattcacagtaaagttgaaataattttgcagtgaactcctgttcaatcctgctcattctccgttcactcccgtacactcctgtgtaccctccagttaatattgccacatttactgtacctgtatttttccacccctctattcatcaaccaaacccaacttcttttctgatgcatttcaaagtaaatcatagatatcagtaaacttcacctcttgacactacactgcatatctttaactattttttacttttgtgtgttttaaaatttacagtgaa

SEQ ID NO: 92836 - DNA, 1122 bp, Homo sapiens
attaacagtagatataataaccacattaaattatagctcataaatgagagatgactttatgtgtaatctactttaatacttaagactttcattacttcacttgtgaaaataatgatttttatttatatatccaagcaaaataaagatgtaattgttatgcagtagcatttatgttagtacaaatggagccgacaagtttgaagatattgctgttgtccctgtgaacaggatgtttgtctataaatagaacaaaatgcataatttgtgaataactaccaaaattacagatttccaatttcttattaatgttggtcattatgctttttagatggaacagtattctaccacttagagtatattaacattttgtttagctagtattaggtatatcacttaaccaatggtgttttctctagataaatctaattagagttagaaatggattgtatacaaggttcccattaaaaaatcatttgcactgtgggaaagcttgttatgagcattttaagtggctacagatttatacgactggactgattaatgtttaaaacttgagcatgggctaagtatagagctagtttgaatttgtaaaattattgtttagaaatatttaaataaaagtgagcagaatgtcagttatattacagtatcttggccagcatttacttcttccattcaccagttggtggacatttgggttgtttccatttcttagctattttgaataatgctgctctgaacattgatgtaaaagtctttgtatggaaatatgttttgatttctctagatgtagaatttctgcattgtttgttatattatgtctaacatctgaagaaactgccaaactttttgttttccaaagtgtctgcacatgttttacatttccacaaggaatatgttaaggttccaggttttctacatccttgctaatgtgtgttattaactgacttttttaaaaatttattttactttaagtcctgggatacatgtgcagaatgtgcaggtttgttacataggtatatgtgtgccatggtggcttgctgcacctattgacctgtcatctaagtttcctctcctctcccgcaacccctcaacaggccctggtatgtgttgttcccctcc

SEQ ID NO: 92837 - DNA, 1044 bp, Homo sapiens
tgccagtgctctggacagcatttgcattccaatttctaaatagtagttgaatttttatgatgagaagtttattgctgcatcatcttcatccgttcacttaatctgctggtcattatttttcaagccctttttataacctggtttcttttggaaacataaattttcttctctttcccttaccctggtaataccaagacttttttgtagggttccaaactaccatgattttggacttcctggtttgggtattttaattgggaactaatattaatcattgatctcttaggagactgatggctaattccatgcttcataagtggattgaaaggtcaaagcaactttttcctctcatcatttaaaatccctgtaatctctctgttttattttttaagtaatttgaaagacagtgttaacaagctcttctatcaattgacgttgcttgtcataatcattaagtcctttgcttggacttacaggtgagaacccagaagaaaggcggggacaggttctaatccttttagtggagcaggcacttcgcttccatgactacaaagcagccagtatgcattgtcaggagctgatggccacaggtgagtagacagcttatttaacactttgcttatgtcctctttatgtgatggataatggaaaaggtctgttctgaaatcaattgacctgattggtaagccagccacattgaggcttgagatacattttatgagcactggtaagtatataggctgtgtacttatatgttaatgtaaacattttaacagattcagacattaaattttatttgagattttggttgctttctagtccctattcaaaacatgctcgtaatttaaaaataattttatgcaaaatatttcaatgccatttcctgtatttgttatctaagagaaaatttaaatttttatattagtttgtgtctatatagtcaatatttccattctttaattttttttaaagatagtgtattatttcgttctcacactgctataaagaaatacctgagactgggtaatttataaaggaaagagg

SEQ ID NO: 92838 - DNA, 1001 bp, Homo sapiens
aaccagtgagcatttacatagctggtggttactgtattggatagcaaagatgcaaaacatttctgtgatcacaggaagttctgttgaaagcactactctgccccaacagcttacaatccagaagaccatttatgttggttttaacaacatgcactgcaggctcttgataagtgttttagaatttgtgaatgaaaacttatccataccttcctttaattacttgccaaattttttatttgtaatttttctttttgagccattttatgattcagcaatatggtatttcccatttatatagtatgtatataatatgtatcctgtaccacttaaaatactataagcatgaatcttagatattaatgttatagagatgctgtttgcattttactccttgtgtggctaagtcattgaggtaatgtgaattttaaacacttatttttttttaaatttgagttttaacggtgactccctgatgatcattccttggcatgaacataaacaccgagctaaagattggtgcgaggagttggcttgcaggtcagtatgagcctgcaggaggcatctttgtttctttgtgggatgggtgaactgatggccctgtgaaagtggtgtctgaccaatgaaaccttacttgatgacactccctaatttagaaagtttgagtgaagttttaaactcctttgactcagttatgttaaaattttttaatggaaaaattaaatactacaaaggaattatgttaaaaaatggtgcttattacaacaactgttttcattttgtgttattccctttcagtctttcacatatagtgatattaatttttttatagttgtaattatggtatgtatgcaattttgttcttgatcagttttaattttttttcttgtcagatttaactttgggaagcctcagaatgtgtaggcatccagtactgcagaaggggggtgggagagtcggtgtggggctgaaaattcatgtgaggaatattggaatgcctttat

SEQ ID NO: 92839 - DNA, 1073 bp, Homo sapiens
cctgtaatcccagcactttgggaggccgaggtgggtggattacctgggatcaggagtttgagaccagcctgattgatatggtgaaactgtctctctaaaaaaaaaaaaaattagccgggcctactgtggcgggcacctgtagtcccagctactcaggaggctgagacaggagaattgcttgcacttgagagacggaggttgcagtgagctgagattgtgccactgcactccagactgggcgaccgagcgagactccatctcaaaaaagaaaaaaaaagttgccctctacctgctgtgtacaaatctgactggtggctcctgatgcatggagggggaatggtggaaaaatggttggggactagactatagtccctatgtcctttctacaggcagtttagtatgctagctaaaagtgtaagctttggattctgactggttgtgttcaaatcctggctttgtcaatttattagctttgttaggatggacaagttaatttatgctttagttttctcattgtaatatgaggaagataatatctactacattagattgataggactaaattgagacattttatgttaacagcattgtattgggcctagtccatagtaggagatcagtcagtgctaaagattattgttgtcactgatcattgctgatacagcagcagtagtagtagtaatagtaatgctattattatcatcatcattgtcatcatcatcatatcagtgtgatcagcaaatttagaaacagactggttgtgctgtaccttgaaaatgcagcaaatgtgaaaatctgttttgattaaaaaatatgtatattatatatctgttttcttatttctgttcagtgaagataccattttacaacttactagtctctacataccaaataagtattattttgctgagggttcctaataactcttgcatctaatatatactttgaataggaaatacaaatctcaacttgtgatacatttttctaaaattcttttagaaaacattttatgtagcttaaggagccatgtctgttttaattagaaaggtcataatagcttgctaggtttattt

SEQ ID NO: 92840 - DNA, 1031 bp, Homo sapiens
gtattgttcaatgtatcacagtgcctatcacagctcccttagcacatggtgagtggcactcggttaatatttgttgaatgaatgaatggttcaatctgcatttgacataggtcaccctagcagtggtgaaactaaagttcatctatagaggttcaggtgctcataatacattgtcatgaataactgttgcttatttttacctggtggttgattttggttgtcctactgcaattaacttaatttttactgcctatttcatttacttccggattaaaaaaataacatttattaatatagccctttccaaaataaaggcaataatgcagatgtagtactttagttaacaattgatggttgaaattaattaattcaggccttatttatttaggcaggcagagttgtaaaggtttttaatattttcttgtcacccatatttaaaagccttttcattaaatcacttttcattaaatttcccctcaggaaatcctaggagtgcctcatgcatctgaacagagatatgatgctgaattctttaagaaattcagaaatcagaatattgttctctcagcaagaacttatgctcaggtaatttgctttttgtaaataaaataattatggttattaacactctctaaatctttgagctgtgcagttaatgttattgtgtgcatatattacattttcttttttgttttaatattaataagtgtagagaaaattttaatttaatatccatcattctgagttttaaaaataaataattttcatagccttagattgagaaacaggatataggctaggaaaaactagggtcatttcaaggtgtttcatatcagagctgcataaaaaagttagtttttgaatgttgtcatataaaatcactcctttatttcttagatttacattagaaacttaccccttgccttttgtacaggaaagtaatgtacaagccctggaaattctgtttacttaccatggttccgacctgcttcctcatcgccttgcaattctgtccaactttccagagacca

SEQ ID NO: 92841 - DNA, 1046 bp, Homo sapiens
ttccaagtaaatgagttgttactgttcatttgatagtttctttaaaataactaatcatttcagtgtgttccttactagtaataattagtccaaattattttagcaacttagatcaaatgtacttactattatcttacccttgtgcttttctgaactgtttcatgagttttgggctcaacggaatattaatcattttcattataactcctagagaaataattctgtgtaaatataagtggcctaacatagttattcaaaacaggttgacactggaacaaaaggaactttgccgttgtagacggaagttattaacctacttagatcgacttgcaacatatgaggtaatgaataatttttgtcaaaccaattatgttcatttgatctgtcattataaatgctatggctgccctaatatcggatattcttggtctttagaactatttttctgggaaaaattaatttcttatagaagcaagttctcttatatactagttttggtaaaaattagagattgtgaaagccagaagttgttttgttagactagggaatagaagtgccttagccatttcagtgcatttgtgttttctagatttataatctttttcatttacttttatattttgattttaagataatggcacataacttttttccataccagatttcagtatatactaggttttaatgtgaatatttctgactcgttttattttagtgatttttttttttttttgagataggatctcactctgttctccaggctggagtgcagtggcatgatctcagctcactgcaacctctgcctcctgggttcaggcgattctcatcccttagcctcctgagtagctggaactacaggcacatgccaccacacatggcaaatttttgcatttttttagagacagggttttgccatgttgcccagtctggttttgaacttctagactcaagcaatccacccgcctcagcctcctgaagtgctaggattacaggtgtgagccactatgcctggcgtattttaattatttgttagtgggttgaattta

SEQ ID NO: 92842 - DNA, 1029 bp, Homo sapiens
cttgggactacaggcacacaacaccacacctggctaatttttgtatttttagtagagacgggggttcaccatattaaaaataactggccgtataagtagatttcagatacaactctagaaacccagtgaagatagtgattattatagatctggtagagatggaagattttatatagtgaagatgtttggagcagggatttggaaggatttaaattaggccttcttgaatgagaagggaggaagacattcttaacaggacagatggtatgaacaaattaaaagacactgagcatgatttatgaggccagtgactaaatctgttttattcactgctatatttccatgtctagttcagtggctggtgtgcagtaggtgcccagtaaacattttatggataaatgagctctgtacatcaaccagtttgctggcactgatatttgacaatagtgaacactgggaaacatgattgaaaagatatattgatttgagttcaggaggatgtggaaagcttctgatgacttaggcatttatctactgttgtggatttctgactgtggaagcagaggaagatggtgtagagagaattggagtggaaggaaggtaggaaaccttgcttggggcaggggactcctacagtgtgctagatgttttgtgttgatgatttagactggtatggaggccgcagctgtggaaaagggaaagtgaattaagagacatttgaagaaagaactgatgtgaggcaatatataaaggatcctagggaatgagtcaaatcttaattaaaatttataaccataatagctctttctaggaagagggcaagtcagggattttttttttattttttattttttaattattattttactttaagttctagggtacatgtgcacaacgtgcaggtttgttacatatgtatacatgtgccatggtggtgtgctgcacccattaactcgtcatttacattaggcatatctcctaatgctatccctcccccctccccccaccccccagcaggccccggtgtgt

SEQ ID NO: 92843 - DNA, 1050 bp, Homo sapiens
cactttgggaggccaaggcgggtggatcaattaaggccaggaatttgtgaccagcctggccaacatggtgaaaccctatctctagtaaaaatacaaaaattggctgggcgtggtggcgggtgcctgtaatcccagctactcgggaggctgaggcaggagaatcgtctgaacctgggaggccgaggttgcagtaagctgagatcacgccactgcattccagcctgggtgacagaggaggctccatctcaaagaagaagaagaagaagaagaagaagaaaaaaacaggctttagtttagatttgagctgataatgtatgtgcatatttctgatgtatataatgcttgctgtaaggttcctttgagttccattgttaatcttgatcacatagctgatttaatgaatcaaaccagagtagatttagaaatatattttctttcattaattctaaaaagttattcttatttccttactattaacttcaaatctcctttttcaatttagtgtgagattaaacttgcccccaaacgatctcgtttggagactagagctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaaggtgagagagtagcatattactacccaagtttgaagtcatcaagcttttcttttattgagaaaaagttaattttttaataaaggagaaaatttcaagagggatgttggatcattgacatgttaaaaatatcagttctataaagctttttaaaataatgctaatctttgtacctaaataatcaaaatcaaaaccatggataaaaattgaattcacttagactgattatccacttggtggcttagctcatttctttgctacccttcatgtggccttcagctctccctttatct

SEQ ID NO: 92844 - DNA, 2108 bp, Homo sapiens
tcctcttgtcctgctctctactttcatgtaaccatttctgccgtactttccaaaacttcattccattgtaaacacgcctgtgaggcttcaacctcttcacagacactctggtttctttctgtatgctaattgcatacttgtatagcttaataggaagaaggtacaggaataagatcgtcttgtagcttttacaaaatttaccctaactacatttattatttattgagcactttgtcctatggttgtgcaacaagtaagcaatagagctgagatttgattttatacctctctgacactgatgcatatgttctttccatgactgtgtgggaaagaaatacataaaacaacaaaaagataagtggaagaatacttatttattaggctagcgaatgccagagtgtactacacacattttttcccacaatacttgtgttattagttatttagtggcatcctattatttgaaagatcagatttgtatgtaaaaggttaggaggactataatcactctttataattattaattttttacattgattctttttatttgatgatctttaaaaacacagagacaaatcctttttctcggtggatgtgatacagattccttcagctctctcagatatgcttaactcttgagctagttagtgtgtaccagataccagaataaataattggggaagcctctcattggtaaacccttagctttctaatagatatctagagtactcatgatgtagtggggttgggggaaggtggtaactttgtcaagcaagaagagtttgaacaaccatagtttctttgagtctttcacctgtatcctgggaatcaatcacttggatgttttagatttgaattttagcttatgaattactaaaatctagtgtattatagtaagtataataaagcctatgtgtaacaggactgtacagtagagtaggttgttcctatttacgtaataacataatggtgaaataataaagttcaagtatttattgactctactaagagctccagtagggaatacagtgtcatagtccctgctcttaagatattcacaggcttccaagggaaattatgaacaaatgattaaaatgacatgttaatattttgagaagataagctcaggaaaggcatgtaggtcagctgatagtgttggggagaaggattattggaaataaatagtatttgtgtagtaaggcttgactatttacagagcatagttttcatttgtctcacaacaaccctattaacccatgtatgctggaggtggcaaattttttttgtgaaaaatcagaccttggccatgaccttgagcagtaggatttaaataactcccacaagcttagcattccaataatggaacactaggcataaatgggtgggaatggtgctaaaagaggttaacttgagatcactaaatgttagagtcaagattccattttgattgaagtctcctgacttcataggttaagccttttttcagaatatctacttacagtacttacatttagaagtattgacttttatctgggtaaatcagagactagcatatgatattaatggtaagcaagggagatatatcagcttgaagtttatatgaataacatcccctggagtcacgcagttcattatgtagagaccctagaaatgtgcaagtagtaataactgagaggtgtaatacagttgtttaccaaatatgtaaagtggctgtgtgtactcatcactggaatcctttaaagagaaatcccaagctttgaaaaatactgagacagctactcttctttcatgtctctagtaataatcaagtgagcttggatcagccaggtagggcagagtttcacctctctttatggctgctctagtaagtagacaaaccgattagtttcaaatcgatgatatggtgatatttaaactagtcagcttataattttagtttaaatgttgtctgagaagaaattaatgttgctgctaccctgcacagccttaaacctctttaccaaaattgtgaattcaactcatttggggctttcttcatgcaatttgccgctttattagtttttataatatgctttgtgtgattgagtattttctctgtaaaacctaat

SEQ ID NO: 92845 - DNA, 1029 bp, Homo sapiens
agtattttcactcagagtggacttagtctttttggtggtagttttggttttagatggaccttagccatttttgctagctcccctctgtcctccctgggtgtttttcaatttgcttttgctcaccaccacaccttgtggcaggtcacaatggagtaagtggggacataggttttagcaggagcaatggagatgacacattgggatttggtgatttctttctttttgcttacagttattgtaaagtttgggttattctctatcttcaggctaagtggagagtatggtttttgtgtagatttatctccctttcttgttcttgatttttttggagaaagtatttggagaagtgtatcaaggccatccctaatgttttcaactcagaagttctggctattgtgaatattgttgctgtgaacattcatgtacaaatatttgtttgaatgcttgttttcattcttttgtgtatagatctcagatggaattgctgggtcgtatgttagttttatgtttaagtttttgaggaaccaccaagcttcttccacagtggctgtacggttttatgttcccatcaatagtgtatgagggttccagattccctacatcctcaacaatgttattttccactgaaaaaatatagtttctaagtctaaagacaaaaaattgtcatgtgttatattaaattattttatgcactgatttctaatgatgaagtcttttttggtgtttttcaagcatagaatcaattgttaatagatgaaattgctttgggaagttttagctttttctatactgatgttaggataaaatggcaaccttgggcagccttacttgagaagagcttgcggtggattttgatttgcataaagtttactggttatatatttaaaaaagcatttgatcatggatgtcttttgtaagattgtaccacttggtggatttttttttcccaaacaaaaacaaaatctcaccaagatccttgacaccttcttggtgattttctttaatcaattaaaaaaatactagatttgc

SEQ ID NO: 92846 - DNA, 1022 bp, Homo sapiens
tttaatgtgttggcagctatttggagtgctttttatatgctctaactcatttaattctaagtaaccctttgaggtaaatattgttactggcccgagtctgttgatgaggtggtaagtgaggtgtagttaagtaagttgccctgatcatccagctagcaaatggcagaattagagtccagatttccatgttgttccatatttacatggactattcatccatccatccattcattctatacttacttattgagcttctattttgtgtcaggcagtccttggggctgtagtagtcagcataggctaggttctattttgataattcaagcaatcaaatgagcaaatgcaaagtcctgaaatttctgtggcttatcatatacatattttttccttattttgtggcaaagcctgatgttgagatcatgactctcctgggcagcttgttttaagtgatgattaaaagatccatggagaatggtgaccttttggggtcccactatctccgtttatggtcttaggaagggaagggagagataataggtggaactttttactgtcttagaccagaagtgacattggttctacttacagttcatttattgtattatggcccctcctagcttcaaaggggctgggaaatagttttctatgtgtccagaaagatgtgaaaaactaggtattggtaaatactaattatgtttaccatcctggccacactgcagtcttgcatgtcttagttatttgtgtaaactgtatgaaagtgagcacttgggccgggcgtggtggctcacgcctgtaatcccatcactttgggaggccgaagtgggtggatcacgaggtcaggagttcaagaccagcctgagcaacatggtgaaaccccgtctctactaaaaatataaaaattagctgggcctggtggtgtgcacctgtaatcccagctactcaggaggctgaggcaggagaatcgattgaacctgggaggcggaggttgcagtgagccgagattgtgccactgcactccagcc

SEQ ID NO: 92847 - DNA, 1039 bp, Homo sapiens
tcccgccttggcctcccaaagtgctgacattacaggcatgagccactgtgctcagcctgtttaaatagctcttttattccacttgtgtacttccaccatcacagccttagttcaggctcttaacattttttacttggtttcttacaacagtctgctgacaaagttttcttctgtatgccctctagtaatccacactttatactccttggcaaattgatcattaaaaaaacactattctagcaggtaacccttcacatctgacttaactgctttctagatttctggtaacctcgggcaagttacctctctgagccccagtttcattatctgtaaaatgggcataattttataaattgagttgtggaaagattatatgaattaatgtatgtaaaactctcggcatagtgtctgacacatcatgaatacttaggagatgttaagctattgttataattactgttactataattctacctgaaatctgtcagttgtttgctattgactggaatacagttcattttttctaatttacgataaaagacttttcgcaatcagcctgtctatcccgtgagagtctcctgctatatgtcttatgttctagtacaaaacagtgtgcaattttctaaccccattgtgttcttcatgccttcacgtacagatggttccttttctcggaagctcctacctttgtattgaattaattagtcttgtatattttagatcaagcatcggctctcctccctgtgttcgctcccaccatttgtacatcttcatgtttcccatctagttgcttctgcctatatcacagcacttacttagcctgctttccttttttattgatttaatttatatatattttttgagatgaagtcttgctctgttgcgcaggctggagtgcagtggtgcgatctcagctcactgcaccctctgcctcccaggttcatgtgattctcctgcctcagcctcctgaagtagctgggattacaggtgcgtgccatcacacccggcatttttttgtatttttgatagagatgcggtt

SEQ ID NO: 92848 - DNA, 1047 bp, Homo sapiens
gaacattgatatgatgcctggaaagtcagcaatgagtcccgaagataaaagccgcacactaagactactgaagcagaaataaaaggctggatccttaatgatggtaagcccaggtctgtctacctctagacctctcttgcagcttgagaatgtcccagttaagccactttaaaatttcttttttctgcagcccaacactttgctaagaggtacagaaaagaaaggaaataaaacacacatcattatggatattgtgtaatgtatctttcaggaacattttttgaatgtttcataatacagcaataatcaagctattctggctaaaaggcggaggagacatttggcctgagttgtgagggaaacatccaaaattatccctgaatatatggccatttcctcacaatgaaaatgaaggtgaaatgtgacatatacagtagaggatgtgactctgaacccagcctagggaacacaagtcaaattaggttgtttagtttgtcctttcattgacatccaccctcctcctcagttcctattcccaggtccttctggaacaagataaagccagctgcttagtttctgaggatctcaccaccaagaaggaggaagcagctagagagagaatttgttttaatctaaaagaagttgagtagaaaatacaatatcgtcatccataaaccccctccctcacaaagtccttcctcacaatatagaatacaaacctacccatcatttcacacaagtaacagtaaccttccccctccataaatgctgtccgtgtaggttgccccagatctacctgttaggagggaaaaaacgactcaggagtacttgcactggatcttgaatcttgctatggtcagtctttccattaacaaactctctccccttcaacacagctcttagttggtaaggctcctgaatccaccctccataggatggtcctccatgtccagcctcctgcttacttccagccttattacctgccactctccacaaattttactttctagcatatcaaactgtgtagaaatccttgcatatgccaca

SEQ ID NO: 92849 - DNA, 1072 bp, Homo sapiens
ccatatctccagtcatgtaagatattttttttcttttttgggggggagaatgggggggtggggggatgtagtctccttctgtcgccccagctggagtgcaatggtgtgatcttggctcactgcagcctccacctcccaggttcaagcaattctcctgcctcagcctcctgagtagctgggattacaggcgcctaccaccatgccctgctcatttttgtattattagtagagacgggggtttcaccatgttggccaggctggtctcgaactcctgacctcaggtgatccgctcacctcggcttcccaaagtgcaacagtcatgtaagatttctgactgtttcagttacatcttctaataggattcaattggaaactgctcagagttgttgctgtttttcttttcccaacattctcctaaaacgattttagagccaaggtctgtaggatagttctaggtagtcattttataggttcacatctttgggagtcatacacaaatttcatgaatgttagaggtaaaggactggaaaaagtctgtgatatgaaataagacaaaactggaatttcacgaatgtttctaatttttccttaactgttaaaagtattatacttaaggtccgctttcaaagaaaacttgcagggaacatgaccagaatggtacaagagattgtctggaatttactgaaaatgatatgttgtttcttgtataacaattttgcaaagagcttcagcttgcagtattccgtatgcagtaagaacacaccactcctttgtttcaagcagtttgcattttaggagagagaacatagactgtaatacaggttaattcttaggaaggtctgcctggatattcaactttagatcttcattagtttatctgtggcttttttttttcctgagattaagagctaggaaagtcgccaggtgcagtggcttatgcctgtaatcccagcactttgggagtccaaggtgggcagatcacgaggtcaggagattgagaccatcctggctaacacagtgaaaccccgtctctactaaaaatatgaaaaaaaattagcgggcgtggtggcat

SEQ ID NO: 92850 - DNA, 1180 bp, Homo sapiens
agggtattcacatggtcctagaatagccaaggcacataactgccacattgtctctaaatgcaacaaccctgtctattcttggcagacttttcacgagtcatgagaggtaaacaggcactgtagtggctacagtttattaggtgacaaccatgctccagttgcattacatgattatctctggtcttcatatagccctgcaaggtaggcaatatcagccccattttgtgtggagaaaacagatttatagctttgcctaaggtcacttgctaataagtgagaacttagatttgaactcaggtctttctccagaacttgtgctctttcaacagtgccacgctcagtagatttgatgtaactgagctatccttcaaaatctttaccctgttttatgaatagtaattttgagagcaatgcaatttatcatttcagtttatgtggtttttaaaattaatttttactttcagagatgggtgtaatgcctgagattgcacaagctgtggaagagatggattggctgtaagtacataaagcctaaatgtacctgggagaggatgttttataatttaaacagttgttagtgattttatcaaatatttttgtgtctagttgggtaagtgaaaatcaggttttttttgtgattttctaaattatggaaagtttcctttttttaaccttgacatatttctagtggaataagatggatcgtatttaccacgtaaaattttcttttaggcaaattaacgtgacttaatttgcttaggcgatttttttccccagtaactaaaattcttcaaatatgattcttttagcctcccaactgatatccaggctgaatctatcccattgatcttaggaggaggtgatgtacttatggtaagtttaaatttggtgaggtgattggtagctggggacacactctaagaattgcataggcttacaaatgctactttacctttattcacaaacatttatgatacatatactgtattcagactattaggtaaaagcttcaaacaggtaagtatttactcctgagaagcttaaacccactagggcaataagacatgtataagaatgaatctcgtatcagagagaatgtggcttcttcgtaagagatgcagagtagtatagaattcaagtgggaatccagttgtccttttgcttgaaggatcatagggac

SEQ ID NO: 92851 - DNA, 1031 bp, Homo sapiens
ttatgaagagctaaaaaaagtatgaccttaagaacatagttttaaatgggcgttagagagttacaatagctttagtgtttatactcacttctgaattttaatatgatgactcttaaaataaaaaggttacatacagaagttgatctcctactggcctggactagagaaataatttgtcggactggatggtatttttcctctttagtgtaggttcattctaccagtctccattgttctatctttttgtgatgttagctgcgtcctatttccttcattcagtccactctgtgttgtctgatgggtatttttggtttgggtaaatgaaattgtagtagcaatctggaatatgtatgattagttgatgtgtgtgcataacttttgtcatttatattggttattaaattgtcgttaatatgtgaatactaatatagataccttttgtttctttgataggcttttagtattccagttatccagatagtttatgaaactctgaaagaccaacaggaaggcaaaaaaggaaaaacaacaattaaaactggtgcttcaggtaatttttgtaaattgatatttccttttatataaatcattggttctcatcactgacagttaggaaagtgagatttgggtatgcatttttaaaatcttgtcagtatctggggggtggtattgggatctggaaccctggaaaccagggatgctaaatgttgttgagagcctaaacactgcaaggttgtccctcctaaaatactaatagtgttccctttgagaaaacactagcattttggagattacatttcaatattatagtgtttttcttaaccttataactttctatgcttaatgctaaaggaaaataggtacattttacaaaaatattaaggaaggattttacaaataatttatggagtaaaaacccatgctggtgggaagtattgccttacagggaacagaggcattttttttcctctaagataagaagggaaccacctaggaagttaaaatataaattttaaagttgtttcttatgt

SEQ ID NO: 92852 - DNA, 1034 bp, Homo sapiens
cgctctgtcgcccaggctggagtgcagtggctcgatctctgctcactgcagtctccacctcctgggctcaagcgattctcctgcctcagcctcccgagtagctgggattacagtcacacgccaccatgcctggctaatttttgtatttttttttttagtagagatgaggtttcaccacgttggccaggctggtcttgaactcctgacctcaagtgaaccacccacgtcagcttcccaaagtgctgagattacagtcgtgagtcaccgcacccggccaagcattttaaattttatatatctgtgggtaacttttcttattttaatttgtttagtgctgaacaaatggcagatgaacccatatgacagaggatctgcttttggtaagtggatagactttccatcagctcatttgtaattcagaaactttaaaaaataatacatgagaacaccaagtaaataagattaagatttaatttaccagatattagaatttagtcactatcattaaacagtatagaactgacataggaatagacagtggaacataatggaaataaatctcagcacatatgagaagttatatgcaggaaaaataattatatttcatttcagtgagacaaaaggatggtttattaagtaaagggtgctgacacgatccatctggagcaatataaaattgacttctatctcatatcataattagaaataaattccatgtgtatttaggacttaaatatatatgtatgaatttgaatacagaaaactacatgtataatttagcagtggcaaaactttcctaacccaaatagaaaatgcagaaattataaaagaaagtatttataggtggagttggacagtcctccttcttggggttaacagaccttacagtggcttttatccaattcaccaggctggctgttcacttgggaataacctccatcatgcatagagccatctgtgattgttccatagtgagcagcgagacctgcatcaactcaaatatgcccttctattctgctgcatttaaaactaag

SEQ ID NO: 92853 - DNA, 2684 bp, Homo sapiens
cagacacatgtttgtttattcttggtttcccatactttcccattatggtttcttccagctgagaactgtaattcaattcaattctgacaccgtcttcatgaagatagcatcatatcccacaggttgagggttcaatcacacaagactgtcccccacatctgatgcccaggttgtggcttatgcttctaacctattggctataaatcagggttcctacaattccttcctcaggttcaattaatttgctagagtggctcacagaactcggggaaatatgtttactggtttatttttaaagctattataaagaatactgatgaagagatgcataagctgaagtacaggaaggggcttggagcttctcccctccctgggcatgacacccttcaggaaccgtcatgtgttcagctatcctggaagctcctagataactttttaaaagttcagttctacataattcagtacccatatgggtaagaattcatactttgaataattaaatttctgaaaagtgtaggaagatgtgtgttgaggtgcttaacagtttgttctactttcaagtacagaatacgagttggaaagatgaaccaggacagaaattatagtttttttccagtacagacaaaaagctgaatctttacttaaaaccatttagtatgtggacatcactgagactgatcatgatgtatagtatagaatatacctcatcttttagagcccttataatattagcaagtaacaaatacatgcttatttattcatgctttctcctagtttcccatatggtttcttccatggattgaggaacaagctagagacagttctgttatcttttagttatatagtcactcaagctctaatttaagtataaaatcaggacgaatattgatgagcgagttgtgcatcatccttgagtacgtttctttaaagggctccagagaatagttatctaaacacatttgtattgatggtgcaactactattagtgcaagtcaggttaagagctgtgttgaatcctttctagacttgttgctgtaaaatcttaccttagttaacagatggcagcatagaaaatagcccccaacatagccaaggacacccagggaatgaaatggttaattacacttgggaaatactactatcactcaggaatcagtaagtctcagtctctggaacattgcaacaaatgaaggaattatcttgttagtgagactgaatgattttttttggtggtagggggtgggaatgtatgatttataaaacctgtactgacgtgtttttctgtgttttcttctcaaatccagcaattgggtcagatggtctttgttgtcaaagcagagaagtaaaggaatggcatgggtgtagagctactaaaggattaatgaaaggtatttgaacagcatctgcacttgtataaacttttgaggcaaggtattaatacgtgagggtttttttgttgttgtttgtttgtttttgagatggagtctcgcacgtcgcccgggctggagggcccgggctggagggcagtggtgccatctcggctcactgcaacctccacctcccgggttcaagcaattctcctaccgcagcttcccgagtagctgggattacaggcgcccaccaccatgcctggctaatttttgtacttttagtagagatgggtttcaccatgttggccaggctggttttgaactcctaacctcaggtgatctgcttgccttagcctcctaaagtgctgcctgcaggcgtgagccactatgcctggcccatgagtttttaaaaatagctttaagtcgaggatctgggaaggtgtttgatggtacaaatatacctataattcttcatttggtacatacctgtgtaattcagaaacaatgggaagatgacttcatggtaaatgaatcgtgtgtgtgatttatataaatctcaatgtattttacccttgtagggaaacactactatgaagtatcctgtcatgaccaagggttatgcagggtcgggtggtctaccatgcaggcctctttggacctaggtaagtgtttctaaaataactgaattgattgatttacatttgggggataacattttattatttggggaagcaaaataataaatttaaccataaaaaggttttattttaaagacatggaaacaatatttatctgtaccccaccctgttccaaaaaggatttgaaggaacttacaaaaagtacagatattatagcagtatgaaatgagggataagaatatgaatggagtcagggtaaagttagtgtgtgtgaatctgtaccacacagtaccatatagatgcttcatgttattgtaaacttgcatctgaatttcttagtggacaaagcagagagggatgcagtatcactggtgtccctagtctcacacacgctctgtggcctaagcactgtttagttttttgcaggattcagaaacttagggaatagttttcctgtgggtttatgaaatggacatactatgtgaataaaattacttcttttagaggtcttttaattttatattttctcttaccagaaaagtaaaatattttttaaatctaggtactgacaagtttggatttggctttggtggaacaggaaagaaatcccataacaaacaatttgataattatggagaggtaagcgattatgttatgacttcaacatagcataagt

SEQ ID NO: 92854 - DNA, 2514 bp, Homo sapiens
agaatgagggtatacaaatgattctcaaaatgagcagattttctgtatattttccacagaaagtttggatttggactttagtgaagaaatattgtcaagctagataaatatgtagtagttataatttttcttttatgccatttgtcatcccctccaaaatacattacgttgtcttctcttttcacctcattttgattttggctttgatacatgttattctcatttcttattattgatcatgatgagtctaaatatagttcgtctggtgagctgaaatctacagtagtgtgaatgagcctaaatatgttgattctaacaagcctgtcaaatgcttgtactattgtatatgtcatatgctctaataggcatttttgatttaaataattattttgaaacacatacttttgatgcagctatattttaactttatttaagaatttactttctattaatagcatttgactttctggtgttctaggaattcactatgcatgataccattggatgttacctggatatagataagggacatgtcaagttctccaaaaatggtaagctctatatggatcttagtagtgaaaagatacatgatattcaataattgtggtttttaaaaatccccccaccctgtttttcaaatccccgtccctccctccctgcctttacttgaactaatatttattgagcattgactatgtgtaaggtaccctggtaagtactggaggcacagaagaaaatggaatagacatttggggcttacacactagtggtgaaagacagacatataataccatgttaggtggtagtaagtgctgtgaaggagggtataaagcaggggaaggaagtggagagtcatagcggtttgggggtttgtgcttttgtgtagggcagtcaaaaggcttgataagggacatttaggtagagatccaaatgagttgggtggtaggccatgcagatttctgcaaagggaatagtaaatgtggatgccctgagatggaagcgtgcttgaggtgtctgagtcacagcgaggaagccactagatctggagtgctctggggataaaggacggtggtagaatgttagatgagtgaggtggtgaggccaggccatggagagccatatgggccatgatctaaactttggtttttattttgagtgaaatggaaagccatgagggttttgagcagaggggtggcatcatctgtctttagtttaacagtaccattctggctgctttgttgaagacacattggagggtggggtgagattgcctagggattgagggtagttaaagagaagaagagatctgaggcctgggttcctgtggttaggggtcagcaaattgaggagaatccagcagaggggaatgaggaggaaggccaggaggagaaccaagaaagcatgggtcctacagtcctggtgaaggaagtgtttgaaggatcagggagcaatcactgttcagtgctgcggatgggtctagtctagcaagatgaagaatgtgcattaactgctgcatttgacaagtggaaagcattagagagctgttttggtggagcaaaggggtgagggtggggagcctcctaataaggagccagttcaatagagaatgagatgaaagaaagtggatacagtgtaaatggaaatcggagtttcactacaaaagggaggagaaaaatggaaggtaaatggagggagaggtgagttcaagggaggttttcttgtgtgttttactgtgagagtatgtttatatgctttgaaatgtctaatggaaatgaacttgtagacagggagtaatgaaaaatgtagaggggtagaagtgacagtttcaggagtaaagtaaaaaaatgaagaagctggccttaggcagcacagtttatccatagtgacaggagagaggcatgaatgcaggtaagctggtagatttgacattgtcagcatgaggaaggtcttttctgattgttttaatctctctctctctcttgttttttaaggaaaagatcttggtctggcatttgaaataccaccacatatgaaaaaccaagccctctttcctgcctgtgttttgaaggtaattaggaatctagttagaaaaaatttgctgtggttgtaagctgcttactcttcattattttgtatacgatggttttcaattagggtaggaattttaattttctgttttattcaatgctagaatgctgaactgaaatttaacttcggtgaagaggaatttaagtttccaccaaaagatggctttgttgctctttccaaggcaccggatggttacattgtcaaatcacagcactcaggtattatacctgcaagggtaaggatttctagaatagtgagaataattgatgagaactccagtaagtaaggcgtctcatagtgagttacatatactttccttgctggtttagtcacacatctttttttaacacagcagtaaaattcatttttaaaacctaattcataaactcttaagtatttggtttcagtgtaggcattttgggatcg

SEQ ID NO: 92855 - DNA, 1018 bp, Homo sapiens
aaaagcctgtgtttttttttaggttttttttttttttttttttttatgaagtctcgctatgttgcccaggctgaagtaagtggctgttcacaggttcagtcttcctacactgtagccttgaactcctagactcaaggaattctctctcttgcctcagcctcccgagtagctgagaatacaggcacatgccactgtttcaggcaggcctgtctttttaatattgatcttatttacaggttgaacaaacttatttagggataaattatgtaaaataattactaattttgttttgaagattgatgcatgttccttattcagcaaatgttcatctaccttccatatgtgaagttttaggctgggagccagggcttcaacaatgaaaattaatcttcctttcacagaattaagtgtgaaagtgtggggatagtgtggaggggagagaaacaaaacaaatacaataaatgccttgagcataccatgtaaccagggcatctgcttagtgtaagaaactcagggacgtctttataaaaggatttgggaagaatgtaaaatgctagtgtgaattgatttttgtgctgtgattatgtataaaaatgaacatgattatagacaaaagttagaggggaagatgaataataaaatcaatttattggttaagatggtaaagtcatgggccacttgtttggtattcggtacaaatggacattttctttcttaaaacccagctgaagtcatgatctttgaatgaagctaagctggctgtcccagcccagccatctgcccctcctctgatacactgactgtacatgcctttccctgatccttacatactgtcatgtgttacttttccttactttttaattttcttaatttttatttcctttttagagctatacttgctttaagtttcttgctttgaatatgcaaagcttttatctaactcagttttacattccttagtgcaggggtggttcttttatattcttcaaccctacagtgctttgcgtataagcatcaa

SEQ ID NO: 92856 - DNA, 2384 bp, Homo sapiens
cagctttgtttgtacatacattttctacatactataaatttgttccttgtgtcagagatacaaaatgtagaccatctggaaggacataaatgtgtttgagtctcttagacatacttccaaatcattttcaggttgggttacctagttcctcagcactgagggtttttaattttttatatgaaaagtctgttgaaggatatatgttagaagctgttgactgaaattttcattctagattattagattatggttttggattgcttattgtcactttttcatattttagtcacaagaaacttaaaattgaatttataaattatctttatccaacaaaataattttgaaaatataggactatgtatatgcatgaattagtttccttatattttgtttgatttagaaaaaagatttttgatactgattaaaacttacgtttttttccatactgattaaaaacttaatttattctttgtttctcatgcaggatgggcttctttctcaaggttattctgattttataaataggatgcacaatcagattcctcaggttacctctgatggaaaaagacttcaggtataaaatttatcaatgcatcttaaaatgcatgtaaacaattgttatgtataatgttacgggatcccagggggtgttgcttttctggctggaaacctctgcggctagtgatgcccttgcccgggttttgctcagttccacccacttggcctggcaggctgtgctcagctctcactaccagcctggaccccatgcctcccaagggtgagccaggcgcggagtggtgaggcgtgtatgagcgaacgtggggtctggccatggcacacagccaggcacattggctgcggcagggcgggtagctccaggcactggcatgggcaccggctctctgtgaggctggtggccaggccccgaggcttcaggtcttccccagttgaaggtggggcttcaccggggactagcccccttccgcccaggagcctgtctgcctcctgctgctgttcatggtgcccagactgttcatgccaagggacacgtgcaggccagcactgggccgtcctcagcctgccttggccctccttccgtgttcgctggcgcccaaaggctggaaggggccaaagtggcagtgggttggtgtatcaatgctacctcaagtgtgcacacccagctggcccaagcttgagacagtgcccaacctcggccttaactttgttctgtgatcagagtgggtgttgacagcagggagaggccaggcagtggaagcagacatctccgaacctgtgggggcaagggagggccttttagggccccccgagtgcagagatgtctgggtccgcagccataacttgggcagctgcagccatgcctgggatggtggagctcctgcctgccctggctcccaccaccaccctgggcccagctccatctcagggctcctctctctctgcccctctgtgcccaacctcactgctccccctctggcaggcgactcggcccagccccattgaggtggctcccagggcagtgggctccagggtcctcccaggggtggactctagagactgtccgcctcctctctgtgccctccccgcagcagtggcgggcaagagcggcaacacggggccagggtccagagtggtggagactctgggcctgggagcgggtcctgcccagcttcgcgaaggttggggtggcccagtcagctgccttggggatgcggggcacagggaacccaccaccaccactgcagctcctgcagcctctcttgctgccgctgctcatgtctccccgctgcagccagcttgatggcagcagctgctcctgacggcctgttgctgccatcattaatgcttatgagcagggtcaaagggtttttgtttggtcccctctcattaaatttattactatgtaaaatgtttgctttacgttactggacgaaatagtatactcaaaggtaacagtcttaaaagctgcttttagaaatagaaggaaatttgaggaaattacttgggtgttgcagaaaactacaagtaaaaattcttagttactttgtcctgtagaccgtttagggtgtgtattccagattattagtactgttgcctgttcgaaggaaaaataacttcagctattgaaaaattgttgtcttctctgtagttatatccttctttcttaggaagcatttaagaaggacaagcttttgagagaaggggacagacagtaatacaggatttttggcttacaaaaatgactcattttacttagtttttgtagggacgtgaggaagagatggcatgatttctatgtgacagtgagggaactgaacctcagagaggttaacctgcccaaagtcataactctagttgtcgctaca

SEQ ID NO: 92857 - DNA, 2351 bp, Homo sapiens
gattttggctcaccacaacctctgcctcccaggctcaagcagttctcctgcctcagcctcccgggtagctgggattacaggcacgtgccactaccacctggctaatttttgtgttttcagtagagatgaggtttcaccatgtgggccaggctggtcttgaactcctgacctcaaatgatccacccgccttggcttcacaaagtgctgggattataggcgtgagccactgcacccagccacaaatatttttgattatctaattctcatcataggaaaacagcgaatttttctagagagattattttatattgaccctgaattccataagaaatatcatgtaagtttctcatatcaggaatattgcataagaaagaaaactttctttagctatagctttgcaaaagatactgaaattgttttgaaatagttgttgacttttttgtgtgtggtagaatatacataacataaaacttagcattttaactattagtgtacagttcattggcattaagtacattcatattgttgtacaatcatcaccactgtccatctccagaactttttcatcttcttaaactgaaaatctgtatcattaaatatttatcaatttttaaaaagcctaacattaaattccgcctcaatgaagattcttctttgcagagctgagactctttgtttcaggttaaatagtgttttgaaaatataggaaggtacatcatgatacaaggttggtgcttagaaaacctagaagaatggatcttaaacccattaggctgcatgtctgacatgagatgtttcaggtggatcattcattggtgagggtcggactctgcttgcttcatggttgaatttcaactatatcaaaatggtgaattatctgaaatcttgattaaagatttgaactcagttttatatgtaggtctaaattaacaagacacatacttagttatccttattgttggagaagagcagagacactgtttgaaaatctgtcatcccaaatgcattttataaaattccagtttttattgcttcttatatttttcttgcataagttttgcttagtttagactaacaattagagatgatcagagagaccttagaaatatgttgggtcacagaattaaagtcttacattcagtggttgaggaataacaattatagcacagcttcacactgaaaaatagagagttggaggatggtgactaaaaaattactagagttttgtgttaaggtttttactgcgtagagtgaagtatgaactttctggtatttagattgatttagaaagtacattaattatttttaaaaggagttaaaataattgtataaagcatttattgagcatttagggaagttcatgcaaggcagaatatgatttgttcttcatgagagataacagttttgctgtatgtatttctgttaatttgtacgtgtgtatgtgtgtgttccctcataaggggtacggttatgggtgtttatataccccataaagtagcataaaaaatattaacagaaacaaaaataaatgaatgaatggtttaactcactgttttactctatctttacttcttgtccttatctatatataatacttttattaaaacaagtattcttttttaggaaaattaagcagtcagtctgtgactataattatgtgtattcatgacaagttcagattgaaattctgttggtttttgttgttgttatgatattcaagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggtaattttttctcacttgaaataaattgtgtttatatcctcttgtaatagattattaatctcatgttgatgcaatctagaacacatgcacagaatttaaagcagttgatggcatattttaagtatctatgcttattcagtacttttccatatgataagccctaggaaaaacaagagagaattttccacgtaggtacattttcattacagtaaacttgaatcacagcatcctaagagttttatattatatggaagaaggataaagtaatttattagtcttaaaatttaaaatatgatcactgaaataatagaatgtatgtcttttaaaccagtagatggggaaaggggaatgaggaaaaaaaacctaaacaagagcaagaaaggaaggggaataaaatgagaaaaattatggttagaaattatagaataagatcaatgttggaaaaatctgaatgtatgagtaaacactgtaagtatcagtggac

SEQ ID NO: 92858 - DNA, 1050 bp, Homo sapiens
tcatggtgaggggagatttattttgatataattacaaatttatagaaaagttgtattcataaagagctcccatatactcattgccaaattcagtagttgtacattttgcattatttgctttattattctcttatacaaaagatttgaacttatttttcttttgaacttttttatgttaatattgacatagtatgcttcaatatttactttttcatcctacttttatctgagaattccttttgatatctgacacccattttaggaaaacttttggattattctcaaaaagaactttttcagaagacctatttattcaatgagctactgaatagtagtggtaattggatgatatatcatacctataatctatttttctagtgccttgaggacagaaaacaattaaaaacaaatttagaataagatatttagcatgtctctatctccatgcatgttaatattttttcctttttaaatttaggtttggtaccatgtatgtagcagccgtggaaaagggtgttataacacaagactcaaggaagatggaggctgtaccatatggtacaacgagatgcaggtaagacttcgagttaggctcacaaataatgtattaaaatggtagaatagaaagcatttatcttcaaaaattatatcttggcttttatctgtttgtcacttataagggaaagtcgtagttggttataatgttatctgcactttgctaattgtaagttgtgaatttctctcttcagaaatctgacttccatttataccaagcattctggcctttccagctttatttaatgatgataaaatgcaactctttctaaatgaaatttttatttggaaattttctctccattacttagttactatctgagatagaagaacacctgaactgtaccatttctcaggttgagccggatataaaggtaccagtggatgaatttgatgggaaagttacctacggtcagaaaagggctgctggtggtaagctttgaattattttaaatacaattttaaatgtaaatatacctgttttgaacttcggtt

SEQ ID NO: 92859 - DNA, 2220 bp, Homo sapiens
aattgtgtcatctttatgtgaatgaaagacttcagcttagctctttctcttgaagtgttaatgtcataagagtagttgaacattttgtggaattagtaggaaacaagagcataataggtgattttgaacaaggaatcagaagcctttgacttaactcaggtggtaattcagcatattatttcctctgcctgggatgcccttttgttagcttgttcctgaaaaattgtaagactcaggcctaactagttgtttccgagccaagggtgggtagaggtgttgggacagctgttagtgaggcctaattatttatttatattgaaataattgatttaacattttttaaagtcaaagttctggagataacttgcccagtagtacattttattgctgcaagcaaagtttaaagtgatataattgagccaaagtattgctgacaagttatttcaagcatgtcatttacattactttgttatttgtgtgtgatgcaggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaaggtttgtgtcttattttaaagttatattgatatattttttctatttcttttttaagaacagtatgggcttatgaagtagaatttatgggtatgtgaatctggcagaggacttacgtggaaccactcgggaatattctaaaagtaggttttcagatggctaaggttgtctatgtgtatattgaagctagaggagagttggaacatgaagggaaattcgatgatcccaatgtagaagaactgcttggttagtttggaagcatggaagttttgagggagtcagtaaaggttctgtatctaaggactgatgactgatgtgatggtgccagtgaagatgtatcttctttttatgaaccttgctttccagatgatgcatacccatcaaagtagaactaatctgctgtccctacaggtcttaaaatcaaacttaaactcagggttttttttgttggttatttttttgtttgtttgtttgtttgtttgtttttgtttttgagacagggtcttgctttgtcacccagcctggagtccagtggcgtgaacacagctcactgcaacctcaacctcctaggctcaagcaatcctctcgcgtcagtcctctcacctcagccccccaggtacctgggactacaggctcacgccaccatgcctggctaatttttttgtatttcttttttagagacagggtttcaccatgttgcccagggtggtctccaactcctgagctcaagtgatctactcaccttggcctctgaaagtgcggggattataggcgtcagccaccatgcctggccctggaatatattttcttaaacactggctcttgcctaaaatatcagaaggaaagggaaaatgtaaatacatataattgaattgttgctttgtgccttttgactcttagtctataaggtagttttttgggggaaattattcttgtccaagagtttccttaagagcacagggtgttataatttcttatatgatggttttcaaaccttttagcaatgaaaaaccttgagtgaaacaatatataaacagataaaagctgtagtgagaaaatcattgtcttgtatatttgagtttagggtttgtgtgaaatgattatgaggataccattctttcacttatctctagaccacttgctttggagatgtcctggaactactataaccaatctcaaagctatgtgatgacagctctgtgcagtcttcacgcacattaatcactcgtttagaaacgaacttttaattgatgtgacagcaaagacaagactgaatttcagacatgtaaatattagaatggaggggatctttctaatcaccttgttcatgcccttgttttatgagagagaaagctgagtttagaggaatgcacattcacatggcctggtggttagaac

SEQ ID NO: 92860 - DNA, 2471 bp, Homo sapiens
gtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgaccctcctcgcgcgggcgcccctgccattcccgggaacaggggctcagcctctccctccctggaagaggacgttgtcgtgggtttggaagagcaggggtgggcttagagagcttccaattaagctattggcaggagtatccctgcagcgggtgaatgccgaggggcgtttgctcaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggca

SEQ ID NO: 92861 - DNA, 1338 bp, Homo sapiens
agggaagagttaaaaccaagcctttccctgggggtctggatgaacagaactcaacccaaagagtggcattgccttgtccttggagcagggagctgggaccccccttggactttgaaaaccagtgttttcagaatgcaggtggataacaagcctaaatttacttctgggctgaggagagatctttgaggctcctggaaggaaacttggtgataagcctccagtttgaaacggctctgtccctttaatgtctgtgccttgacagcttttggtgaggaagcacttccttccaacagctgtcttcttggcagaaaaccaaaacattggcttaaagggacccacagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttgggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagccaggattctgtctgaccctaaaggccaagttctttatatttatttctaccacctgctaaagtcttgaatggaggctgaaagcacagttggggtatggggaagaaaaatatatatacatacatatatgtatatgtatgtatgtatgtatggggggttgttttgtttttgtttttgataaggagttttgctcttgttgcccaggctggagtgcagtggtatgatctgggctcactgcaacctccgcctcccgggttcaagtcattctcctgcctcagcctcccgagtagctgggattaccggagcatgccaccacacccagcaa

SEQ ID NO: 92862 - DNA, 2035 bp, Homo sapiens
ttctcacatgagagtaactagcatctttctctcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgtcccttaaggagcaaccataaataatccataacctatagagggaatttggtttccgtaaatagccctttttgcacctgtacaatcctggttggggggcatgagtcattgtccccacttaaggtggagggaactgagtttggggaaattaaggcagttctccaagattatgcagaatagagatgttattagcgactattgtgtgcattgtagcaatggcatttgataatttacagagcacttctgtatactgtggctccttagtggaattaagctgagacctcagatcagtccctttaaaagaaaagtaaaaatagccacagggttgtttaactcgcttgtattgggctttggtagtattcgtcccattggcagacagtcttctattttaaggtagagcatagtttgtctccaagaattcattgttaaaaacattcactaggatctgtg

SEQ ID NO: 92863 - DNA, 1049 bp, Homo sapiens
cgtccggctaggaaatcatgtctgaactctagtgtggaacacagtctaccaaaatttaaggagaaacatcaaagatcaataaacatgaaagtaagcaaatactaccactgttctcagaggaagggaaaaaaaaacaaaacatgtttctcatttttcttttaagccatttctatgttgcttttcggaatcaggcatgtattgcagtttggtgcttgggttttgccattgacattgcaactatttgtgcaaattaaccagaatatagtaaagtagcaagctctactgagggcctggaatccatttcatgtcctaatgcatagtcattactcataatatgttcaaaatgtactccttggaaccccagcttgaagtacccagagatcaattttcaatggactaataggtgacattaaacattattcatagaaacagtgtttatttaatctttaatgctacctaatgcattttggtcaaagtcctcagtgtatgttcaggctttattgtgtggaaaatggatgtgctattaataagtcaatacaaatacaaatatggtttcaattggaaatcattaggttgcattaaatggcaaatgaaatccataggaaggatttgttttattttgtttgtaaggaggaaaaggagccttgagaggcatttcttcgctcggtaatgaggaggaatgattggtttctgcagaggggtggattacaggctaagccttgcgttattctcgttaggatgggcattggcacagctgtttgctgccgtgggccaagccgaaattgctgtgtgctttggagtcagccaatgcctcccagcacatagcgggtggagtcactgcaaagctgtctccttcctgatgctggtggccctgggtggacctcagccctcttgaagtcagctggatctctgaaggcactgacttggacgcttctattctcccggctcagcagcagcacctgtgaaagagcatgtagccatttacgtgactaaaagctccttatgagtagaaaagcagccgaaacaggtcttccgctaaagcagagatt

SEQ ID NO: 92864 - DNA, 1815 bp, Homo sapiens
atggcagagctgggacatacacctgaggacctcctacatggcaggcactttcggtgttctacagtgattaattcagttaattttcacaaccaccctcccagggagttatttttatccccaatttacaccagaaaaaacctgagactcagagagaattcgacagagccaggaactgctccctatccaacagagatcacagaatagcagcaagagaggcaaggggacacccaggtatgagcacggtctctgaggctgttttgttctgcctgggttctagccctgctctgctgttggaagccatgtgaacttgggcaagttgcttaatcattctgtggctcagtctcttcatttgtaaaatgaggataatttcaggtaatgaccagtgccttgaagaaaactcaacagagtgatgagagaatgatacaatcacgccaggcatgcggagatgagcatcccagctgaggctgtgtgtattcaaggaacagaaaagctctagtgactggtgtatggagagaggggagagtggtaaaaagaggatttttctaaagagagagtctaagctccaaataggacacaatatagccttggagattaatgtggattctgcataatatttgatttttctgaagttgtcctttatgttaatacagcagtaaacattttagaggaaacaaatttggaatgaaataacaaagaaaatcagtttctgaaactgatcactcactgtggaatctgaaagtcacatttttctcactggtcagggaacagctcattctccatcatattgttcttgttatcactataatgatgatcatattaaggcaattattaaaaataattattaccattgtttattgatttataaacgtgctttccaaactgtaagaccctcatttatatataaagaaagaaagaccattaatgagcagagagctggatactgtcagctgctgctttgatgtgttaattgcaagtcattctaatcttattattaaagaagagcttctgccaggcagtgagcccaattgtaaataccatatgtacttgaaattaatccgactgcatttattttgaacactcctgcaattttcactttatacaactgtttattaagcatctactgtgcccatagcaccacagccagctttttggttgaataaggagcaataaacgacatgaccgtggcctctgctttcaaagctcttagaggctagctgagattactagatgcatcagcatgaaaagtatagggaataggatttaaaatcagatgtgattgcatgtgccctgtgactttgagcaagttattttgtatctttgagctgcaatttatcatatagagatagtgatagaggcaggatcacatagaggttacacacttggactctggaaacagactgagttctgacacctctcagctgtgtgatcttagacatgttacttaacctctctgtgcctcaattccctgtctggaaaatgagggtagtgatagttcttgcctcatgaatttgctatgaagattaaattagttaatagtataaagagcttagaagagtccctgaaaaatgataaattctaagggtttattaaatcaacgaaataagtaatgcctatctcacagtattgcttttaaaattaaatggaatagcatataaatttcctagtataaaactttgcatataatattcaattaatgttgtttcttcctttctttgctctttttcttccttttagaatagtataccaggagcattttctgcctatgtttgcatatgagatgtagactggtggttcacaaactttgctgcatgttag

SEQ ID NO: 92865 - DNA, 1032 bp, Homo sapiens
tttccttactctaatggctccatcctcttccagcccataagcattttgtcactgtgaccccagaggttattcaggccttttgatcttgcctacctccagcccagtttcccagctgccctgcggacccaccacccagagggtgagcctatgggcaggattgggccccgggcatgaggaggggttacctaagcgggggcggtgttggggggattggagaccagggtggggtgggctccagcgggaggcatttcagtctttctctccatcagaatctcctctcctcctggaaatcaaaggcccagggcctggggccttcttccctcggggaagagccaggaggagctctctctaaggcctccagccctccatagctgcccagcgagccgggcctgtctgtctcccactcttggccccggtgcatttcctaggactttctgtttgcttgctggacagtcttgttgtccctggatgttcagccctgcccccctcactccgtcttccacaagttctcccccacactccacattaatgtaacactgccctatccctgtagcacggggtctatgacaacactttggtggccagctgccgacagcccagctacttccccttaccttggggtccactgtgaccgccagctcctggggacagatgccttgctttctgtattgttggagcctccctccccaccccacagcctggaacaatgaagggtagtgttcagtccctttgagccaggaatagggtgacttcggatgtttttagaaggagctttatagactagacaggaatgaataaggtttatgacccaaattcttctgataggcgtctaagatgttgagaggtggtagaggtactggaaagggcttggtgagtttttaaaacatgaaaggatcgatttatttgctcacttatttgtacaaacaggaatggaaccccttctctggatgactgttaaattgctcttagcactgggaaagcagacggtaaaagactctagtcctgcccgtgctgggttcgtagtctggtagt

SEQ ID NO: 92866 - DNA, 1067 bp, Homo sapiens
ccttcctagtatcctagagtgctacccaatataagatgaaattttacatgaactggaaacaattaggataaacccacccaacctccacagcaaagtagtttctgcaactcccaaagttaaatgaacctagaacattgacatattttccaaagcaatttcttatttagctcagaactttatatgtgacctcaataaggtcattttatggctcttagtttctttaaatagaacaccaaagttgtaaaaaggcgcattttttctctaaggttacttagcaaattgcaaatgaaagaggaaatatacatgcgactagagagttcatcaccttactgcactagaaaatatggcccaatttctctctctctttcttgttcataattctcagacaagacaataggagtcatgtgatgtgactgagaaattgggccagttaaaaatagaaggtgcacttcaccaagtttgttagaaagtggaagtttcattgctgattgctgttcatttatctctgcctgccacatctgtgagggagtggggcaagagacaattgcagattctgagggctggagcccccacacccccctctttctatttcctggcccggctaaacagcaatgcccaggagctcaactgagccccgtgcactctctctcttggtcctcagggaactctcttctctggttggcagcagttttagttgggagaaagctctagctggctcctcgttcctcccaatgggagtgctcaacgtcagcttttctaaatgggaaatgaaggtctccagcctcacgtatgcaacatagtgtctgtacttttgcccttgcagagttctgaaagtcttcacaagccttgcctgcatagcagctggcaggtgggagaggagagaggccacactgagacctgccagtttcataaatggaactgagtcctcccctcaccagctcagagtgagcacccaccatgggtccagcaatgcctggggccccagatctagaaagcacgatgatatacacttgcaggccttgcagggttcccaggacagagggtccgaggaaggccaggccaggccc

SEQ ID NO: 92867 - DNA, 1038 bp, Homo sapiens
gtgcccagccccttacccatttgtttaagtacccgaaaaattcagtgttatttttgaaacacagagtctttgaaggggaaattaggtctaagttatcctttcatgcaagagtcctcttgttaacatctcagaaaaaataattgttcagtatctccctggacatccccattaatggtgagctggggggatttttcatcaatcctaactttctttaggaatctgccttcatcatcacttacagcccctgagactctggaagatggaacaacaattataataataacactcatggtttgtccataataatgtttatcatagcagctaacatttattgagaacttatgtgccaggcactgttcttggtggtttacttatttgatcctcatattgaccctctgaggtgatgcgattattatcctcattttatagacaagacatttgaggaccagagaggtaaaataactcacctaaggtcacacagctaataaagtgcagagctaggatcagaacccagatggtgtagctccagaacccacatcctaactaccatgtctgctaccctttggaaatgaatgaatggtgtgtcttaatgcaccaggtccaatcatagcccttttccatacaccagctcacttaccactggggagagtcctgtgacgtagacaagcgaatacccccattttacggaagaccaacctgggagataagtcacacaccacatccctcacatggtacaggctccatgtaccataactggaccaggatagcaccaaggacattgcctcctgaataaggatgctgtgactcagaaaatgcttatttctttctatgccaaaactcaatttctacaaattcattttggatctatcagtacacacctagaatgcccaagaggtctcttgcctctttccccactctgggcctcagtttcctcaactataaaacacaaagatcctctcttaccctggcatagcgttgaatttttagctgaggtctagggaagaggaggagggaagagggggagcaagaggaggaaga

SEQ ID NO: 92868 - DNA, 1017 bp, Homo sapiens
gccctggttttgggagcaaccagcatgtctgaggtctgctgttaatgatctcaaagctgagggtttatgcctaatatcagacatcccctccctgaggggataccagtcaagatgatccctgtgtttctgaaatgtagaggaaataagcctcatttccatctttacctcgttttttataaatgtcaagaaaggcccaacattgctcacatccccaccgccaactcaggtccattcaaatcaaaagaggagatcaaatcccccaccttgaaaaccttctggaatccaatagcctctgccctccttgcatcattgcatccatccccacatcacagtcaagtcaggtgtgagtttcagttaacctgggacaaggtattgaaggctgagtgcctgccaattacctccatagaggcagagcccaggaccagagaaaagaaacagccatcatgtcaggcatgtgtgattataggagaaaggaggaattcaggtgggagaattatggggaggggaggagaaagcagagccttagggattatgtgtcccaatggcctttgtaggaggctggctgatcctgcttcctctgatctggtgaccacaggagctgtgccagcaaggctcaggaccacagatggctccagcctggtgcagtagaaaaagcagagtatttgaaatcaccaagacctgagctacagtcacagcaggggctctagtcagctgcatgactgttcacagatgacttatataaatcttaatttctttactggtaaaatgaggctaataaaatttacctccaaaggtagtggggattaaacaatataatgaaagtaaagatgcaggcacagtattggctacagagacatagcaggtggtaatcagtagttgttcaggcatcaagggacagacatttattgaacacctagcaagagtcttacctgttgaactgactgcccctgatcatcattgtccaaacttatgtcattcactcacttgataaacatttattgagataaactatatgtc

SEQ ID NO: 92869 - DNA, 1047 bp, Homo sapiens
tttttttttaaaggagtgcttgtgatggaaatattaagagctgttgctctaaattatgtgaaaggcacccctttgggttccttttcaaaggtatttggcaggaaagcagctcagccattgacgggacctagatgccctattggatcattctatggggctatttgaagaagatatagaaacttcttcatcaatacttgccgaagctaggagtattgtcctaatttctaactatggggacaggaaattccaggccacaaaggttgctcacatttttacctgatttgcctccagatttgaagttatgtgaatggcttgtttgtctaactcagctctgctcaaatcaatctttcacgggtccccccagtaaagatcaccttgggtcaaaggttataggtcatcatggttcttaaatacctacccactttgtaggagttccaaagtggacaattactcagaaattaggaataaaagcatatatttcaaaagactaattgggaaaaatgggtatggcatgtgcagtaatgtttcaaatgttgtctttatggctatcccaattaatttccagtgtttctccaacctgacttttaaaaagatagaatacaatagaaagcaacctgctattgatgtgcagagttgcctgtgtcacatctgctgtacaatgacttgaccattaggatattcatcctttttatgtgcctgggtgcgctcatgccagcacattcttaaatgtatgtgagtccagacacatacatgcaaagttgtgatcaaaagatttccctaaagtaattaattcagggctactgctgagaaacaaggcaaaacttggaggggctttccaaaaatatcatagttttgccgttcagtagtgctgacttcttgtggtgcaaatctattaattttgatgtaataaaaaaagtgttcatagaaacaagcaagaaataaatagggacattaagattatatggaaaggtggaaactggaaggtgagctaagaattgtccagatgacaggcaaaggcagtggaggcaacgtggatgacgcaggttg

SEQ ID NO: 92870 - DNA, 1048 bp, Homo sapiens
atccttgaaatccagggaccagctgatgtgacttgtgggcctatgatctctgtcagaaaatcattctgcaatgagcaaatctaagacagccagcattggctcccgccaccgcccccttatctgtttttctttttgcaaaagaccttgaggcctgtagtcggttccactacaaaacggttacacaatttccctgggagaaggcgagtttccacctttggggatgaatgagccctttcttttctggagagccggccaatgaggcacaggctgggtactgcaggaggcgcggctgagggaacagcaggcctcggtctaatttgggggtaactatttgttttttcattaaacaaagtctgcatggtaggaattgtggttgcaggagcctcgggaggccgataaagcaggcagggcgagtctgccgggagcagcgggcgagggagctgctctctgattctgctgctgcccaaagcttccacttttctggggctgcaggtcctataaatggtgcctttgaggaggctgccctggtgacagcaggaccctccctgcagcacccactcggccactgacttctgaaagcgggattgtccctccccaagccctgccctcctgcgacattcctcatgctgaccattgtctgcagaaagaggccattgtctggggctgacatatctgctgaccaggcacatgaaacaagcagagctttggggaggaagaaatccacccaaaccaacaaaaaacctgagcctagcctgagggcagggcttagacccagcttgctgaatttcctgattcactggtgttcttcccgagacgaagtgcccaccattgtgggaggatccgagttttatctctgggctggaatgacaccgtctctgcctttgtgtcaacagcactgagaggccttgtttaggatgatgtggccagtgctgagaagggcttgtttgaagagaaaaaagaaaaaaacagaacaatgtttatccagcaggcagctcctgccaaggcggcctcctcgctgtcctctccgtaggatgctgctcgccaggcc

SEQ ID NO: 92871 - DNA, 1007 bp, Homo sapiens
aattagttttcctggaaaggactctgccagcttcctttttgtctgtcaaacagtctagtagaacacttggtatgtcctggttgtccccaaacagcagatttagcccccaccctggcagcacctgttctgtggggcatcttttccctggcaaagcgctttcccattattgcttcttatgtagtgactgactgttaggtaggctgattctttttcatattgcaaacttggggagcatgatggctaattttgtatgtcagtgtggctaggctaaggtgcccatttgtttggtcaaatgccagtctagatgtcactgtaaaggctttttttttttttttttttttttagattaacattgaagtcagtagattctgaataaacatattatcctccaggtcttaagagaaaacactgaggtccctcgaagatgaagaaatcctcatgaagatgaatccaaaggtggattcaatttcagctgtctttggactgaagactgcaacatcaacacttcccagggtctccagcctgcccgcctctcccgcaaatttcagatttgcaagtatccacagtcatgagcaattccttaaagtaaatatttctctgtttctttctggatatgtataggttgtttctctggagaatcctgattaatacatgaagggtcaagataagtctactccagggtaagatctttcacatgatatttaagacttgaaagggacttcaggagactgtctgtgacagcgtctaggagtgactcccagcaggtgccaccctacacagacgtgggaagtgccagctgatgttcctcaaatctgagttgaatcagtgggctttaaactcaatgaagacccacatcatttctttcctccatctgactttagaatgtaaaatccctccaatggattcagggaccaagcctcacttaagccttgatcattatgaaccgcttgtcagactaagcttagccagcctacaaggatcacagcagcaagccacatagtgcttta

SEQ ID NO: 92872 - DNA, 1049 bp, Homo sapiens
gatgattaccaaataattctggaggctcatggctttgaaacaccaatgagacagagaacttgatggtggaaaaactcttcccgagaagaaaataggccatagatgggacttgcccaagtcttccttagggagtgggaaagataagggagctcacattgccaaaaacccaacccaacccatggtgtactggggattttaggaatttcatttgtccctctgatatcttttcaaagtgaagattcaccccattctacagaatagaccactgaggctcagaaaggccaatacttgaccccagtgatacagggacaagatctcggatctgcctaattctaaggctctgctttctcttcctgccattgtggatggacagaagtgtgtgacatttttagaggaaatgagcactatgctgtgtagtttgtgcttggaataccagcaggattaagaaaattgcaggactgataccttttagaattttccatttgcaaaagccacaatcctgtaacaaacatccctacaacaaaaactcaagatgaaagagccagagagaagcaaattaaaggcttggaaagatgcaaatcaagtctttgtctagagtagtggagccaagaacctggtggctttactcaacaggtattcactgagcacctactctgtgtaggagaccctgagagatgataacctctcagtcttttttcttttttcctttaaatagggatgggttctcgctatgttaaccaggctggacttgaactcctggactcaagtgattcttgccagaactcctggcctcccagagtgctgggattacaggtatgagccaccatacttggccaacctctcagtcttaagtcctctgttacatgtagacaccaaggtgcagtggagagagaggctgcagaagagttggcctatgacacagaagattggaattcacaaactttccactccctggcagtgtggccttagacaaatgagtgcatctctgagccttagctaactatttggtaagatacaggtgaccattcttgctcagtctacctcatggg

SEQ ID NO: 92873 - DNA, 1050 bp, Homo sapiens
tggagagtcctcattatgactccccctagagtaggcccttttagagggcaggagtgtctgtgtctctgtcttcagcacaggcctggcagacagcacatgggcccttgtgagtgtgggaggcaatctcctaaatcttagctgaaatacaacattcgtcaggatcttcctgctctgttcacaccttacacatgaatccaacctcatggtgcacggaccagggctctcttctttgaacctgcagaagatgcttcattaaaggtcaactttgtttgcaaaataactttatggctctttctgtaaaagctgaaggactccagtggtcatctcactgaaaaggaagtttcttccctagcagctgagtcttcacaaataatattctctttcaattcacaccgcagattaggcaaggatcctttgtaactcccagtaccacaggtctgaaagggcccttggaggtcacatattcttattcctttattttgcagatgagtttgctgcagagtgcagaggaacttgctgcaggtcatagatcagggctggtcttagagttatgtgtccttccttcaacttgatgaaaacaactctcctggcacttctctggagcaaagccggcggtcctccttggatacggtgagccaccaagctgggctctaaagcaggtggacaagttcagggccccctgttaggatgggttcacagtcattccgaggcttttgcaagtgtttttctggtgcagggctctgcactggctctccaaagagagacacaaaatggctatttttgcagatacactcatggtgggaatggccgtcagccaaaatgccccgatgtgcttctcagagtgtgtggatagacctcccttcctcctccagccatgaactcgcagggccatgggagaagatgggtgtcctgcaggtcagggctgagaacagtggctgactgatggcgacaagggcagtcctgagtggcctgcacagcacctagatctggaacccagaggagttgttggctgcaacagcagattagtcaaactcccagatggcatctctg

SEQ ID NO: 92874 - DNA, 2822 bp, Homo sapiens
aggagataagactccagtggctgcaggagccataaagcaaggaggggctggcagttgaggatcccggggagccgggctttgaactctgccctcatgggggtgggaagcctttatggctgggctgctctggggccgaggtgggagcagagccatcacgggagaaaagagtccccagagccggccccctggcacccagactgcacggtgagacaacggagcccggagtggtgggaccagcggcggaaacagcgctccatccgggctttattgacttgtaaacggtaccattaaagaggaaggcctcaccttggctggaagcagctgtgtgcgctgccgtaaatctagggcgagctctgaggctgcagccgggcctggcaaatgccaagcatgccctgggcagaagggggtgcaggccagggatccccaccacacccagctcctagctccactgaggggctgagtatgggaatttataagaaggatgtttaccaggggaaatatcagcggctaattagactttgcaaataaaaaaacttttcaaactttgttttccactttttttttttttttttttttttaagagaagggatctcgctttattgctcaggcttgtctcgaactcctaaactcaagcaatcctcccgttttggcctcttgaacgctaggattacagacgtgaggcacagcacccagccatccaaaaaaaaattgttaaaaaagagaaaaatgtctagacatctttgagtctccatttgcaaatttagcccagaaagaaggacattgagaagccgaggcttagagtggcctgcagaggagtgagcgaaagtccatcacggtttcttgttcactgtgtatccgcggactagctccggagaagcccaggtctcaagtttttctttcttgttttttttttttaacataaagaataaacataataccagctctcaaaggttggctatgatgatggaatgggatgaacgtagaacacctcaccagtgggaggggctcaacaagtgaattttctctcttctccgattgacaataaaacaaaacagaaattggagatattggccctctttttgttttgttcccctggaattagctaaccttgcacaacaaaaggctagactgctagctgcctgggggcagggacagccctgcctggttcagttttgtaggttagttgttaggaaggaagctggtgtagaattctgagaatgttttctacaaatgttgggtgaataaaaaaaaaacaggggactaagaaaaaagaaggaaagaaagagtggaaggaaaggagggtggaaggaagaacacaaggtcacttttcctctggacaaagtccagagtttttggaagagaaggaaaggagaagcaacatttgccacctcctgctgtgagcccaaatgttataaaacttagttctcacaaccaccaggagggccctgaggataattgcccaagctctgctatttacttattaaccaataagtaaatctgtcttctgggcaagttatttgctgagtgggtgagtaagttctttgtgcccctgacttctcctctaaaatggtgagaattaaatgagataataggtgtaaacccattatacagttattggcaaatactaagtgctcgatacatgttggatatggttatgcttcacgatgaagaaacagaggttaagtaacttggccgattcacaaacctgagaagcacgtggctggattcccactttgcttctagagctcacaccagttctccggggtctgcagctcttgaggcatcacaaggagtggtttgtggaatccccacgccacatggtctcagaatgtattaccagacagaactactaaaaggaactctttaggggacataacttttaggctgagctgctggaaagggttaattgggccactgggattcttatctttgtctgagggattccttcattcattaaataacaaacagataaataaacaaacaaagccaaaaggaggtaagatccttaatgcttacagagcccttacccagcccagcctgagccaggagctgcaggaagctcaaagctctaggacagggcccctcacctccctgtctccagggacttagtatttgctaatcactgcttgtcacaagtaggacatcctcagtgctgtgtgttgatgggaatcagtttcttatcgtataacaaggaggctggatggcaagtggcgtttaccaccatctagaattctctaacgattcacagtgagagagatctcaatccaggaactaccatggtccctctgcgtctgggatttcagcctagcctttgtaggtgctggaatatgcttagatagctctcagggcaaggcactgttctgtatgtccacacatactaacttatttaatactcacctcaattccactcctttactgtcaaggaactgagacacgaagagtttaagcccacacagccagcatgtggtgaagaattcgactccgcacagcctggcggcaacgtcagcgccatgcaatgctgtctccctgcaaaacagatcccagtaaaatggaattcagtttacaaagtggctattcatcttccaaggagggatagaatgaaggagctaaagacagagggagagaagaaagaaatgcagaacagggagcggaaacgggggctcctcccttgcagcacctgagacacgtgatctctctgcctgttccttcctccagcacccaaccccctctgccagcaacttccagataatcccactaagaattccaagcaggtctcattgcttcttggaaagtagccggcagaggcccacaccctgagcgtg

SEQ ID NO: 92875 - DNA, 1079 bp, Homo sapiens
tcgtattaatctttacatttctgaaactatcactgatagaagcaataatatcctctaatttgcaggattgagaaaaaaatgtagtctgatgggggctggggtgggtgagaggttaattctctttcagcaaaagaaaacagcatccatccatcgattaaatagtgctgagtacctactaaatgtcagacgttgtggtagcaggcagagatagggccagggagcacccacacttagagttctataaatacacaagcatactatgttgtgatgtgtattagaataggcctgcactttaagcggtggaacagaaagattggaaggcctagaaatgttttccaaagatggagacacggggccagccaagtcttggaggggaagctggaggaagcctggtcagtgtccttggtggtgaggggagcaatggtggcagtggggataggatgagagaagacagagacaagaagagacatgagagctggtgtatttggggaactccaagccgttctgcaccactggaactcaggattatttgcaggtgtgacagcaggggcaggatgatggacagattgcatgctggctgttctttggaattcactctgcaaacctgggggagccattcacagaagcagctggttagactgacattttagaaagctcaccctggaggctgtgtggagaaattttgcaaggaggggattcagttaaggagtagacaaagggttgggataacccaccagtggaagaggaagtagagatggggggtgggggacactgtcaagggatattttaggaatatcactataaggaggcaatatggggcggtgcttagaactcatcccaccctcttgccatcttagctctaacctcgggcaagtctctgaccttgagcgagtctctgctttagcctgctcctctgtaaaacaggcatgataataaaaatgagccccatctcatacagttgtttttcacaaaggaaacactcaagaattgatagagatgatagggaagatgatggtgggatggtttctaactggatgtaggggctgaaggagaaaaaggtctggacaaatgtccagatt

SEQ ID NO: 92876 - DNA, 1049 bp, Homo sapiens
ttgtagtttaccaagggtctggggcagcaacgtaagggttgaaaccaccttgggggcagagtaggggacaggaatgagaggggagaaatgagatcaccacttgtgaagctgccatggaccagggatggtgctgggtactttctttattaggttattcatttcatgtgggcccggggattaagtactttaatatccatttatagaagaggacactgaggctcagagtggtcatatgccttgcctgagttcacctagttcatacaccgggaaggacggggcagggataatattttagcatgccatgtgtgctgagcttctttctttcaaatcacgtgtgcattttgtgaatggtcttggccacaagttcacatgctgggagaagtagatatcactgtgtccattagattggtgaggggtggtaatgcttgaagaagtgaagtggcttactaaggattgcatgtctcggagaggctgtgtggccagggagggaaagactgctggttgaatggaacccgaatgagtgttccgggatatcgattcatcctgccctgctctcctctcctttgatgtgtcaggcctgagagccccttagctggggagctctactgtcatcaaagtattgtcttctatagggacaacattttccaatttccgaaggacttttatatctactaggccctgtaacctccaaacagcccttcagggtaggtactattgttcacagtttagaagtgaggaaactgaggctccacaattttgtgcaacctgcacaggggcacactgctaggaggttgcggagttgggattccctctgacccatcttctggtcttccacagtcaaggtcaaccctggactgtgcaggccaacgaccttggtctccctctgatctcccgctgcgctgggctcgttgttcctggatggagggttggctccctcactttgttagcccgactgataagaggagagctgctttccaacaaaccagagacttgcttggggtcgtgcaaaagaaacattgactcccttatgtcacaaggagcctgtggga

SEQ ID NO: 92877 - DNA, 1106 bp, Homo sapiens
ttaacgcatcagccttgagaccataaatctttatttattcacttagacaacaaacattgattgactagcagttacttgcaggctacacacataatatagtctctgctttcaaagaactcagcatttaggtggtgacagggtggtgaacagagtggctgagtgctctgataacaggtgccacgagagagggagcatctacttatctcttcagggggtgtcaggcttcacagaatagatatttgctgaactgtttctcagaggatgagcagaaattttcctggcagggaaggggcatgagaacaccccaggcagaaggagcagcatgtacaggagatgagggacatgtgtgttcaggtggctcctggtgactggtggcgggtggaagttacaggagatgcaggatggagaggcgggactttgatgccactcaaagcacttggctctgtactgggagagacctggaccttcatgaaccactttgcaacacagaacattggtgggtggattctgatgtccatgcaattaattcaagtgagctccagcatgaagcacccaggagaaaatgcttttaattgagagacatgtttttcaaatgttgctcagctgccagctcctgtgtgctctggcaggaatggcaagtgatacttagctttcttcaagctccattaatctgcccatttcttttgcttcaaatcccacttcaaacacacagcggctcctcacactcataatgaaataaatgatttataatcctgttgggagccagcaagcctcctgtctggtggttcaggtggttagggcaggctgggttgatccaggtgacctttcagagtgcatcagagggcagacagtggctctcctcaccttcccaaacacagtcttacacaggcatgcacacacatgcacacatacatacatacttggctgcatggaccttgccctgtctttactcctttctcgtgaccatgtgggttcccctgggaaagcccagtgacttggtcaaaggacagtgttccagtggcttctgtggagtaagccactgagtgctgagtgccactttatatgcccagtacctaagttcataatattatgtgacataaaaagat

SEQ ID NO: 92878 - DNA, 1056 bp, Homo sapiens
acccttattgagttggggttggtttgctttcagggtttccagaaatatgtcacccaaatagagagaatgtgatatcctggttgtacctgatgttctctgctaccctaagctttagaagtgggcagtggccagagatgtgattttgtggtgttgttttcacatctggcatggggccttgaatctcagatctcaaaatgagcctgcctggcacaaagcaaccctcgatttcagatccagaactaatacttgcatagagaccccctgggctgcaaggcttttctggtgagcaaaactgactgtccacaggcagggattttgggagaactggtccttagggccccagaccttgtaaatggctttcctgcattttcagttggcaatttacttaggaagtcagttgagtggcaggccctgcacaaggagctgaaaaaacaaaaagaaagaggaggtggtctctgcccgtgttggggacaaattaatagatagatgaatgcaaacatctgtggttagcattatgaaagagctacacatgaggtacatacgctacactgtaagcacttgaagcaacaacaacagtgatttatttctagagtatggtagagtctatggtagagtacttggttgaatagtgccatcctaaattcatgtccacccagaacatcagaatgtgaccttatttggaaatagggttgttgcaggtgtaatttgttagatagggtcaccctagactagggtgggccctaagtccaaccaccgtggtcctcataagaaggccatgtgaagacagaggcaggggttggagtgatgtagttgcaagctgaggattgctggccaccaccacaggggagatgcagggagcagattctcccttgaagcctccggaaggtacagaccctcaggacgccctgttttctgacttctggcctcctgaactgtgagagaataagtgtctgttgttttcagccatcatgtttgtggtcatttgttacagcaatcctaggaaactaatacacatggtgtgttgtcaattacatttcactggcagcactgaatgag

SEQ ID NO: 92879 - DNA, 1586 bp, Homo sapiens
tacttggtttaataaccataatacaaaattcctttggaaggaagaatcaaatattaaatctgagatgactgtgagcattgaagtgtggatttttgtctaaagaaataagcccaaatatcaattgtgtttccgaaggtaaagatgggctgaagcttacacagagcactgtttgccgctaacctctaccattctctctccatccaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtttgtggtagtattttaattctagatgtgttatctctctgggaagtatagtttatagaaacacaaaatatttgatttcctgtgtcggctcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctcctgtatttttttcagttagtgggagagcagcagaaatagatagatgtgctgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctg

SEQ ID NO: 92880 - DNA, 1126 bp, Homo sapiens
tgagaatgaagtcaataatgagatggccaatcgaatgtccctcttctatgcagaagccacgccaatgctgaaaacccttagcaatgccacaatgcactttgtctctgaagtaagtgaagttgagcaacgaggtgcttttttccttaattccacacaagagctgcaagcaggactaatgtacatttgtgtctcccatttagaacaaaactctgccaatagagaacaccacagactgcctcagcacaatgacaagtgtctgtaaagtcatgctggaaactccgtaagttaaatcagagatgtattcgtggttgagacttcacccagccagtgtctgttaagatgatgatgttaatgatatgtaacatttgggtcaacaccctaaagttttcatgtatattatctgctttaatttcactaagaactctgagtggtaggtgtcactatcactactgcatagctgaagaagctgaggcccaaagtggttgactgacttcccaacaactgcatagcttgtcaggtggcagaaccaaggctcagatcacagatgctgtagaagatctgtaagaaccaaatggagggtgtgttaaatgatgggacatcatgataaatatattgtagagaagatataaaaccaggagttgacatgataagactgtttcaagagtgaaaatggaggtctctctctttctctctctctctgtctctttttgtacctaaactagttgctacttgttagatttaaaaatgattgagaatattgaggatgaagcagcatggtaatctgtgctcaaaattctgagttccatttatggctgtagcccctactatgcctgtaaataactggcctgacttcctgagcctcgggttcctcatctaatgaagttcccataaggccatctactttgcagagtctttaggaagaccaaagccatcaagagtaccttataaaatctgatagcctgttcaaatgtaagatggcattaatttcaaatatttcacttgtaccaaagttaagatttattccaaggcagaaatagtaatcatcttcattgcagagccaattcataatgaaatagatgctaagaaagcctctaggaaaaaagcctctagaattggcctgaattat

SEQ ID NO: 92881 - DNA, 1090 bp, Homo sapiens
gaggactgagggtcctgtcttatagatcaccccagctgccaggagagaattactgtaggatggaaggtatttgtttaccacagcccctgaagtccgcctcctctgggagagaagtggtaccagccccctggttactcatgcaactctgtggtcatataaatgtcagtgctgatttgttgaaaggtcccttcacctgggatggagagcgcagcttgtttgtctctagtgccagtacctttttcaggccaccctatcagaaacagtcttatttttgaaacagttaagagaggcctctatttttaaagactgacttgaaatctttctttttttctgtttaagtaatcatcaacaggatttttttaaaaaaaatttccagctctcctctctggcccacttagttttaattctgttttgtctaaaacttatcaagcggtgatttgctagggtggagccaggtgaccgctgagattagaaggctttctgttctggcctcagagtgccttcttctttcccatactattttataaatatactcaaatagtcttagccctgagaatcttggtcactgactatcttgcttttcttcttctccaaatacatacatctctaggaaactgtctttgtttagcttatgatttttcaaaaggagacaggatttgaatagtcagtgttttatttttatttgttttctaggctcgttgctttgcattttttcttatgttttcttccctgacactttccttactcagaaactgccaggcttaccctggaattctattctaccagaacactttctccagttacgggcctcctagcttgtggatttttaggtttgtgtttaagacacttgcatcactttgagaaaagtttgagaaagcagaaaaaggtaaaatacaaagtgattaatattgtgagtaacatcatatctgagaaaacttaccaaatgtttttgggaaacactgataggccataaaacctgaaaaagttcaggttgaataccccttatccaaaaacgcttaggaccagaagtgtttcagatttgggttttttttttttttttttttttctgattttgaaatagttgcattat

SEQ ID NO: 92882 - DNA, 1047 bp, Homo sapiens
aatatgccggccctgtcacacatatttgctggcagaccttttccattttattctgttttcataaacagttagtattgtgctataaatcacttccattttacatccccacatattaataatagataattatttatgcttcttagtttagcctgaaggggaaagagattggaggagagaggaagtgggtgggaaagaagggcagaatttaatttacagctttggcgaatccattttgctgtactttttttcagtgtttatacaacagtcatggggcacagagatagctatatatcctattgatgaaatgccagggcatctttcaaaaccaaagacatctctatgtaaatggtgttttctactcacattatcttagtttagtttgattctctgtcaaattgtccatacagtcctaaacgggttgttaggaaaatgtgtatatgttactggtgcatttgaagacagtgtaagtccttggccgatctataaaaattagaatacatggatttgatagcccttctccagtgcaagccctgctgtcgtgccctgtggcaggttcaccgaagaccttccccaaaaacaaagcacatagccaccttcttctccattagcatcaaggagtgccgtgcattggtttaaataaatatcactcttctccacaatgaaatcttccaccctgcctcaggtgacagcaaagtattcacagttaatattcaccagcattaacaaattgagcccctgcaaacaaaactaatcctgtttaactatcttaatgtataaggtacttatgctattgcaaattctagacactttgaatttagtgagttcttgacaacaaatgtatatgtgtgcaaggtcgcagggcacttgatacattttcaaactttccacagtagcaagtccagaacaggactttaaatcatccccccacataatgtcctggatacacttgttccagggctcctggaagtattggtttctgaaactgcccatgtaaatcacagagatttttaatagctttattgttagacaggagtaactccagcttta

SEQ ID NO: 92883 - DNA, 1022 bp, Homo sapiens
actggggcttacctccaaagagaatagcagacatccctgagagaaaaccagagagctgagcagatgggaacattaggcatgcttatgtttaaagggggcttgagcagtccaaggatccatgagagaggtcagactgtagaagaaggaggacatcttactaaactgagattcctggaggcagggtctgggccccctcagttttgtgactcagcacttaacccatgaatgaacctcagtaacagatgctgatcccatgagggaacagagtgaagcgggctctatccaggcagtcacaagagcacatgtgatcaagaaggagggagtgtaaatggattcagtgctgcagagctgtcaagaagaatgaagcttgaaaagggactgatgaattaggcagtgagctgtccagtcactagtggcccctaggggagcagattccgaatttgttgctttgaatatagaggctggattgtaaagagttaaggaggaagagatggtgggaaggaggaaggctgaacagcatgttgtaacaactttaatgaatttggcacctctactttgagtgttaaatattctttttgaagttagtggtagaatataattgaactgggtcagacagatataattaagctgggtcaaaacaatacaaaattagacacatctgtccttaggtattcctgttgcatagatctgatttaaattctcatctgacctttacagtgcattctatatactttgtattcacatttctctacaaacacttaacatctttgttgttgtttttcatccctctacttctttttcttccctctctacttccttcccatgtctccatgtcctctttgaagtctgggagacagggagaaatgaaagattaatgtagcaaactaatctttcacgagtgatggcttcagtttacaggaagaagtatgtctgaagttctactcaagattgtgcaaccagacccaccattatggcacccaacttgggcagtaggcattaacctttcaatgaagtagtttcag

SEQ ID NO: 92884 - DNA, 1047 bp, Homo sapiens
ggtttgtaatccaaaaaactgacagcctgtttaagcgaattcactatcagaacagcccaaatttgagataacttctaggtgttcccttttactttctagactggagttgaaaccaaccaagagaggaagagcaacttgcccaacatgacactaagtgaatggtgtctccaagatgagtgcttgggtctctggggccccttgccctgcatggggtacctttccatttgaaattaggcagaacgggcctgggtaggctgagagtgtccacctgcctaggtaagaagcaggtgtctcaagcagtttcctcataagcatgttcttgatttcccaagagaaaggggacagattcactagtgacttcccagcggtggcctgggccggagctgagcccagtttgattgcttccatgtcactagcatttgaaagtgggggacacattgactttcattccctaaaaaagaatctaattttgccctcatttcttgggtactttttgctgctgtactattgatgtttatggaaaaattagctatgatgaggtaatagtctattttagaaaactgaactcagatattgaaagaactattttaaacctgcacttaattgttcaattccataatggtttcgtggttttttttttttagaattcccgtgaattgccttacaactggactctagcagcttgtattccatggggaatgccaagcccttttgagggacaccatggtattaatgatcgatgagaatattcaaggcattttctcatttgagtgccattacttgtagtgttaaaacgttttgaaaacacactttagccattaactcatttttattgtcagatgaaagtgcttaatagactcactccacttcagttttcttccttcatctcggaatgaaatcgtctgttggattcttggcaatacatttgacaatggaacagaaaacctcatgacttcattgcaaaaaatggcagatggagcagggatgtgcaagcccagccccgccatctaaaatggctaacctggcttagcaaatacaggctcccag

SEQ ID NO: 92885 - DNA, 1056 bp, Homo sapiens
cccattcaaggtcaatgaccacttgtttgagaagtcagcctgaccatgtggctgcatttaaaaaatatgtcaaaggccagagagtcagagacatgttccaatgtggattcaactcccaaactgctgagtccctgagtgaggctgctttcttctgtgagcctcaatcccctaattataaaatgaaagaattagacaagactatctcttagatgtccttcaggcctgataatctgtgatcttgtgactctctgctctccttaaaaaatacattgtgactagtggagaataggaaattgcttctcacagtaacatgacttgcattccctttttagcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtaagaaacaattgactttcgttataacgtgtagcacactgataaccatcattatactgcaggaagtatgtcgtatgcatgcttatgttatgaaagacatgaaactattaaggaaaaggttcaaggctctgggttctatagctgtattctgagtgggatctgtgctatcttgaggcttttgagggttaaggaatgaaagagggtagctgagaattacatgcaggggaagaacagagtcgagctgtagatctaggttcctttttccttgcagaatcatttagtgttcctttctgcccatgctagccaactagatttagacagtaggaggagaggtcctttggtagccaatctgagatggaatttagatcccatgtcagagaacggacttgcatcccacctgctacaacatctttagaaacaaattcagttcatgaagtttcatccaagggcgcttacagcagacaggctgcagctaaccattctcatcacccgctttcctgaccaccaacgcaatgtctctgtctgcttattgctcgtctctctcccctcctcccagtcacttatggat

SEQ ID NO: 92886 - DNA, 1123 bp, Homo sapiens
ctttgtggttgcatctgtaaggtgggagaaggtggggtgagggtgagagctgagtgggggtccgtgttaactgaatgctagtccatggatcagagccaagttggtggcactaaaaccctctcagaagatttttaaccgtacaagtttcctgaccgctgctctggattgggtctgtattttttgtgagcttcttagatgcgtagccagtacagggggcccgctggagtaggggaaccagtatgtgatggcttacgggctctgcattctctaccccttggtgcccatcaggggtctatgaatagtattagcattagtagaagtggtattcggttattaagttattattagggtcatctctgtgtgtggttgttcaagttaccaggtgactgtcattctttacaatgtgcatttggagttggggaatttctgtaagcctcagtaagtaaatggagtcaacaaaatggacaggaagacaagcaggaggtgtcttagaatgatgatcaggaggaaacccggtgttccgcctgactgaccctcttggttttgtggtggaaaatagcagcatttgtgctgaacccagctgagtgaatccatcccagtcatgcacactgaaaatgggttcaattctgaggacatttgagaaaaaaaaaaaaagcagtgaggatgggatagctctccctgatacctgatcactttgagagcttttctcttgtttccagatccttttgtgacacgcctggcccctcagccacagtcaaaaggtgaggaacagggccttaccccagaatccttctttggaaattcaccaccttccatgtctacacctgaggtgtggaaaacatccctgtgccaggcggtgcttggtggtgggaagtggaatttgtggaccccaaccctgagtttggaggaagtaaacgtctttgccctgccctgttaccatcacaatccggtttcctaaaatgcagggcccagctccactaacgtccactcagaaatcactttctcatcaagccaaggacatttcagagttgctgtgttttctctatcatttccttccctcctcccccacttcacttcctgttttttcttcctctttctccacccccaccccatctctcctggc

SEQ ID NO: 92887 - DNA, 1051 bp, Homo sapiens
gggtgcggtggctcatgcctgtaatcccagcaccgtgggaggctgagactggcagatagtttgagaccagcccttggcaacatggtgaaaccccttctctacagaaaaaaaaaaaaaaaaaaaaaaaaaaaaagccagggatagtgacctgcacttgtaatcccaactattcgaggtggacattgcagtgagccaagatcacgccactgaactccagcctgggtgacagaacgagaccctgtctcaaaaataaataaataaataaataaaagtcatgagacaactcataggcactaaatgctgagtggcacagacagaaagttctatgagagttcagcaaagggagaggtcagtatggattgtggtcttaggtgggtatcagagaacacttcagggaggaagtaaaactctgctgctggccttgaaggatggtagacagggtggggggtgaaagtctaggctgcaaggcagggcaagagggtacaaagctgcagtaaatcacatttgggcttaagctgggagttaacataaaggatggctctaattagtatgcagtcatttatggaagaacttgtaccctcagcttaggaatatggattttattagaagtggtggttctcacatggaaactgcattttcctgtagtcagtttctgtggggaatcttatcattatctattcttctatccgctgctcccctcattggggtggagggtgtgcacccccctcctgcagccctgtgctattggggaaggcagaatccctttgcatcttggggacgaatgcaatgctgaatactgatcatatgacccctgctttgcctcacagcagggagcctaggaacaagagcagctgtgctattgtctggagcgcaattgccagtgtttgtctgccgaggccagggatgacccttgccagcatcatagataagccggctcccagctgtcatgggtgcattctcaatcattcctcatcctatggactctgactctctcccgcttcccaagaatgatggaagtttttcattttcccccgtgcctgctttgtgaaag

SEQ ID NO: 92888 - DNA, 1277 bp, Homo sapiens
catcacaagatccactgtgctgggatgtggatgtgaggaatgaatgacagaggagtgatgaaaggggccaaactcagcccaggagatagccagctcctggtgtgtgggggttttggaaatttcttttctattttttgttgtttgaaatggggtcttgctctgtcacccaggctggagtacagaggcatgatcatggctcactgcagcctcaacttcccaggctcaggtgattctgccacctcagccttcctagtagctggaactacaggcgcatgccaccatgcccagctaatgttttgtatttctttcttatttttttttttggcaaggggttgggggagagataggatcttactacgttgcccaggcaggggtaatttctttccctgaagttgtcctacttccaacctgtggccctaggtcccagatggattgtaaccagcttgtccggagttctgagtaagccttgcagagggagtgtagagacctcaacaaaaacattttctctgaatagataggtgactcagcactggacaccaagaaagctgcatttagctgaaagtcagtaagaaactcgggaccgggcctggggcagttggcctcctatcctggaccatgagctcctcattcacaaagcaaggggctgggcagagagttgcccaggtggcttccagctctggcattcagtgcatctgagtgagttgtcatttatagaccaggaagggcgaaattatccccattaatctgctcacagttctggtgcttgagaagccactgggtcttgccacatctcgaattagctctgggcccttgggcttttaattaaagggctttgtgagtcggatggtttatggtcagattcagatcttcagggagacacagagggaggtcctgtgttctgtcatctgcttgtttagaaatcagctgccactctcagtgtgagaactcagaatccggagtcttgcaagggacttccagcaacggctgtggttacacctcaccccctactttcgctgactccagaccccagaggctgagggacagtagatatgctgcctgccattgcctctttccttgtgcatgtctgagtggtgccagcctgatcagattctgttgcagttccccgtgcttgccacaatgtcggtcgcgtttcttatccaacgctgtttctgcttctggtggtttgtgctaaatgcattttcaatcccaagtggtacagagaagaaaaggattgtctttaaaaagtggctttgaatgtgtcgaaagcaaggttgcct

SEQ ID NO: 92889 - DNA, 1105 bp, Homo sapiens
ctcgcctatggattgtccctgaaacatctgcaagttcaattgaaatatgactttcagatgaaagaatgctatcactgtcccaaggctttctttcctgatttgtaccaacatcaaagtagaagtttatactttttcattttaatggtaatcggtttccttaataagtcttgtctttaagaggtaaattcaatcagctgccgtctgctatgagactgagtggttgtggctccgtgtgtggggggttggtggggcagggctgtctttatttttctgctctattttcttcttatttcccttagcaataattgacccccttgcatgttaaagactcccgcaaaggtagaagaaggaaggcatgcgcagtgatgctggaatcatcttccatgtggttatctaagtgtggcctccaaggaagttacttctagagcccagttaatttctgacttaatcagagcccggaagccccaatcatgcttctgaatttggtaatgacaagtgtctttgcaaacatctaggaagaaaacaagcttagaggaagctttgacagacaacagtagttaagccccagcaacagtgtgacagatgccagctggacagtgtgataggctcctgctcatgggtggacatggcaaggactgtccagaggagaaatggtcacctgaggctggaacacaacaagggcagtcttccagtatgactaggcactgaagttttcatgactcagcccatccaccaaagggactgatcttaagagtttcagtcttaacctccctgtgtggtgggacagacacagcaactaattgggatgtgtgattcactcacatcggctctctacctggggtcaaaccaggcattcaattctaactttgcattttaaaatgtctgttacatatccaatactgcactagctgtgtcattgcaggagctcgtttaaactccacagcagctatataaggtgcatatcagcttcgttttattatataaggaaaccgatgctcaaagaggggaggtacctagttccagactgagttgaagctgaacctctggcttggcagcagggtagagagccctgagatgttggcacagagagttgaggagtggcctt

SEQ ID NO: 92890 - DNA, 1106 bp, Homo sapiens
agggaaaaagcaaagacttgccttttccttattcaaaaactgttttttgagaactgactgtgcttaggtgctggggttgttctgacagataaaccccttcctcatggaacccattccaagcagcctccttgaagaaccttatctgaaggtacttgacataagatgactggaatttcctgcattcaactgcatattacaagtttttaaaatggggaaattaaaaaaaaaattcacggcacctgatattaaaataataaaaagttaattcttggtctgccaatgacctgctcaaagtgagtggacagcctccctgggtcttcatctcctcatcctccagtggagctaatcttccttcctgcctccttttcaggaatattttgaagacaacaagctttgaaaacaagttgaaagctctgtataaattgcagggcgtgactcacatgcctgtgcgggacccatgttcacaaggtgctacctggtgagaggttttggatgaaggatagagtctgttcacagatcaatttttatcaactttacttctccaggtttgtctgcaactgtttagggattttttccagctgtcagaaatacttttcctgattttatattagtatttggcttctgcactgcagtgcggtgctttacaaacatgcacacgtatatgtttacctaatttttctaggatgataatttaatgtagttgatatgacagtataagaaggcaaaggccaggattgttgctccaggtacgaggaggcttgaaaacagcatctgtgggtatacaggagtgggaggtgttagaagtcagcctagcttgggtcagggtaggaaaccaaaggtgtgaattgtcatgaaaagccacatgcaaggtgccaaccctcccagaccccccagaaatagctgttgaaaattgggctttctggtaaaaagatcagctgctgcagaacgccttccatacatgtcagcaagtggggccggatagcatagagcgagcctgaaatgcgtctaaataaatgattatggtgactcactcgcccccgttgaatggaatgtttttttaaagtgaaagtaagagagaaagaagataataaagcaaagaaaaagaa

SEQ ID NO: 92891 - DNA, 1044 bp, Homo sapiens
ctgaactgttgaggaccccagctgagagcagagcaaagccacttgtgacttcctgtttttactcagcaccaagaagaattcagtttgcatttgctcccaggcctagatgcaactagataagtcagggacccagagtcaagtagaccctcccaagccagccctgggcaaggagttcatagctccccagggccataggggcacccactgtcagctgtcagtgaccctctccagtgaggctgttccttcccttccctggtgtttttttcttcagtacacgctcttcttttccattccctgccagtcccttcacattgccatgctctaggtttgttaaaaataagctgagcacgtattatggtagcacaaaaagaccagagaatcagcagcctcagtgtcaaatgttggtcctgagaaagtcagttcactcatatagcctcagtttctccatctttaaaatggggttgacagcatctatcctactggccacattttcttgttcttttaggatggcatagaatagcctaccgggaatgctttgaacactttgaaaggctgaaggacccataatgtcctagttctattgggagatctcaatcttaaagacagccctggaccactgtccagagattgaaaactaatttaggcataattaagctataaaatctcagggttagaggcatcctccaggggcattttgcccagccttgatgttgaatcctctaacttatttatgtatcttacatttattgagtatctgctttgtaccaaatacagttttgggaactaggggttcgaaaaatgagcagcatttctgttttcaaaaaaaaatttagtcatggaaaaagatccttataatacagttagacaggtggtatgataaaaggaagggcaggctgatgtagggcccagaggtggccacttgactaggtcacccatgagggttgaatcaggtgatttgtgctttggggctgaaatacatttgtccttccactgtccacttgaggagcaatggagtgatggttggagagccacacatcagccctt

SEQ ID NO: 92892 - DNA, 1074 bp, Homo sapiens
cacctgccacagacgttcttagccagccagaaagctgctgtgcctaggacccagcacaccttgccgtcaccctctctcctcccccagaacccagaaccccagtttggcaaaaggcacttttccaatactgagctttgggaacaatttgacccacttcccaaaatgctggtcccaggccagccatgctttttggtggagacacctgtcttgtctgccaggagacattctctgtcaaaatgggccagcccgtccctgggtcctcctccaagctgctcctactcgctagccagtgtccccagagaccagggccaagatctttgtcatttaaggcctccaaagctatttccccacgcatccccagaattcccccagccactgttttgggggtgccaggtccagaactgatggagcaatctttctgtgtccagggcctgatgtcctctcccacacccttgtttacccgcctgctccccagggaacccaagacagggtcatggggctggagtttagggccctgatctcccctgaagctctgtgaccctccttttctccctgttagaaactttcctctctgtcaccagtcactatctcctctggatgggacctgggccatctgcacagtgtcgagtccccagggcacagaatgctgatctgggaccctggaaggctgggacttgtgctggggcagcaggaggagagtggctgctagccaggtctgggcttgggtaccagagttctttgggtggatcattgtcggctttcactgatctctggttggggttcgagggcttgctttgcagtggagacaggaggcagagcaggggctgtttttcctgcgtgcttctgactgtcttgtgttgctatggtgacagttttgcctgtcttcctccttctgactcttctgggagctggtttttattggtccgttgtcctgtctttcatggctctaatttctcctttctacttgctctgaaataaacagtcataaacatgggcgctgggcccaggctgggggctggcagaacttcacctcctgctggccctgggttcctgtgaggggagagtgggaaagcg

SEQ ID NO: 92893 - DNA, 1053 bp, Homo sapiens
ttttgtcctgtgatatcatatgtggcaatgtttggtactgttctcaagaaagcagagagagaacaatctcttagagaagtcccattttccccatcctactaaatatcacagttccccaaagtgactttgctgtcttctgtccccccagtgccttcctgcatgctgttccctttgcccggaatacatttcctttcttgtcttgtgtgttgaacacctgcgtgtgttgtaagatgcaacccaagtggctccaatgaatgtttgcttgattattctctctggccattactcactccctccttggatcacagctgtggcaaggcatggttctctctattagagccccttcactggggcccccactgtgagaacgactgagaccctatggaagagcaggtccttgagggcacagactctgtttaagtgtatcctcaggatccaggccactaccagcacgtgggatccaggataaccttgaatcaataaatgagttactcctgagctcatttcacttcaacaggatggactcatcactcctggttttaagcaaagcgcctcacatctaaaaaacaccaatgaagcggggtttttgaactttaaactgtatttcaatgtttttcacaaaactgtgtatgctttaatatctcattttcccagcattatctcacttcttcagaggttgtataaatctcatattacaggggccaaagtcgtcagcacagtgtgggttttttttttctttgcgtgtgaaagagtttcaggcacacaattcatgtcaatacattctactccagagtcttttctaatagaataaaatgagaccatgcatgtgtttaattagagttcagttttccggcttgatttgtctgccttacacagaggagggcatttaggaatgagctgaatgcttgtgattcacatggtgaatctgggtgatgtatgtccagggccctcagaggaagtagagatgatggaatacactctaggcctctcaagatcaaggcccttctgtttgctaaggatggaagaagagtgaaaagccttgaaaattcttaa

SEQ ID NO: 92894 - DNA, 1029 bp, Homo sapiens
ccttagtcacgctagccatacttgaagtgctcagtagccatatgtgcagttatagctagcgtgctgtgcagatgtagaccttcccatcatcagagaaagtactaccgggtagtgctgtgtaaaaaactcaactctctaggggggcatgttctgaaaatgcaaacctgcttttagaggttttgatggaatctcttctgcctccttcaagatcaaaagagtcagagttctgttctgttattaaaaatagctacttctgttattttttgcctactttagatttgggaagacagatgtcttctttcctactgacttatgttgggggacacctgcagcctacctgctgtgtgtgcacagctccacgtagttgcactgaacatacgttgttagcaccaaagtcacactgagataaaatttattgtcatagaatgaacatttttttttcggaatgaacaaatctgttttacttttcacatgccatgttcgttgtccctcttttgggagcctggatgaaaagttggaaagttgcttttttcccttttgttgtcattaattcttcaaattccaaagttgtatatttaagagtagatttagtaagttgttgctagcaactgctgcaattttaaaattataaaataagaattagggggaaaatcaattgttataaatttatttgggacatttattgccaccacattggaagcctttgaaaattcaaacagaaaccaatacacttccatcttttttactttcgataaataatatctttgtgtatatgtatatatagatagatatacttaatcaataagtcatttagcagggtttttacattttatactgcattcatccaaaacagctctttccagatcgataggatgcaaatgaggtaagaattaaggcaaacccaaaaggcatgcaaatgtagtacatttatattcactgataatacaagcttctgtggtgtgtggaccagacacaggagccaagggtccctctgtgtctgtccaatagtattttacaggagggtagtga

SEQ ID NO: 92895 - DNA, 2304 bp, Homo sapiens
gagatgggctttcactctgtcattcaggctagagtacaatggtgcgatcatagcttactatacccttgagttcctgggctcaagtgatcctcctgcctcggcctcccgagtagctaggatgacaggcatgcaccaccatgcccaactttttttttttttttggtagagacagggtctcgctattatacacaggctggtctcgaactcctgacctcaattgatcctgtgacctccacctctcaaagcattgggattacaaacatgagccactgcacccagccaattttctcctaatagtttctggtatttcttttccagtataatagatttcttggacatcatagataatgtaatgactgatccctggatgaaaatccaggagcttgtatcagcccacagaatgctgcttttacagaaatgtgacttacacaatagcaatcctaacttttgcctttgtttttcaggatatggttaataggagaattgccatggacttgatactgaagatggcagattcccagcgttttagacagtttatcttgctcacacctcaaagcatgaggtaactttttaaaactttctagatacatatcaagtatataaaagggggaaagaaatcttttacaattttaatttttaaaatacaaatacatacaagaccaatgaaaataaaaattagctcccctactggttcaggagatttgggatgtttttctctttttgagatatttaaaattttacttgtattacttccctttcataactgaagcaagttgttactattctgttttgagtctgcttctttgtagttatcatgacaaactaaagtaatataattttagtaattctgtttggactaaaatgatttatgatttccctaatcttgcctcttttctcttggtgacttacaaatgtcaatctttctaaacaaagagctctactctgctgtcagtcagtatttattgggtgcctacaattgtcaagcactatgtcacttagagttaatattctgtctctaaagtggccatgtgattatatggggatctaaatttgtgattgggaatatccaggtaactccttccttgctagacaataacagaaatttaaaatagttgatatataaatctctttcattttcttttcctccaaactgaaaacccatgggatctagcaggaattaatttttaaaatggaaaacaaattatttccttattgcaaatgatgtttctcctagaactctagatattagatatatcccagataaaagccaaatatttagctttatattttcatgaggtaatattagaattttttttaattggtaaaaggtttcttggaaatttgagtaattgattttgcttcttctagttcacttccatccagtaaactgataagaattctccgaatgtctgatcctgaaagaggacaaactacattgcctttcagacctgtgactcaagaagaagatgatgaccaaaggtgatttgtaacttaacatgccttgtcctgatgttgaaggatttgtgaagggaaaaaaaattctggactctttgatataataaaatgagactggaggcattctgaaatgaaagaaactcctttatatatccaaccacaatcaaacatataaataagcctggaaaaccaactacaacctgcaatttaagattactattactttaagaaaatcaatttcatagtattggttttaaatctttttaagtttttttaatacgatctatttttataggttctttttcagaagtaaaattttgtacatatatacatgtacatatctgtttagtttgggttcatttctataacattttgtaagaaaataaaagtttgagcacctgattatatttagttttgcttttccagatattacattctatagttaccaaaaatggttgaagggagggatttctcattgcagagggtggggtgcaagggaataagacacttgtacggaacactgaagctttgccaacttctacacatgccttttttgcagtcctttaactgtccaccctaccaagagcttataaccagtatcagaactggataatgacgcagtttttcactctgacctccatcatgcttgcctgatttaaaagccctcagtttgcagtccagggactgttcaggcttgtcctcagctgagaggacacaggctagagggactgtgcagaaccaggctgggagaagggctgggaaaactgggagtggagggtggatcctcatggagcaggagagtagctcatggctccaggagcctgaggccatgcagttgatggtgagctg

SEQ ID NO: 92896 - DNA, 1762 bp, Homo sapiens
ccatggacctttatttagtaaataattttttaaagattttatttagcttttaaaagaaatttaaaattatttaaattttaaaagattttatttagaattcaaaataaatacaatacaaaagaaatttttttttttttttttttttttttgagacggggtctcgctctgtcgaccaggctggagtgcaatggcatgatcttggctcactgcaacctctgtctcccaggctcaagcaatcctcccacctcagcctcccaagtagttgggaccacaggagtatgccaccatggccagctagtttttgtatttttgtgtgtgtgtgtgtggagatgaggtttccccatgttgcccaggctggtctcgaacttctagggttcctttaaaggattcctaaagcaatcctttaaatcttttaaaagatatatttcaatgcatttctttggccagtgtaagctttttaaagttgatttctgtccttttgacgttcagtaatcacttttaatgcagcttaaccactaggtgtcactataattcaagtaacaaaaaatctcagcacttttaaatgtttgaagcttaagtttcagggttaggtgtggtggcttacacctgtaatcccagcactttgggaagctgagatgggaggattgcttgaaccgaggagttcaagaccagcctgggcaacatggagaaacctcaactccacccagaaaaaaaaaaaaaacacaaaaattagctggccgtggtggcatactcctgtggtcccaactacttgggaggctgaggtgggaggattgcttgagcctgggagacagaggttgcagtgagccaagatcacaccattgcactccagcctggttcaacagagcgagaccctgtttcagaaaaaaaattgttttattaacattttttaaattagcctttggaattttggtctgttagattcagttatggtgaaaaaggttttcagttttattctcttgcagtagagcaagaagtaccattatacgtataactgttttactgtaaaattttttgaaaggaatgggtatttccaaatcactaagtcattttattcccatctcctttttactgtaaatctattatttatctgtcttgtaaagaatttaatctggcctttcatttacttagttttttgttccttgtcaactcattctcttcaaggttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggtattgttaaattttaaattctctttttcatttttttgtttgtttgaaacatgtatttctaaaggaaggaaatctttctttagttttacccctaacaggaaagatcctgccctgactctttagtctgtgaccagtagtggggaagaactaaagaactagagttctctcccttgcttctaggcacacagtaaccctagagaccctggaggggtcctcctcttctcgcccagcatggatatccgtgccttccatcatatctgcgttttctccctcaccctctctcccagcttattttcatcaacccataaatatgttcagactttttgttttaatacaaaattataacctgttcaccaccctggctttgactcaccctagccactgtttactgttccttcatacccacacatttcagaacaatgtacag

SEQ ID NO: 92897 - DNA, 1649 bp, Homo sapiens
ccaacccagctttctcccttattgactgtgagccctatcatacctcaagcctaatataaggaaagggggcccctctttagtgaaatattgtacgtttggagacgccattgttcttttacacaaaatatcaagcataaggtaataaagactgcgtgcttacccctaagatcaggaagaaagcagttctgtccacgctcaccatttatattcagaagtagaactaaaggttctagccagtgcagttagcccagaaaaagaactaaaggcatgtatattggaacagaagaagtaaaattcttctgatccacaaataatatggttatctctgcagaaaatctgatggaatctacaaaaagagctactagaactagttgaagtcataactagcaaggttgcagacacaatcagtatgcaaaaattaattacatttctatgtacttgcaccaaatgattagaaattgaaattttaaaaaatactatttatattagcatcaaaaatataaactacctagggaaaaatctgccagagatatttaagacctgtacactgaaaactactaaaatagatgctgagaagctaaagaagacctaaataagtggagagatatagggtgttgttagatcagaagactcagtattattaagaagtaagttcttcccaaattgatatacagactgcctcaactcaattttcattaaaatgccagcagacgtttttgtagaaattgacaagctgatcctaaaattcatatagaaatgcaaagggcctaaaatagccaaaacaactttgaaaatgaagaataaaattggaagacttatcaaattgtacactttaaatatatgcagcttattatatttcatttatatttaaagctgtaaaaattgccacatatatgaagaagcatggaaaggtgattgataattttttttaaagtaggaaatagaaccagactaccagatgataattacaagagaaagcagactagtatttttaaccatgattaatttgttaaagaacatagagttaatcataaacaaaatggacaaaacagatccagagtttcaacatagaattggaatccacaatttcaatacagaattggaagctacaagaatattctaaaactgaaaagtgcagcatctgaaattaagaactcattggatggatttaacagccaactggacacaacagaagacacaattaacaaatcaaggcaggtcgaaaggaaatatctaaattgaacagcataaaaacagaaaacactgaacagagtttgagatatgaggagcacaaccagcaagtttaacataattggagtcccgataggatagaacaaagaatgagcagaaagaatatttgaagagagaatgtttgagaattttcaaaactgaaatacatcaatctagattcagaaacctcagcaacctacaagtgaggtaaatataaagaaaaccatacctgaaatttatatgatagtcaaatagctgaaaaccaaaaacaaagaggtaaccttacctttttgtaagtagcaagagaaaaaatatgcattagtttcgaaagagcaacaataaaaccaaaggcagagtttttaacagaaattgtgaaggtaaatgttacctgacagactttaaagtgctagcagaattgg

SEQ ID NO: 92898 - DNA, 2829 bp, Homo sapiens
taatttttaaaattgtttatgtctttactctggagaactttgccattttatgacaacagtctcttttagacatcccatgaatggaagcaatgaatgaatacatatctgtattgaaagaaaagttaacagaaaactctgaaaaccagctagcagtggttgctgtggcagcagaaggaaactcaggctatcagtgatttctagtgtgggaatttaatgcagttcagggagggaaataggaaggaaaagagtaccagagaaatgagccttaggtttactagggagcaaagatgttatgaaaccacagccagtgacttaccatgcagattttattttctaaataccattccccactaaaaggaaccagggctccatggagaaatggcgattccagagctgggcagggaaggtacagatgagcctcatactatggcagagaggaaggaagggctgagaaaaaaaaggggggacacatccagcttgaaggggtgcccattggaaaaatctaggacagtctgaggatctcaataaggatagtaatagatggtgtgaataatgtaaaaataaagccaatgaatatcagactccctaatctattctgataaatagaaagttagataaggaaataaagaactgaggaagaagggaaagttccttacagtaaaatgccatctaatatatagagaaggaaagatagagtttgcattgtgccaagcaaagtgtaaggcattagaggtacccagtgcttaagagagtgcccttagcttttttgctactgtgaagttagaaggaggcaaataaatagatactttgtccatttatcttgtcaccattacagttaatcctctcaaggacaagatacctttataatgtattagggtaatgccttagattattaattagttgaatgactgatgcattcctaagcactgactgtggtataatgggttatattaaatgtgagatgactctttaattcatttcattaatttttttgttataaaagtaaatgaactggtgaaagtgtagggacataaatgaatataaagacacaaggcaaaaaatactacctaaaactcaactattaaatgagtaaccaatgtttacattttggcatatttccatctggttttctcacatgcttagatcatgctgaatatagtttttaaaaaacctttgccctctttttaatgtgcctaatttttaaatttcaaggtgtttgactttacgatgcaaattatactttgacaacttactatctcagcgggcctattgtggaaaaatgaattttgaccacaagaatgaaactctaagtatatcagtaagtatcctaattcttttcatcctaatcattagaaaaactagttgtttcttttcttttctatttttgttgggttttttttagaggcagagtcttactctgttgcccaggctggagtgcagtggtacaatcatagctcactgtaaccttgaactcataggctcaagcgaccctcctgcctcagcctcccaagtagctaggagtataggtgcatgccaccatgcccagctaattttttttttttttttttttccgtatagacaaggtctcactatgttgcccaagctggtcttaaactcctggcctcaagcaattctcctgccttggcctcccaaagtgctgggattatcggtgtgagccaccatgcccagcctgctgcttttcttttgataaaacattgataaactttaacctgttgtctttgatttttaagttaaggatggtctttgccaaggtgttgaatttaaatcgatcttactaaataaagctgctagcgtagattttatttttagacaaacacattattttcttagggtgataattgggaagtttttttcagtgacaagtatttaccttgtctttctactccactagttcccttttaaaatttacacagcattttaaattatttgggactttatggaaagtacatagtctccagtctcctaaaaggaagcaaagatggttcttccccacttaattgtgtttatactatttacttctgaagttgtccctagatctggccacttttgagtaaaaaaaactgccgtgttcaacttgatttgatgggttctttcatagtcatgtgttaaaagagggcatatggagatatggcattaaaaaaaatgtgtagccaggaggtcaggaacaactatccactctaaatattctggggcagaattttcaaataattacctactactcttagttaccataaatcttatcctttcattttaatacttacaataaatgttaaatttttggaacatcttttttgtttaaaagctctgcattttaaccatattagaaagttaacttttactctctctttaatttctactggtagatcatgggtaactcctctttacctgcctttggtttttaaaagacccatttattaaagatacaattttgaaagtattgggaggaattgtgcttattgatagggaaggtagtatgtcatggtagtctattgttctcactgcagactataaaaaagccagggaaattacaaaacttttatttttaaagacattggaaagctgtctaagcaataatgagtagacaaattggaattccaagggataggggagcctgtccaaggtaagctgacaattgctggacgttttctttcctgggagtgtttgctgattctggactttgagtagtctagtagtagtaggagggctgacaagacagagtagaaacttgggaagggaactgctaggcacctaactaatatttcagttagtcaattcctgagttctgatgttgtgcacagttggcccaag

SEQ ID NO: 92899 - DNA, 2425 bp, Homo sapiens
tttgtggcaacactgttctaataagttttctttgtctgtaggagagttttgctgttctttttcatattttccccataaatatctggatgctgtgccagcgcgttttttgttacttatttttttaattagttgaattttcctgggccagttatttgaaggagaatgggaagggtagctgtgggagcctcgaccagggttgcctttcatgctaattcagttataggcttgccacagtaataggctgttgccttttgtaatagcactctgagtagccatgccatctctgcctctttgatcttatcttgtttaggacaggggagggtggattctaatgctggcttgagttctttttttcttttattggcatctgtcactgaaggaaacctttcttccagtgtgaccccttccctttttgaaggtgtgtatttgctagtattctctaagatctgccacctctaggccgtaccagggcatttgttcacacactgtctctgcctcctctagggcttggaccttgttccttccctgtcaggatagcactttcttattccgtaccaccctttcattctgggagtgtaatttgcctggaaatttatgaaattgactgctactaggcccccttagtactctctgcccctccctgttcttcccagttaaatctgtttgagattctactgttatgttttttacgtgtggtgtattttttacgtaatattttgtttatataataggcagtaccaagaagcaagagagacctatcttgatctggatagtaaagtgaggactttaaaaaagtttattaaattactgggagaaatcatggagcacagattcaagacatatcaacaatttagaaggtaagtacattgaaaaatgttactatatattatacatttttgtgtttctctgttttcatattatttatataattctgttatagcagagactattaatgcttgctttgttattcagttcttaggattctctaatttaatcagacaattccgaatctgaagggctctttatggtgagcttatccaacttttccactctgttagatattctttatgcttaataggtcttttatgcttaaataggtcctttgaaagggaactcattggttctaaaatagcttattttacccttgactattgcatgtttttaatggatacaagcatttggtaggaactataaaggtaatacctcagttgatttaccataatctactagaatgacgtagctccatgaatgtagaaactctgttttgtttactgctgtatctctagtttctataatcatacctgatacataccaatatacattggttggataaatgaatacagaattagggaaactggatattaacatatccagagatgtacagactcacagagatagattgactccaactgatcacaagtgacagaaataaacagaggataattgatagggagggacggtcctttaatatacatgaatccgagacagccctagtccttccatttgcctctgtttttctccaggcaaattccctcagtaatacactttttaaaactgtctttacaccaaaaattctaccatcttaagcttgtacaaattaaaaaaaaaaaaggtacctagctcttatattccttagtgaaactacaggttagtttttgaaattcctgtttcagttttacaggcatattagtagggcttgaattaaataggacccatttttacccttttgaggctacttttagccttgttagatgagattagagcagccgttggttgtgggctaattttttcctacctctgaggcagtgctattttgagtactctaccgataccttgtaaatcacaaggttttcactctggccaataagaacatgaactattcctggtcgtgtgtgagctgtcggaattacttctatttcctttggatatttcttttcccagcctcaaatggtgtcctcacacctatgcactgaccagtactcagctcaagactggagcagaaccctttatagatcctctggagtttattttgcctccccagattcccagctccagctcctgaaacaagagcaacagctccactttgatttctactcctttgtcctctgtcggtgaagagcagtgtggggcattggtggggttcaatttgtttcctagaactagcaggcagttctagtcaaatgacctgatagtcactatctgatagccagagtgtgaaaaccctcagagtttggaagaagttaatttcaacccccttggatgtccttgagggattcagtggaggaagtgactgcagatatggtggaagtggcaagagaactagaattagatgtggagcctgaagatagccagagtctgaaaatgcttgttttatatattttgtctcgttttttagtttcaggcagaagaataaacccaatctcta

SEQ ID NO: 92900 - DNA, 2414 bp, Homo sapiens
tactactgtttgtttttaaagtgatcttgggatagcttctttccagttgtattttatgctcaaaattgtgaagttataccagatgtgactaaataaatcagcgttaaattttttcacatccttgctttttcccgaacccaccctttttaaaaccaggtatcctttttcaggtgtcctctgtaaatacctaacacttgcattgttttaagtttttaaaggctaatgtggattcccccaaaaacacctagtttattagaataaaactgaaagtaccataatatatggggaattcagataagaatttgaatttaatgtgacttcctaatttgggaaactcctcacttctattcagacacatatggatataataacacttgcctcttcaaacagcataatcctagccactttaccgagttgtttattatctttatacctatgctggaaatttttttaaaacaatcttttattctggctttgttcaaacaggatgaattaaaccttgctgattctgaagtggataaccaaaaacgagggaaacgacattatgaagaaaaacaaaaagaacacttggataccttaaataaaaagaaacgagaactggatatgaaagagaaagaactagaggtttttcaccatttttttcaagttattttgttttcagccttagccatgattattaaagtgtgttttccctaatgtcatgtttctaaaaacagaaaagttgtctgaatttctgtttcatatagagtaataggtgtttgggtgaatcaacagaagaggcttagggaccctcagagtgtgaggacttaaataggcaagactctgacagtcctgtattatgcctctgagtgctttagaaagtagcgctgtctttcagctaacatagctccttagatgcccaccttggcaagcggatagcccttgagtgtccggaaaaggcaccccttccagtgagtagttgggctgtgggccgggctagattttagctcctacgagacatgtctattggcaattctaagcagtgacccggtgtttagaggagaataaattgaaggcaaccttgtcctaaccagaacagatggattccaattttgcatttatatcttaaggaaaatgatctaaactctgtaattcattttcttacttgttttcctcatttgtttaagaataatacagaaagttgtgaatataaaaaagtactatgtgtaaaagtgccttgtattctttaccccatgagggtctttgtttgtgtttttaataccattggtgctcagagtcaaccctaaaggatgtggaaacctacatctcacctcgatgccctgggtagcaagcttttcgtaactgctgcattaaatttgtttcactaggaagttgtggagatcttgcaccttattagttacacacagcaatgcagttttctcttgaggtcattactctggactttatcttcaatataaaacttagataaatataaataacattgatattaaatgtaattaaaatacatttcttaaaaatgagttcagaattttactttgcagattttggcacaagtagtataatgaattgttatatcaaagaagagttttaaagatataaacatctactttcttaggagaaaatgtcacaagcaagacaaatctgcccagagcgtatagaagtagaaaaatctgcatcaattctggacaaagaaattaatcgattaaggcagaagatacaggcagaacatgctagtcatggagatcgagaggaaataatgaggtaagtagctggtagcttttctgctttaccacattattcatgcatatcatcaagacaaaaaatgaaaaacatatacatgtcttaaatttgaatgaagtgttactatagcaaatagttatagctgaagtagtcctttatatgtgtattattctcaataaatagtaaccttttttcttctgaactattacaaaactcattatggaatttcattttaacataaatgctttcgtgtatctataaggttcatatagacatgaaaatgttcaacttcataagcaatgaaagaaatggaaatcaaaacagaagccatttttcaaatacatcaaattgaataggatgaaaataacactaatattctaggtcagtaaggttcaatgaaatggatattttcatattactgataaaaacagatgctcttgataattagagcacaggttctgaagaaagagtatcttgatttaaattgcatttccaccacctatttatgtgactttggcaaattagctatctctctgaactttaattttctcattcacaaaatggggattgttctgaagattaaatgaaatgatccataaacaatatgtgggaaatatagtatattagttgttaccattaatgtctttctgaaaagcatttagtggtatgtcaac

SEQ ID NO: 92901 - DNA, 1085 bp, Homo sapiens
tgttgtggtattacaaatcatatatttataaactttatatatactcatgagaaaatgctaataaaagtggcaaataatgtctaattgtttttatgaaaatagttttggcttcacagaccatctgaaggatatcagaaacccccacagcttacttggatcatattttgaaaaccactggattagaataatcattccataacttgagactttggatgtttcagaaaaatttttctcgttggactcaacagtgccatcatttaaaatgctaagatggattacttacatctcttttgcatgggaatggattagtatataagaatgatatggcagaatttatacgtaatttcctttggttgatttaatactaatgtacccctttcattaattatggaatccttctgtatcatcattatagagctttgtagattaatgaatcctttccaaggttttcggtttaaatttttttttatgttactaaaatccaaatacttttcttttagatgaaaataagaaaaaatatttctgaaattcgggaacttgagaacatagaagaacaccagtctgtagatattgcaactttggtaaaatactttttttcaatttaaatgtaatattaaagggtaaagccaccatttaggttaatggcatcaactcagcttttttagaaagttcttttaattgaagctactctttatgattgctgtctccattcaccaagaaggtaaaaactacctggtatacagccttcatattttttaatgttttgtgtatatataactttcatgcataataattgattttgtctcctatcacatggaaaaaaactttaccaaaacttaattgtatttctaaacaagggcccatcaaaccctgctgttgagcatagtgtttttcacataggcactctcagagttcagcagtatcaatatgaatgggcacagatgtcaggatcatcttttagtcagttctagttggtgtcttgttttttttctttttttcaaatcagtatttttcattttaaatcaacgcattttttactgtaatctttttttcgggaatctgtttatgacacttagctttttctg

SEQ ID NO: 92902 - DNA, 1042 bp, Homo sapiens
atatgataccatacagtatgtcatatattcttacaatacagttagctacagaaaagagtatgttaaaatcataaggaagagaaaatatatttactattaattaaataaaagtagatcatcattaaggtctttatccttattgtcttcacattgaataagctgaggaaaaggagtggttggtcttactgtctcaggggcggcagaggcagaagaaaatctgtgtataagtggacccacatatttcaaaccctgcattgttcaagagtcaactctacttgttaaggaaataagtaaaacttgattcctgtttagaatgttttttgaaatgtctgcaatagattttcatgattaatagcttggtaggattatagaactggtttaactgaaaaggattttgcacataacttactataaataaggctttctttgtaaaggtctaaagtatttgtaatattgagaaaaagatttaaagtattttctatcttctcctttcctatcaagtgacttggagaatgaggttgaaaataagacggcccagatattaaatcttcagcaacatttatctgcccttgaaaaagatattaaacacaatgaggaacttcttaaaaggtgccaactacattataaagaactaaaggtaaaaaaataataataataaaccttcttttgtttttttcaacttactactacgaagttgattttaagatcccattattgactccaagcaattctcaaaccttttggcctcaagcccctttacactcatcaaagagctttcatttatgtgggtatatctgtcaacgtttacatttttaaaaattaaaacaaaatttaagaatatttattaattcatgtattagtctgttttcacactgctgataaagacgtacccaagactgggtaattaataaagaaaaagaggtttaatggactgagagtttcacatggttggggaggcctcacaatcatggcggaaggcaaaaggcacatcttacgtggcggcagccatgagagaaagagagccaagcaaaaggggaaacgc

SEQ ID NO: 92903 - DNA, 1082 bp, Homo sapiens
aagaaatatctaagacaactgagcaggaaaaaaaaaaaagaattataaatgacttgtatgtgtaggggaaatgagagttttgttgaaatagatttcttctagtcatttttatgtgattatgagagcagaataaaggaaaataaccataatggatgttggaaagtttagtaaaacaattagcaatagaaaaagttgaatgactagcaccttggtgttctggcacttgcttttgtttattatctcaatgcagttttcagttacaaaagtatacataatgtggaagcaaacccttagaatgattaccagcgtggttcataaaaaaaattacctgtgaatttttgaattgttaaaatgctataacattttaatctaatcttcagaagtatgctctttaaaattttattcttttatttgttctttcaaacaacaaatacttaatgggtatctaatactccaggcactaatcaaggcacaagacacatcaggaaacaaagtattaatatacaaaatttctctactggatcttaaatttaggggaagatagactataaatgaatactaggttaggtggtgatcagtgctgtggagacaaataaagcatagtgtggggcaagagagtgacgagtatactattttagataggctgtcaggaaagatgtattcatcccacacaaacaactcacatactcagctcaggcttaatatatttttcattaggtaacatgttctctatgtaaaaactcagtaaaaaaaactaaggaggaacactgtatgaaaatgtataggaattagttttacccagtaaaaacaaagttgtaaaatttattagttttattaaagttacattgattgcttaaatttattctatatgttcagaaaaattgtataatgacaatattgtcttgcttattttgttggttttcatttttggcttaggctgtagtttccgaagtttgtttacttggcaattttttttgtttttttgagacagggtctcactctgtcacctaggctagagtgcagtggcaggatcttggctcactgcagcctctgcctccggtgttcaagtgattcctgtgcct

SEQ ID NO: 92904 - DNA, 1077 bp, Homo sapiens
gttaatcttttattggaatttgctattcattcatatcttttctagggtataaaagtcatttagaaaaaataattactatgaactggtctaaagtctatattttcacattaaaaagcacttagaatagttttaacttttaaatagatagcaatatgtgaatttaaaaataaatatacaccaatttgtcatgaagcattgtttactaaactgttttaagactttttaaatagttttcattcttctaaccttgaaagtttttaaaattcttatatttaactttatgaaattatttgaatgttttaaaaagaatacttgaatcatattaaaataataaggacgagtaacattttgaaattctgtacatcagaaaaattttcacatcgtcttaaaaaatttattttcttctattcttttagaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataaggttagagtcaagtttagctttactgtatcattcccactgcttccttgggggttcattttctttcatattactcttttagtggttgtttcagtgaggacgtgagtaatctatctcagtgcttggtcttaaaacatcacttagctagtcatagaattcgaggttgacagttatcttgcatcatcactttaacaacgtcattcaggactgataatccagaacgtattccctcaactggatcatttgtacactatttgttacttgtcctcaaggagataggagcttgactcaatgtaaatcagctacatcactgtgctcactgtttagttttgcctatttgtctcagagaggatacagcagactggtttacattctggctcaagctccttataatgtccctgattggtactttgaggtgcacagttctagaaagaagatcaactgacatgattagaacacatgcctaggaaaatacagctactagaatagacaaattgagaagt

SEQ ID NO: 92905 - DNA, 1082 bp, Homo sapiens
aaaaatgtaagctccatgaacagggtgtagtctgttttgtatactgctccctttatcctctggaacagcacctggcacagagtaggtgctcactaaatatgtgttgaattaatggatgaataggtataaaacatgtatgcaaagatactttgttttggaattctaggactaggaaagcactaagaatgctaccaccatcttttcctcctcagccattcattgctcctgtacctcctattcttagtatgttcatttttcagtgctattgatagctcacatgtttacattttagttgaaagattgtctctttcatgagcccaaattacaattcataagaatatcttttctttcatatttcctctgtgttggtaataaactttacttcagtttttcttttctcatatcagggaaaagattgtttagctatttataatgaattttaaataattgacttatgtatgataactgtatgagatttaaggaaattgtaattattaattatagtaggcagcagggcatattgattaagaatctggactctagagctgagctgcctgggttaaatcctagcccagttacataagtagcttcatgacgttggggaacatactcaactctctgaagcatccttatctgaaaaaaatgtggagagaataatactatttatcttatgtggttgttatgaggattgaatgagctaatatttgtaacatgcttataacagtgcctagcacatagtattatataaatgctaaataaataaacctatacagctatgttttcaaatgttaccagatatttgatattgtcttgttatttataatttcccccattacaaatatatatggaaatatatatactcttatatatatatacacaattttcatatgtatatatttataattaaaatttgctaagttaatccttctgtatttttgtctcctagagctgcttatcatccagactttccaacagttctgacagctttagaaatagataatgcggttgtggcaaatagcctaattgacatgagaggcatagagacagtgctactaatcaaagtaagacctccagatctttgc

SEQ ID NO: 92906 - DNA, 1237 bp, Homo sapiens
ctgtgcttctaatcacttagccacgaaacacatgtgacaaaggatccagtgtatgtgtcataatgccagttttcttggaagtaggtgagtttatgtgctgagaacaagggcctcaggagttgctaggaggtaccttctttaagggtttagattggctaccaaggagaatgagagaggaagctgactcgaagtctgcttaagatacaaaagcctagtggctgcaggatttttcactaataatgtttctttagagatgtgagtggagggagagtctgtactgttagataaacattagagttttttagagtgggtaggtactgcagaaagggaaaagggaagcagttgagtgttttgttgacaaactagtttaaagaaagagaggcctacgagaaagtgtttagacccacctcagtgaagttagagaatatgcttaaatgcatgataagtctggaaggataggaggttgtggtaagagtgagaaattcaagttgaatggaacaggtctaggggatgacaaagtccatgttttggcttcaggagcaggtagctgaaacacaagttgttggagttgtggaagaaactagattctaatccttttgggtgttgacaggatattgacaagagtcttgagtatgtctaacattctgttaactttacctgccttgtaaacattttgaaggggtgatttttttctgtgtttgaagaaatttttcggtatgaattatggttcaaatgctaaatttaaaaactggctatattattttaatgtggaaaataatagtaaaatattattagggtattataatgcatcagatacataggactcatttcagtcatttaggcttacgctagataaccttaacagaggtacctaggaagatgcctagctcgtaaggagtattcagaaaatgtgctttcctttcctgtaaagatggtcttgtttcttcttttcagaaggacatagaagctactaaactactactcctgctattatgcctgcatttgtacatcttgcccccatctcaagagagattctttctgtctgaggctagtctacttgtgccttgaatcacatactttcttgcctgactctattaaccatttaaaaaaattatttcagccctctcctgagccttaaactttcctgttaaattttctctctgttttaaacatgataggtctctgatttgcgtttcttttaaaaatacacctctcctaggggagactgcattcactc

SEQ ID NO: 92907 - DNA, 1046 bp, Homo sapiens
ttttgttagtaaagtattgcatttaagtattgtagtaatatctcttttaaatgatacatacctttataccaggatccatttcaaaggatgaggcttttttttttcgcatcccattaaggactttgaaaatcgtttgattttcagaaccccattggaaggctagaatagtataaactgaacatagaaaagccaccgttgatttacattagagtgggacaatttttttcacaggatttggtggattttctctccattgtatcctatgggtataggggatttcccattcagttaaaatattatttaaactgctttatataaaagtatgttaaatcatttataaactatgattaaatgatctgtaaagtcatttaaactgctttatataaaaatataagtcatttatatgctataattaaagaggaggatgttaatatttcaaaataagtatttatgagcccttctgtaattttctctcacttttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacaggtaaggcattagtaattgaatatgtttctggctttgcttaatcatatgcaagattggaaagagttaaaacacttttaatgttaatcatatctttaccactgatttgtaaaatttcatcaagccactttaatttctgtctaggtattagttctgggcattagagaaacatagataaatactccctaccattgaagttcttatatgtgggagacattacagggaaacagatgtagtatggcttagaaattacaccagtgaggaaaatgatatgaccaatttaagagggaggggcctgaggaagaacattggcacccattacacacagttaaattctgaaggtgtttcacagaatccgtga

SEQ ID NO: 92908 - DNA, 2187 bp, Homo sapiens
tagagacaggatttcaccacaatatccaggctggtcttgaactcttggcctcaagtgatttacctgcctcagcctcccaaagtgctgggattacatgtgtgaacctctgcacccagcctcttctatttttttaattattatttttctgagacagagtctcaccctgtcacccaggctggagtgcagtggcgcaatctcagctcactgcaacctctgcctcctgggtttaagcgattttcctgcctcagtctcctgagtacctgggactataggggcgtgccaccacgcccagctaatttttcgtatttttagtagagacggggtttcaccatgttagccagggtggtctagatctcctgacctcgtgatccgcccaccttggcctcccaaagtgctgggattacaggcgtgagccacagcacctggccttctattttttaaagtagagattttgtacctgagttgaaattagtgatgctttgagattttaaaaaatgtaatggtttcaaatggccattttgtgcttcatttaaaaaatatattcctgtatatattcagcctctgaagatttgacaaaagtggacgtgaatgggatatttgtgttttcatttttgtaaagtgtgtctaatttttttggttaggttttatataaccgatccttaaacgaatataaagcattaaagaaagatgatgagcagctttgtaaacgaattgaagagctgaaaaaaaggtagggtagttactttgaaattttcatggctatcccattttgtaataaagtaaggtagatgcattggagtattatattttatgtattgttgttaatggaattttattacatcggtttgtgttctttaaatgttaggctgttcattgaactaacatttttcactttgggttatttactgttagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagtaagttgcaacatccttagaatgatttttttcaattacttttacatcatatagttttgttcttgtatgaagagagcaaatatggttgtttcttctacataataagggatctttttaaaaagattttatttttatgttaaatactttgcagagcagggctaactcattggcagtgcacctacagccagctggatcttttaaaatcacttttcaagacttttcttatagttgtagagttgaacaatttctgggattcctagcccatcattgttgcattactttttttatgccaagttttgaggactccagactgtttttctctggtaacacaattattttcaaataaataattctgcttttggtttttagggtagctagctgggtcgttcactgggatgtaggtgttatgggcaaaggttaaatgtttctgtaaaactatcacatatatgttctgtttttctgcttttgttttttaggagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggtatttgtcttaatttagcgaggttataataaactttagaaataagtttttattttcagaacgattgaatgaagttttcgaaataaaatgatttcatttaaaataatgaaattatataaagctttgtagctttcgttttatatttttaaagcataaaatatccgaaagaaagagaactttggaaaaggaaaagtaatcatagagttgaatgatttgattcttgtttttctgaataaatgaatgaataagtaaatgaactaatgtaatataattgattattcagaaaaaaccagtaacatcaagatatagttgaaggagcagttaactgaattttggtaatctttttaaaatgacttttctttcttagtttctattttggttgggcagcatgatttctaagttctcttccaactgtaaaatctgtggttacttcactcttacatatacatggtact

SEQ ID NO: 92909 - DNA, 1285 bp, Homo sapiens
attgtgccactgcactccagcctggtaacagagtgagactctgtctcaaaaaaaaaaaaaaagtgaacttagttaagaaaattataacttgtttgattttcagaaataaatttcttctcatccttacattctctttggaatgcctattgactctgctttgaggaacagaccatcatgtctatcagatagggaataaagagggaaaatgggaaagtgagttttgggatttctctatatttgtgtagtcttgaacctttaattcctttgctcttcatctgaagagtatttggccatttttatagtgcagaaattcacaaaattattggacttactaaaagtataccaaagaatcaagaataattttaaaaaatagaagttatttttaaacgaatatttatgtagtacttgtttaggcattgtttttaaaagaaatagatttgcaaaaatgtgttttttcaacattaataaaaaatacgtccgttctgttttctttttttaagcggcttactgaactaaagcgccagtgtgtagagaaagaggaacgttttcaaagtattgctggtttaagtacaatgaagactaatttagagtccttgaaacatgaaatggcttgggcagtggtaattatcacttaattacttgttcacgtatctatgtgatatgcagaatgtatttggttattattgttaatctgatcaatttgctatataatttctttcttaggtcaatgaaattgaaaaacaattgaatgccatcagagataatatcaaaattggagaagatcgtgctgctagacttgacaggaaaatggaagaacagcaggtaattacagtttttaaatgcagatttaataggttgaatcatatgaaattacagatattagactatttatgacccaccaaaccatcagtttcagacagtatatttgtctatatttgaattgattgcttaggtgaaatagacctaagcttgttttcaaggcctgttgtggtgactctcttttgaaaagagtactctatccttgataaacctgtcagaggctagggctctagaactcatgcatattgtcagtggaactttgttactgacaagacatagaagaagagcatgaagcttttactctttggttcattaaggagttgaaacacaaaaagacctgagaaataaaggggtgctagaataatataaattagaaccacattaaaggtaagtatcagaaagtatgagaactcagaactgaaaacaatgcccagagattgctaagggaactgagatttatggtcca

SEQ ID NO: 92910 - DNA, 1061 bp, Homo sapiens
ctgtgctgtaaatcttaaactattaaaaattttaaaaactaacaaaatacttgactatactgctaaatattctgtgtagccttttgagtgagttttggtatttcttactctaaaaatttaagatgtactaagaccaacgatgccagtcttttcagctgtttttgcttaaagaatggaattagtgaaaatgagcttattaccacaccctgaagtgttttctttcatggggttttaagagcttttgcaaatgaacatgtggatgtgagcatagtaggttcagtcaatttgaatctgaaatatgatgtattcttttgtgtttgtgtgattgcttacgtttttaatgtctttttacatcattgatctaaaagttttcagaaactaaatttttctttttctttttaacagttctatggaagtttacaaactcctaattgcgtttttttttgttattgataatagttcttcatgaaagcaacgcaacttgaacagatgaaggaagattattcatacattatggaaacgaaagaaagaacaaaggagcagatacatcaaggagaagaggtttgtaaacagttaatgtaaatctttttgagatcagccaaattcttatagtacttacagtaaatgatattgtaaaactatgtgtctgtatatttatataaaactagtaatatttttatagcactctgaagtatatgcaatgtagtgtttatattccgggtattaattagctattacttttttattttgtaataatgactgtgtacatgtcttactttctctattagattataagatagagaacagggcagtatcttacatacttatcctctgatagtatgactaatgggttccacaataaggtatggtagtttaagtagtttaaaacctataagtagtttaaaaactgcaatatttcttctgctgggataataagcacaagcttcaagctgtttttaaacatagtatgcatttataattatataccgtaatctacaaatcatagtaattataactctagtaaaatgttaacattccttaagcaactggtaggttagtag

SEQ ID NO: 92911 - DNA, 1109 bp, Homo sapiens
aaattaccttttttaattctaatcccctttgaaaatgttaactactttaccataattcttacttcatcattctttaaaggcctactgtcaagcatgatgctttatataacttacagtagtcaggcagtataattttgattacatgatttttataggaaaatgtataacttatctacatgtcttgaaacaaccgaaacttaatggtttttgtgcagatgtgctatttctatgatggatagaatagtcagtcaattatttttttgaagcttcacttattctcaactttatttttttgttaggcacagtatcgttaacgttatgctgtagtgaacaatcagtgtcagctgttgatgtaaatctaatttgcaaatgaattggccaaattatttggtggttttgaaaaatttgaaaactgtggcaacctagtattgtaattacactgtatcttcatgtaacttagctcaacctcattctttcagctctgcagatatctcaataacattgaggaacagaggagatgatgcctttaaagccagtgtgtatggtaactctatacttatacagcaacacatcagcatagatggaagtcgatcttataaacttaaaagtgcaacaggtttgttttgattctcttttcatttcttataaaatattaggaaatactcaaaaagaattagatgactgctggtattgattgaactatcttccttgtaacatgattggttgtgtgcatatatatatacacacacacacacacacgtgcatatgttacacatggttgttttaccccaggatattatagcaccaaaagcatgattagcagaattggggattatttgaaacaagttgtgctattttgttttcacctacagacttcctatcacaccagggtttttatagcatgtggaaataaatggttagcaaaaggtgcaaaatgacataaaagaagaggtgagcatttagtttttaaaaagagatagataaggagcaaaatatgtttagctgtgggaacaagataagcaccattattgcatgtgggtactttttcttcctctgtacttgtgccatgttcattcatatttgtacgtattcaatggtacctttcttga

SEQ ID NO: 92912 - DNA, 1226 bp, Homo sapiens
tcttgagggaccagactgagaccctgtaagaactgagtcacttctctctctggggctttcttttaattgcatctctggctgtctctgtgtgtcttgtctctggacctctgtcttcctctccctcccattggtttgttctgcaactctcctctgtgcacctccctcacaatcctaacttaattggctgtacttctgtgtgtgtgcactatgctctcctgtctctccttgtgaaaagtgtacaggtaagtgagtgtgtttctctccatcactgtctcaagtatgtgtacttccttattttttgctaatctttgttgctgtgtgtctttgcatgtgcaggcatttataagtcttactgtcctagtctgtaggtgtatgtgtataaggaagtgatcttatgttttctgtccctctggttcactgccagtatctgtgagtatgttatgtctttttattagcctgcctaagtggtttccaaagagcttatctgttctattcagacttttctattttcttatcagactataatgccccaaattggtttctctaggtctagaggctccataactttgtagctcccaggattcaccatctctcgacttcatcatgtcttaatttgattttttaaaacctttttattttgaaataattgtagatttacagaaatgttgcaaagatagtacaattttctgtatatccttcacccaattttccttaatgtagatatcttacgtaactaagatgcatttatcaaagctatacaattaccattggtacaatatcaactaaactacagaattctgaaatttttttaaccacattttcttagtttgattttttaaagaagaaaatctgattgcttagttggtaaaaaatttctatatttagctcaatcccaagaggatgggatggaaaattatatcgttgctaagccctttctgctagggcacttgtacagaaaaggatggtggagcaacagagcaaacacttcactgtgtctactgtcttagcagtaattcacaatgaagctcatctggagtatttcttcctgcatttcccacaaatgggaacagttttagagtatgattacaaattcacaaaagcaagtttgttctgttaaaggtttcatttaattaccaattaaaacacttttatattaagggactttagcattttgacagatgctcatatgaaccaggtaaaatatctgcttttatgtgtaagaaaat

SEQ ID NO: 92913 - DNA, 1106 bp, Homo sapiens
aaaattagccgggcatagtgatgtgtgcctgtaatcccggctactgaggaggctgaggcaggaggatagcttgagcccaggagtccgaggttacagtgagcaatgattgtgccaatagaatgtcataaaaattagatgaattaataatatatgtgtaaatagagggatgattcatttattaggttgataggccaaggtggtacaatgaaaaggttggaaaggtgtcacaacaatttttaccattttctttttagtggcaacaatttgattcctgaaatgtactattttttttgctaataatggcagttcaatttttccttacatatataactttttttttaagttgttgctttgcacgggaagaaaattagagttgaattttaacattttattttaaagtgagtctcattcataaatctttttgcattacatggtaggagtcagctttttcctttttcttttaatgaatgtgatttcttcaacatctgtttctttaggtgggaagagtgcagtactcacagctctcatagtcggtcttggtggaagagcagttgctactaatagaggatcctctttaaaaggttttgtgaaagatggacagaagtaagtgtttgctttctaccatctattttcaattctttagtaagaaaacagttactttagattcccagttcacatagacatgactggaaatgaagtgccttcccagaacaggagcagaggtgtcctattttttcattcctttcttttaccccttgttgctggcatggctcactgttgcctgttaccctctcaagacagatagcttgtgtaacctattgccctgtgcctggccatcttgcttctgttacttgctgaaagaaatggctgtgataaatctatgtaccctgtttaacaagtgtttataaaccttgctaattcctgactattgacccaaacccagcatcagtgagtccacattgatacgatagtagggagagcaaaatcagtgaccagccaaagtgtccctgcacaaaacttctgtctttagctctctaagaagtcccaaaataagaattctactttttgactctgattttataccctttaaccaagtaggttgccag

SEQ ID NO: 92914 - DNA, 1149 bp, Homo sapiens
taagaacatgtactctgctctctgaattgaaatagtgaatgtcagatagtgaattcagtgttgaatgcatggctggatcgtcatctttcagaggtattctaaataaagtatataggaagttttactatgccaattggatagcagttctcaacaaaggggattcttctctctcccttttgcgccccccagggacatttagcaatgtctggacatatttttggttgtcacaacttaggggcaggtgtgtgttgccggcatctagtgggtagaggctggggatgccactaaacattctgcaatgcacaagacaaaccccctccactaacaaaaaattatcagacccaaagtgtcattgccaatattaagaaacctggtgatatacttttaaatcctttaaagattttagaatgagtactgactcatagaaggttcccatttaatttcatcttattcattgaagttaccattattcactttctgtaaattttttcattggtgatggtgctagtctttctgatgccaacaatgcttgaatggttataatgagtgaattagattgaccattttctcccattgttttttattaatagactgcagcagaagttggaataattgagagtattcacctaaaaaacttcatgtgtcattcaatgcttggaccttttaagtttggttctaatgtcaactttgttgttggcaacaatggaagtaagtgttttttcccttctcgtttgactttgagcagtactttgagattagagtacgttaactttttgaaataggtgactattagtgctaataagtattttttctatagatgtataacttgtggttatgaatattcttggtatttgctgccagtgtacacttaaagaaaatactgagttaactctaggtacattacttaagcaatagggataaacatttcctgcttatgtttttaatctatttatcttggaatctgtaccatagaagggtagacaagcgatcctcattgcaattgaggcagccttgtgtcttgccttactaaacattgtaagagcacaaatgaagtgacttggcaatccaaacataaaagtagttctcaccaggtggccaataaatgctttaagaggaggtggtatttgtgccagttcttgaatgaaaatt

SEQ ID NO: 92915 - DNA, 1106 bp, Homo sapiens
aatttcaggagtcaccatgccatctctatgaatagatttagaaaactagaaaccacaatttcacaaaatcttttaccttttgtgagtttagtagtcacaacatttaggtaggcttatactgataaaatcttggctatgaatacctctgaagtaaaatcaactagtatagaatatgcagatgttaaagcaatacaaacttactatcttacgcttctgtggattagaagtccaacacagatctcactgggctaaaatccagatgtcagtagggctatgttctgttttagggcctctaggggaaaatctatttccttgccttttccagcattttttgactcatgtccctcttccttagtgcaagatgcaagactaatttactttaatttttaaggtaaaaatggatggacatagtacctaaagtttaattagccttgttagatttattttgttgagtttaatatatatggaacttgatttacctcattgttactataaatatttgttcagacctgatggccaaaagaaaggaagaaaatttttcctctcctaaaaatgccaaaaggccaagacaagaagaattggaggattttgataaagatggtgacgaagacgaatgtaaaggtactactttggtaagcgaaaaattacaaaattatgctttttgatatgtttttcttgtaacattcatcatatcacattctgtgataacttaaaatcaagaaaaagtaatatgattttttaaaagttgaggtaaaatctgttctgggtaattttgaagcttatgttaattattagaaaaattaatagagaaaataaagaactgaatgtatagaaatgtgaataaaattgacaaacttttagtaagaccaagaaatgcaaaaagagaaaagacacaaattaccaatatcgggaataaaataagggctatccacagaccctgcagacatccaaagggtaaggaaatacagttagcaactctacacacataaatttgacaacttaggtgaagtggaccaatcctcaaaaaggaaaaattaccacaagtcacccagtacgaaatagatcatctgaatagccctataactactaaggagatttaattcata

SEQ ID NO: 92916 - DNA, 1024 bp, Homo sapiens
ttttataaagcacacccaaagttttgattgactttaatagtaacattagagaatcttttttttttttttttttttttttgagacagctgttcactcttgttgtccaggctggagggcagtgacatgatttcggctcactgcaacctctgcctctcaggttcaagtgattctcctgcctcaacctcctgagtagctgggattacaggcatgcgccaccaagcccagctaatttttttttgtatttttagtagagatggggtttcaccatgttggccaggctggtctcgaactcctgacctcaggtgatccgcctgccttggccttccaaagtactgagattgcaggcatgagccacccgcccagccaataatagaatcttttttttaagtttaatgaaggatagacgagatgaaggacagattaatagccaatttcactctctatgaataattaactgtcaaacttcagtttatgccagtaggaacctgggcgttaaagaggtttaactgggttttgacaaacctggatttggatctgagctctgctatgttagagctatagaagcctttgtatgttagaactaagttgtagctacataaattcaagtcatttacttgtgcctcagtctctccttttgtaaaaataagggcaatatttatctcataaagatgttggggatcaaaggaaatagaaagtgttcatctcaaaagctaagtatgtagttattcagcagatgttaattctactcacccatttgtactcaccaattctactaattcagtcttttaaatctcttgttttatctcttccctttgtccctgatattaccactgcttttgtttagcaactcatctcttctgctactattcttactttctgtttcatctatcttctatattgagccacaggatgttttcagtacagaaatctaagtgttcagattttattaactgaaatgctgtgctttatacttcccggttttgctgatcctgaaattttagatgggtggacttaatgaataagt

SEQ ID NO: 92917 - DNA, 1009 bp, Homo sapiens
caaccgccaggcccaggagcaccaggaagcgtttcgaatccagcgccgggcccgcgcggccccgcctcttccgggaagtgactgacccctttcccccaatggggcccgctcggctttcccttgccggctcccagccggcctagcggacgcatgcgtagaccagctgccgggggcgctcaattatctttcccttttacttaggcaaatcactcacctcccccgagtccggtcactgcggagccgcccgtgcctaccagcttcccccacccgctaaggggcacttccggcctctcagactccggcggcgcgaaaccccgcaactgcgcaggcgcgggcggagcccgaagggagggagggcggggcgcaggcgcggttagtaccgcggtgggcgccggggctcccgggaatctaccttctcctgcggccggcacgcggttcccagggggccagcggcggtcagccgaggtcgagacgcccgcagggtggccttagcggccggtcgtaccacggcagccccgccgatcaggttcctttgggagacttcgacttgttggcggtagggtgaaggcgcgcgctgtcgctttcccttgctccggggttcatcctccgcccgctgcccccttggctggcgacccccagccacccgggagaggcagggtcagctgagctgcggcggtgttcatggtcgtccttgcgggcccgggcgggagatgtccgttcctcgggcgggtcgggcggccggcggcaccttcgcgcgctctccgaggcggcaccggtctcctgagccgcgggaaacctggcgtctgctccgggccgtcccctcccaggcggccgtcccctcccaggcggccgtccccagactctcccgggctgtggcgaataactgtaaagcggggagaggtctggggaaagctggggtagggagtggctcttagcatgagtctgatgatatctcgcaggcggcaactggtgtgtttaaagggtgtatgcaaagatcactgaaatcgga

SEQ ID NO: 92918 - DNA, 1296 bp, Homo sapiens
gctcaaagccatcccgggagagccctccctggtccccataggcacagttgggtgttcccttttccgtgttaaccttgtatttcggatatagttctgttatagtaattactttaaggtattgtagttatttacaatcagtctttcccccacggtaacctagagtgtaaaccccctaaataaacgtcagaagtaatgaagtcttaacttccttggcttaggtttcagcgcccttctcaaccccacactcccgcttcagtctttacacaacccttcccatgaatatgctgacctaacaagtaacctacttttcatactccaaaatcttctcttctgtgtggggaaaataatgcattgactgccacctcactccacctccaaataaattgatgttgaaattctggcctccggtaatggaattctttacatcaaagtcactttttatttctaaaagtaatcacatatatattatattcctactgtggcccttgccatggatcaacgaaaaatatgacatagtcaaaatagaccaaaacatctggccttgttgtaaccaatgggaaacacggttgggaggtccctacttacatgtcacttgcttcaggaaccgttccttgattcctaagtgggggaccttttttcctaaatacaactatagcttgctttcttacctcttaagccctttttatctgcagtctcacttaccctactaaggtctttaaatgcagggcttgatcttccattattgtatctccagcacctataaagctttcctgttaaatagtagacatttaataagtatttattgataaacgtgaagtatgcctcaacgtttaggctaaattcatatgaaaataaaattgaaaaaataattttaaagaacagcattagttactgagattatgtggtaaatcccttaaaatataatcttgcattgaaatagttttcaccatttaccagtctttatatgaatatatactcatctaaatggaaattgggaaatttaagcattttctgcttttccgaagtaaattttctaatgtttttcttaaagctgaactaaattgcaaaacttgctttaataaagtgtgtatttttgcatcagttaagcccctgacctctttatgttctttaaatttgattcattagtgaaattaacaaggttctgtgtttttctcacctcattcagttttataattaaccaataaaagcttattagcttttaaggaagttttaggaacttaaattgatttatgggcaccatatggttacatcaaaggacttgtttttgttttaact

SEQ ID NO: 92919 - DNA, 1041 bp, Homo sapiens
gatagagaattagtcccattctctaagtatgtaaatcaaggagtgaattttcaagtagacaaaaatgatttacagcatccttgcattcgctaccgatctctgcttttgttagctcttgtttttagctgggaaaaagccaattaccgccattttaacgtttcaggtgttcttaattcattttgaaacgctgactgatgaaaaaaataaggaatatcctctatgaattatcctgaactggcttataatatattgtttgaattcctgttatgagcttctgtttctttaacaatattttgtaaagtgtgtttcacataacagcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggtatagtaaaagctcttacagtataaatgtatgatgtataaacagtcttggtatcttgattttgtttcacctttttttttcttttgttgttgttattcttttacattttgaggttttaagatctatttaacatgtctagattcaccatctttatattaaggactcacattcgtacctcttaccctttgagctccagactcacatagctatctcctacttaacgtatccactaggatgcttcagatactaaaagccggagatttgggagacattttctccctattttacttctctccacatctaatccgtcagtaagtcttgccagttctacctccaaaatatactttgtgttcacaaacttatctcagtgtccagaggcaccacctcagtctatgccaacctcatctctcatctatactcctgaagtgccatcttcactagtttcttgctcttggcctcccctaccccagactattttccacatagcaattagaataatcataaatctttcttgcttaaaaatattcagtggtttggccgcgtgcag

SEQ ID NO: 92920 - DNA, 1065 bp, Homo sapiens
ggctgagatgggcggattatttgagctcaggagttcaagaccagcctgggcaacatggtgaaaccccatctctacaaaaaatacagaaaattagccgggcatggtggcacacacctgtagtcccagctgcttggggactgaggcaggaagatcacttgagccaggagattgaggctgcactgagacaagatcatgccactgcactccagcctgggtgacagagtgagactctgtcaaagaaaaagaaaattcagtggttttccactctaattaaagcttaagtaaaatgttattacattaacgtttttgatactagtctaatgttcttgcctttgtgttatactattttgacttttactatcagtgtttgatgattaatgtattactaatttatatatttcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagaggtgagcattcagatttgattcagtaattccgatttgaattaaagggtgcattttactcttaatagtttgtcatctttaatacttattaattttattgtgactagcagggatgtgcctagagaaaagagtttattttttagagtgaaattgacctgagtttcattcttggcactggtatgtagaaactctgagacactgagcaaaatttgtaacctatctctaccttgtatgttaccttgtgaaatgacaacagtaatactcagcagggatgtgataaaaataagagaaagtatatctaaagcaactagtacatggtaggaacttgatcatattaccttttataacaccttcaggacttaaagaagtcccagaatacatgagatctcattaattcgtacttcactcattcagaattcatgatagttcatatacagaatatatatttggcttcccttagggcttgtaattttaaaaa

SEQ ID NO: 92921 - DNA, 2714 bp, Homo sapiens
gattaatttctgctaatgcagatgtcagagaagcagtgtcggtgcactcacaagaacattggatgttaggaggcttgtctttgtaatatttagtgtgcaacaacaaagatatttaatatgcatttgtcttttaatagtaatgttaaacatttcatctatttttagtctccctttgggtaatggctatcatcatgtcctttacctacttacctcttgaggttttaatttttcttttgtgcaagttctttatgtattaaggatataagcttctatcatatttgctttgaatttgtttttctttttaattttagttaaaaaattatgccatttttctcctcttctgaaattttattttctactcacttttaaaaatagttttcaattagtgaatattccaccctaatgactatcagcagttgaagaaaatatctgtgctaagttctaattacttcttgtataatcaattcctggaaatattcatggtcctcaatcttagagtgttaaagaaccagcataaaacaaaaaaagagatgtccatctcttcttaagaaaattgctccattcctgtttctttattgctgcagtaattatggtgttcttaggcattttgtgtcagttcagtattgcctgttagtcatttttatatttctgtactcttcagttactaggccctgcttcctcctaatccactgctatcttttaggtattcgcatgaaaagcacaaattagtagtcctccaataccacctccaccccacatggtagagacatagagtgggaaaaattgcaacagccttataggaaattctgtgctggttctttgaaaaaatttgaagtggcaaatagtacaagaagttgaaataactgtattatgaaaggctattttttacctaggggtaaggtcgaagcaacactgtcacaaaactgtctctctaaaatcacggggccagcgtcctgaaaagtgatatttttcaacatagtactttgactttttgaaccttgtctgccttgggcaacatctgacagtggtagttattatgtaatgtggcgtggaagtgattaatcaaagcaagaaatggtatttattctgtcagtctctagaaactacaagtaagtagccttttctccccaccatactcagtagtccctgatagagaatgatacatgacaaaaaagaatggcgtattacaagaaagaatgaactaggctataaggccagactacaagctacccagcggggttaaattcataaaccagaggaaagtcacagcaaattatttgtgcatcagcaaaatgatgtaatcattctgcacaaacatttgatttcctaggaggacactgacagctgacttctccgcagtttcccacaatacgagagtttcattgtacagggaaggcaagatgagaaaaaaatgcaaacattaaaattcaagccaaaactgtatgatagcatcttctttggaagtacgcgtattgggttgaccatcatgtgagaaaaattattgaagtcttctagatgtaaatcttaatatgattaattattatttaaagatattttcagaatctgactataatagcaatgaaatgtgaatatggattactttgtaattaacattaaaatcttaattttttattacagaaaatttaaatcaacacaaaagtaacccatcactaatcttaaaccattatcttggctcatcttgtttcatctattcccctatccacacatcattttgaagcaaatcgtagacataatattgtatcattccctgtatttcatgttttctaaaagatgattcctaaaaaataaaaagaaacataaccacaatataatttttattagcacacgtaaaagtttggcagttcattccttaaagccctcaaatattcagtcattgttcaaatttccaagtgtttcttaaatatcgtaatttttaaaacaccaaaatagctactattaatatttgtaatacagaaataggtttaatagtaaataaatgagcagtgaaaacattctttaacatcttgcacctgctttttgttttcagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggtgtttattttctttctctttttcagcatttgtttacgaactaccttttttaaagggctgattaaatgaaatagtagatataaaatgcttactgtaatgccttgcacgtagcaattgctaattaaaatgcttactgttattaaaaatcattgccacatagttcattctcttcaaaatgtggatttatctcataagaacttgacttgtttgtttcacatggtttgattctaaatcattttcaaaaatacatcacgaattgcatatgaaaatgtgttgctttgatcctgaatttccagtttagtgtttcatcctcagaaatacctccaaatatgcaaagagagagatataaagatgttcaatgtagcattgttaataattacaaaaatttggcaagcagcccgagtgctcattgatagggacatggttaaatccttcacacttactggttcccagttggagagatactgctgggagacattttggttgcaac

SEQ ID NO: 92922 - DNA, 1536 bp, Homo sapiens
tgccaaccaaactaaaccttctgccagacatttctgctatccctcccgaaatgctaatattagcacccccattgagaaacactgtttcagagtccatatgatgtaatacagtgcagtcattgaaaaggctattattgacataaaagatatccagacatattaatggtggaaaatttctcaaaatagtatttttatataatcctacttttacttaaaaaacgtaattaacaataaatattcatatatatgtatcaaaggagatggttttttggaagaatatgcaccaagctattaatgatagctcaggcagtgcagttacggggaatgtttactttctataatatatatatatatatatgttacagtgttttattttgtaagatggaaatctacattttttagacaccagaaagcaataaaatggaaaaaattggctagcatagttatttttaagccatttttgaaactacaactttattttcatatattgaaatgtcagattctataaagattctgctgatcaggataattttcttatataaagtttttggaataattaaactttttttctttttttgagacgtagtctcactgtgtcacccaatctgaaatgcagtggtgtgatctcagctcactgcaacctcctcctcctggcttcaagtaattcttgtgcctcagcctcccaagtaactgggactacaggcacatgccaccacgcctggctaatttttttgtatttttagtagagatggggtttcaccatgttggccaggctggtctcaaactcctgacctcaagtgatacacccaccttggcctctcagagtgctgggattacaggcatgagccaccatgcccagcctggaataattaaacatttaaagataacattgacaaattatttttgtaatgtggtttaatgtataaatatgtactttttgaggattaaactaaatctgttctttctttaggacccacatgttgactgttacacaatgtcatctatcaagagtaaactaggtttggatagagatgctctggttggattagcaatacttcttggctgtgattatctcccaaaggtaagctgaaattgtcatatttatttgctattcataaagtctttttcgtactttatgtgctgtataaatatgaatataatatggctatatgattaaaaatcgaatttaaaatataatttcaggcataataagctattcagtgactaaaataatcggcatttcagatggcactaaaaagctgacttgtgacacttaatattataagcaagaatagaataatgtagtaccacagcttgaatctcagtaaactgttactctagattaagagattcacatttatgtttgactatctttttaaataaatataggagttattcttttcttgtattatgccattgtttctttcactcttttttctgttttttagttttcagtattctttgtgcacatgctcaatgctattactgttgctaagtcacgtgatcattgggataagccattcatatttccatgcc

SEQ ID NO: 92923 - DNA, 1075 bp, Homo sapiens
gttctctgtttatgtctgggttttggaatattaaatgttcatgtaattaaatgaacttgctttttcctgattacaaacataaagttaggttaaattaaaatattatccaaataattaacatagtaaatgaaagccctctaaaattatgaccctcccttccctaaaataaacaccatcagtggtttggtatataactcgctgaaatttttgtttacatagataacagtgtaattgtcatttactttacaaatcctgatcatatacactattgtgaagtttttgttttatgcatagcagtgtatcttgcatatcttttcctatctttattgaagagttacctcattctttcagctgctgactcttccgttcaattaatatacttttaaccattcctagtgattaacattggaattattttttttcccactttctgaaagggagtccctggagttggaaaagagcaagcattaaaacttatacagattttgaaagggcaaagtttacttcagaggtaactaataattactttctcttgtgacattgaacctttattcttgctgaacttaataacgaatagtacaggaaacaattgttttccaaaaaagggttttgtatttttaaactgacctatattttgtttgatttaagataatttatttttatttattttgaaattttccaaaggaaggatgagaatacatgttccaagccgtattgcatttttttttctttttttggagacaaggtctcactgtgtcgcctaggctgcagtgcagtggcgcaatcactgctcactgcaatctcaacctgccggagtcaagtgatcctcctacttcagcctcctgagtaactgggacaacagatatgcaccactgtgcccagccaccatactacatttaaaatatacatattatttatattaaacatgttaatatattaatttttaatttttttttttgtagagatagggtctccctatgttgcccaggttggtcttgaactcctgggctcaagtgatccccctgccttggtttcccaaagtgttaggattacaggcatgagccacggtgcccag

SEQ ID NO: 92924 - DNA, 1069 bp, Homo sapiens
ccatgggcattttgccactagctattttaaacccttttaccaaaaggtaaagataaacatgacattaaaataattttgtatttaatactttgatattgtattttctttctataaatgaaatgtctgtggcgtgttgtaaatatttaataataagcaacattaattgaaatcttactcgactggcctttgctttatagctacatatttaataataacattaattcgtttagtctctatagttggaggattcagaacaagatgcagattatatagaagttaacaaactatgctatttactatctcaaaaacacatgaattatatttgctgatgaaagcaatgttttataaaaattaatattaatgatgataggtatagaatcaataagaaaggaactaggacactgggaaacttaaaacagtcttggcctccagcaggttcgagatggcaagtgcctgaaaaaaatgttaagaggtaaaaatgaaaaaggaatgaccataaaaaatacatcaaatcactgtattctttcctatgatacttctcttttagctgtaaaactgttgataaatgtaagacttcagtaaatccattattgacatcagttattactgtgcccaagcaagaaaggaaaggtataatttggcctgggtgtgagttaaggaatcatttgggaattgtaaaaaataatataaagaaggaaaagcaagtgaatataacacctggctaactccaaaccattcttattgaaacagtttcagcaaataagcactgttgacacttgaaaataataaaattacatttattttataattatctattattctgttttatatactgacttttcctctcagttatttttaatttttgccgtgctattctttatctggaagcaattaatgctaatttttaacaggcttgtacttggtctttgtagtaaatgaattagaaattccagaagctaaatagtaactcttaagtaccagatactgcacaatgacctgaagagataatttagcttttataaaaacttcaacttgtttaagtagaggaacataattcagaacacatacg

SEQ ID NO: 92925 - DNA, 1032 bp, Homo sapiens
actgaatgcagccaagcactgccttttggtaaaaatgtggacacagtaacactagtagggggcagtgtgagggtgggagatgtgttttcagaagaaggaaactctagattagcatcacacaagggatcctaacgtggcatttgagctactggaaaaaaattgtgcttgcttaaatataatgtggtaactaatattcatctaatcacctaccacatttttggagcacccactttgagcaaggttcttaggcttttctatgtacaacagccagctggaggcccagtgagtttaaaatttttccaggtcacccaactagaaaaagttaaagctgggactagaactcagatctcctaattcatgagtgaaaacaattctctgtatttatgtttccatacatcattcagttcttgactcaaatatcacctcagagagtcctaatctttttatctcctgacattataaatgttgagttcagggttttttttttcattgtttcccaaactagaatgcagacttgatgagggcagggactaagtcctttctgttcacagaattctagaacagtgtttgacacagtaactactagatgcatgaatgacaattctccacaacgccccacccatggagcctgtaccagcagtggctgcacttaaccttgcggaatctggccttagtacttcagcatggctcacaaggctgaggcagcctggccccaacttgtctcttcagcttcatgcattcatagtcatgaaccttggctctagccacctaagaccatttgttattccctgcacggatgtctctgcctgaaatgcttgctgcttccttattggctagataaacctcatctattaaggaccagctcacatgtcataactttataatcccaagcagaattatttgctctatacgtgtccccaaagaaattacccatacattcatcagagtatttatcacattcattcattcgttccacaaatattagctgatgcctgccgtgtaggaggcacaatattccttacttaaaaatgc

SEQ ID NO: 92926 - DNA, 1062 bp, Homo sapiens
accaccactccttcacacttgcctctcaccctgtattattttctttacaacttattagatttttttctttgtctcctatcactagagtaacataacaagagaataaactttgctttactctttgttgtattcccagagctttgaacagtgcctaatatgcagtatgcatttaatacatacttgttcaatgaataaatcaagttagcttttcaacccaaatctatgtaaagacaaagcccaggctttgaccacgaacatgctgcaattttttattgaattcttaagatggattcagtcctgggacaggcatactgccaagtacatgggaaaacatctgcttcctcccttcaagatgtttataagttagttgtgatgccagactcatttattcttgagataacaaatacagtaagtgctgagtgaagggaaatgtatcagagggcaccagaatgtagaagagagtggtcagtgaagatacaggtggtccttatagggcctcctagagctgagaaacttgataggagccttttgtggtggatgccagttagggggagggtaagactgtcaggtcttggatgagacttagagaatcagtgagtttatccaggaaagagtcatcaatgacatgtgttttagggcattccagagagggacatttgctagatacttttttctggaaaaaagcctcactctttacttacaagtatagttttatgagaaaacgcgggcaagagaagaggaaaggaggaaagagaaagcaaggcagtgaggtttcttctttctcactctggccatggttgtggtaggggcaagatggatcgagactggcacacagtgagtgccagataattattggcccacttactcttgaaggtctcctctgtgggactttcctggaattccacgctctctccagaaataaatggccaactgtgggacctaggaggctacctctttagggccagcagtaaggcaaagctgccatgcagcataatctgcccaagtgattggactgcacagacccttggccattggaagagactgcaccatcccagagtttcc

SEQ ID NO: 92927 - DNA, 1067 bp, Homo sapiens
ttgatgtctccccccggttttgtctggggagaccgagccgaaagcttcactcgggtggcccgcagcaggggcagaggacagcaaagagctacctccacctgccaaaatgacccaggggccctggtttggtgccaaggcgtgaagtggggggaggggcggtaggtgttccttacgttcctgccggagagtagctttgtggttggcccggagccttcgttcgggttttttgtctttcaccctaccctctgaaaatactggagcagatgagtacaaacagttcagaagcctttcctgtttctttccctgtatttactcaagcgatttgcgtaaccattcacttggaactgtgtaagtcactcctagttgccccccttcttagactatttgcaaatacctgcccaggtaaacaggaagcacgcacctatctcttagctgaaggcatatgccctcgtgctttgtcttccctgcatatctggagccgaagaggtggctttgattctctagctgaacttggtgtaatgtgcaggctccacttcttacctgggtggtgaccttcttgaggagattgactcgttcagtatgcatttccaaccagcccgccatgggccaggccccaggatgcactcggggacagacagcaaatggatgatataatttctgcacccagtctagtctgttctttctttctcaccagcttcccttcttctcttgttctaatattatgtttgtcgtttctgaactaggaattgtcaatattgggatccggagaaggtcatatgaaggtgccatagaactctgaatccaaagcatgttgtgaatatactaaggagacttgcgggatcagtattaattgaatcttttgtctgacccataattgcctgaatagagccattgatgaatgcagctacgctaaggttttgctggtcaagtgtatgagggcaaattgggaggtcagaagcagtctttgttctgttctgaaatattataatattaaaaatccaaagctctggagcttgagtttgccagcaaagcaccaactgagtatcatcatcttcttttaagaagga

SEQ ID NO: 92928 - DNA, 1059 bp, Homo sapiens
ccagcattatagagggcagtctgctttactcaaagtctaccaatttatatgccagtctcttccaaaataccctcacagaaacactgagaataatgtttgaccaaatgtctgggcaccctgtgacccagccaagttaacacataaaattagccatcacatcacatttaacagaatatactggcctaaacatcaataatgaccgtcacagataacctgatggggcattaaagaaggatagagtatccagtgatcaatttgtagttgtagggaatgagagtataaatagggccatagagcctgggcaacagagcgagactccatgtcaaaaaaacaaatacaaacaaacaaacagggccatagaacggaaagttattccaaaaatcagtcaagtcatttgctgcctctggactttaggaatgctggcttaaatcctgacaaataattagtgtatagagataaaagaatgccagcagactaaatttggggcttcaacatgcttatatattttttacttttattctgctatgcactggattggctttcctaagtcctgatggacatgccatggtgaaccgaaaagcatttcctatgatttacttgagataaaaatgtaactggccaaagagatgggagaacttcatggttgaatactgttgtttgtagatttggattgagtggagatgttgtagcaaaggcatttcattattcttgtctttgagttcagacaaaacacttcttggaagtattttttttgtgggtttttaagatctgagttttctaagtatggtaccttcgtgaggccactgatgtaagaccccagtcttcccttggtgctcagatgttacgaagatgagattcagccctgaggctcaggcttgagcttccatgacagagcttgtctcctctgggatgaaagggtaaaaagaaaggaaagtaccatgtatggcagtgttcatctgggtgtccccatccatccgtccgtccatccatccatccatccatccatccatccatcccattcttccaccacccatttaaatgtccatccatccatccatc

SEQ ID NO: 92929 - DNA, 1003 bp, Homo sapiens
aagtgcggtattagggtgggagtgacctgattttccaggtgccatctgtcaccccttaccttagctaggaaagggaattccctgaccctttgttcttcccaggtgaggcaatgccttgccctgcttcggctcacactcggtaggctgcacccactgtcctgcccccactgtctgacgagccccagtgagatgaacccggtacctcagttggaaatgcagaaatcactcgtcttctgcgttgctcatgctgggagctgtagaccggagctgttcctattcagccatcttggaactgccccacctcgggttattgacattttagataggctaactgaggatgttcttgttgagaagatatcatttgagtgaagacttgagggaagtgagagggcaagccatgcagaagaaagagcattccaggcagagggttcagccactgcagaggccctgaattaggatatggctcacttggcatgataagcattagcaaggagaccaggatgacagatgggaatgatagagggtgagaggagtaggaggtaagatcagacaaatgaagttaggggagggtggatggtgggcactttgactctgagtaggatggaagccactggagggttgaacataggagggacatgatgtgatgcacattttaacaggatctctagctaaaggattcttaatccttccttttgccatgaacccctttgggagtctgagaaaccctatggaccccttttcagaatagcgtgtttaaacacaaaagatgaaacctacaggatgtaaaggaatccagttatgttgaaatgcaattaccaaaatagtaaaagcaatttatgagttagcaatatatttgcttattaattctttaaataaaatctagcagtaggtctataactactgtgattccaaagtaataatgagtataaatgatattttgagatctcttcaataactctgataggatatgaagctattcatacttctattggtgtgaagtcat

SEQ ID NO: 92930 - DNA, 1056 bp, Homo sapiens
ttgtagatgcatttcattgaaagaagggcattatcagatataggtaactctttgactcatcactcctcttaatgtttctatggcttcggagatggatataactaaacagggtttatggccacttttaaatctggaggtttattacatgcatgtgtgttaccccctgctcattaaaaaaaaatcttttctccaaaatgcatttttgatattggaataagtatagttttgaggcacagcaatagaatttgggatcttgttttatcaaagattttctaattagtggtgaagtaactgaagactccttatgtaataatagtaacagtagtagtaatagtaacaagaacagcaataatcatatgataatacgctaactgtgtaattgcatttatttattacaacatcccttgaagcaaaagtttgatactattcccattttaagatgaggaaactaaggtttgcagggaaggtggcttgcggaagttcaagagtcagtagtggggttgggctctggacccaggaggctgactccagggcctgtgcttttcactggcccctgctctgccgtgttagggagtggatttaaggaaacatcagaacacagtgcatctgaagggacaaagagccacaaacactgtcagactttgactttttaaggatgtgagctgaaaggggaaaatgctggcttatgtatcttccctttcctaatccagacatcagatacacttatttacagagacagttttctagaatgcccctcgaagctggaataggctctgagggtctgtccctgaggacactgcatggcagacacagcagaaactgtggctctgtaagagcctagaaatgccttcactggtgagaccaagtagagtaaggggagctttgacagttggacctgtgtaggaactgagtttctgcctgtgtctcatattaattgctggagagcggcttgctgtgtggcatgagtggtggtggtggcttccctctgggcttggccggctgcaaacccttcccccagccccttctcagcccggtccctgccatactcttcagtta

SEQ ID NO: 92931 - DNA, 1046 bp, Homo sapiens
aacccatgaaagcacaggaaatggctttgtgtagtaggtgtttgagtctaggcattctgttgacagaagtgggttctacccaggggttttgtgttaatgtaatcaaacacttcagagctgcagcctaacaagatcaagtccacccacctcagagtttatctttagctcatctggaagagtttattttaaacattgaacattgtttgctgctgttgaaatgaaagtgagagagttacaagctttcttccactgccatctggcaggtttactgatggatcgggttctttaatccatgtaaccctgtgtgtgggagctattgtctttgtgttgatcatgcagctggcttggctgaactttaaaaagcttacataaagctatcaaaagccatcctatagataaatgaagttgaggatgttgcaaaagtcactgaggcctttttggagaaggcttggatatatatttttcattcttcactgaacacatattttgcatgttctctttatgaactggaaaagaggaagataactgtatttggatattttgaaagaaataactgaagctaccaaaaaaaatgattattcttaattaagaaaagtattgtagcatagtagaaaggaaagaaacagcagattagggcgtccatatttcattaaagtaaatgtgggatgtaaaaagtcacatgtgtgtgctcttttctcggtggaggtttgtctggctttttcttcagcctacatatggcatagggatgttcaatgatacacttattacatacttaataattagctatagcatccttaggtatagtactacacagaatctcatgtagtatgctactaagtataataatttacaaccaactccagggcacagtttcaaccgtattctcaaatgcatacatacatctgcattaagagactgcatgcaaagagtagactatgtgtaagatagggtatcttgcaaaaatttttatattacatttgtaggaacataagacaaatggaacatgaaatatcttggatatggtcaattggtattcagttttcttt

SEQ ID NO: 92932 - DNA, 1046 bp, Homo sapiens; identical to SEQ ID NO: 92931

SEQ ID NO: 92933 - DNA, 1050 bp, Homo sapiens
cttggagactcattttcactttttcacaaaatcctattgtttcagtgagacaaatgacaaaagcagtaatacaaaagcaataatctgtccaaagaaacacagagaaaagaacatattattttatactgttttgcttatattgttttgctttttttttaacaaaaggaaacatggtattatcttgcagtttatgactaacatagtataatactcatttgctttttatgaagtgccacagaaatttctaacataaattgaagaaaatgtggatgttttgacaccaaaattttgtgtgtgtgtgtgtatttctgagctggcacagccatgtgcagcatttggtggtggttcttttcataggatgagctgttagccagcttcacagaaccttggatatcatgtagcctagttcctcctcttggtgctcccatctctcaacactgtttgctttcagttcgttcatgcaagttcaatgaaatcaccttaacttagattcttcttttgcatgttcatgatatcataataattattttaaaaaaccccaattgccctgtttttcttagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaagggtaggctaattttaattagtggatgccattctatcttattagaagcttggatttctagatgtacaatgtttaatgtaggaattaaagcactgaattttgaagcaattcacattaacattataccctattttatttatttttacaagtgtattcatgctttattttgtcattgtaagaaaggttttttcttgaaataacttttttaaatgaaagtatttgatgttcatctcagaagttttattctttagg

SEQ ID NO: 92934 - DNA, 1058 bp, Homo sapiens
ctgtccaactagtcccaatgagatgaacctggtacctcagttggaaatgcggaaatcacccaccttctgcgtcaatcttgctgggagctgcagaccagagctgttcctattcgtccatcttgccagccaaggccaactttttttttttttttttttttagatggagtctcgctctgttgccctggctagagtgcagtggcataatctcagctcactgcacgctccacgaggtcaacttttttagatctcacatatgagtgagaacatgtgatatttgtcagaaacatctattttagaaatcacttatgtatctgtgtttctaaagatttgtagttttcttcttgctggctctaaaggtttatttttcagtttattcctagttttgttgtcattaatgaggttgtaaattttttttctaattggttattagttatatataaaaattatttttatgtttattttataactgaccttcatttagttttaactaatatgtgacataaattatacactgtttaaaatagctgtatcatattcaatttatacaccatttctagacttaaaagaacaattagatctttaacttgagatgcttcacctactaggtgaagatctctatatgcctcattttttttttttttgtcagtggtaagacgatctgaaacaatgtatgacctgtaaattattacccttgaacctatcatgctttggatatgaaattagaggatattgtttattgtaactgagtgattacattttatatacattttttctactacactttgttgtaaatacttgaccccagaaccagtttataggattctgattgtaaaacacatgaatatattgtttaaactggttttatgaagtttttgatatactataacaaagtatttttaagattccaaggtctagagaagaaaaagatacaaattggttataaatctaatattaaatcttaatattaaatctaatattaagtctgctttttttattatactttaagttctggggtacatgtacagaacgtgcaggcttgttacataggtatacatgtg

SEQ ID NO: 92935 - DNA, 1035 bp, Homo sapiens
acctttacgtgtcaagaagctctatgtactgtcagccttacttatagagcaataccatgaacagatgaagaatgcccagcgaggaaaagttaaaggaaaaagttcagaggtaaagtagcacgttaaataacattacatcattggaagtgtttaagaaaaaaaaaaaaagaaactattaaacttcttttatggataggtcatttaatttgcatgtctgcatttgtttccttaaatgatatgaagaaaaagaatgactgatttagaattagtattcaaattcagaaatttctacctagaaatattgaaattgtttttctgtaatactaatctgtagtctttgctttaatgtcttatttgttaaaaaattttacttacctgggaaatcttcctttctaatcagtgagttttaaaactttcctagatatattgttgtaatgcgtaaatgaatgtctgattaacttagaatctaattagttatattttaaaatttattcataccagtttaacaaactatgaattataataaaaaattaaatctgttttgggtgcagtgctcacaccagtgatctcagtgactagggaggcttaggtgggaggatcacttgagtccatgagtttgagactgcagtgagctatgaccacgcagctgcattccagcttgggtgacagagtaatacctcatctcttaaaaaaaaaagtctgtaatcatagttttgtaatgataaaatctgctcatttagatactttaatgactgttgttatttgggagttgacactgtgtgtgcgtttgtgctgacggaaagtgtgggctgactttactcgtaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacaggtgggcatgtcacctaatgtgtatagtatgtctgaaaattataaattgagtat

SEQ ID NO: 92936 - DNA, 1039 bp, Homo sapiens
aaattaaactaaaagtacagcgttattatagaaactattgactattaatgtattcttttaatatttttcttattttttaaaaccccttttgctttataaaaataatttttaaatgtcaaatctgataggacattttcacaactgaaattgcatattttgttttactataacatataaacaagtgtatctttcttgcttgaagttttgtaagattagaattacaagattaatatgattataaactttgaaactttcattttcacatgtatttcttaagcaaatcagagtcttagagatcatttaatcattttgacttatgcttataggacttatgttgctgtgattttaaatgctatttttaaaacataccagtttttaattttgaaatagtgtttttactataaacttaaagctttcttgtgtgaattttatgatatatgtgactgtaaatacttgggtgactgaatggtgtaatttttctcctagtggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaaggtaatgtaaaaatcttggtgaatagttgatttgttccagtcacaatattttaatatatgaaagagcatattctccattttctttggaaacaaatatttattacagcaaaaccactctggttttattgcttctgtatacattattttagtattattgccttttaccaacaaagatgtttattaatattagcaacttactaatacctaaacaattgtatgttgaatactggagttaacaaagagttaaagaaattactgagactgcaaagtacaaatttctacaacagggaattaaattttgttgataatagagttttaagttcttttaaatgtacaagttttaaatattacgctttacataatatttatttggagggaagataattagt

SEQ ID NO: 92937 - DNA, 1039 bp, Homo sapiens
agctctgttttgggtctagcttcctgaactgattaatggcagacttctctaggacatttctttatagaggtatttgagggctctgtgaatgtgagatttcccttaagtctctagttaataattagcactgagtataccaccaattgatataaaggcttttttcacccactggtgggggatttgttttggagcttgacatttctgtatactagctactgaactgagataagaaaggagtgcagtgtcttcagggcctcgttaaaaatcagatccacagcctgagccagtgaagctctggatttatagaagtgatgccttagcatccattctcatttgtaccctctgcccttgcgtctgtttacaagaaaaatctgtaactaccagtaaatttaatactcatacgtccctacggagttttgttaaattaaaatataagtaatttccttggtctgtgaaatctgatagtattgttttgtttgtacaggaaatagcacaaatgtttgtcagagttggaatgtgtgaacaagcagtgactgcatttttgaaatgtagtcaaccaaaggcagcagtagatacctgcgtacatctcaaccaagtaggaactgaaactttctgtctgtgcagcttattgtcttaggaatttttaagtcaaagcaaggttaaagtcaccctagtgatcttttaaagattattgccaatgtaagggttggagagcctgacgtgaattttatgaaaggagccaggcgggtattctcttaattgaggatgaagaaagttgcacttacctcttaaagtgctaccatgaggggtgacccacttataaccagctcagtatgggagcatgaacaaaccttgtgcttttagtctggcaagtttttgtctggaagtaatttcataattttctgcattttgttagggttgggttttgtttccaaagaaggaccagttaatggttggtcattgcctgaggaaggaattgagttactttatcaatatttattttggcaaatctgttttccttttcctttatagaaaacat

SEQ ID NO: 92938 - DNA, 1039 bp, Homo sapiens
tattaattgagaaaattggactgaatattacatgctattagggaattaacattaattatgtaaggtgtgatcatagtaatgtggccatgtaagagaaaattcttatgttttaaagatatgtactgcagtatttagggataaaatatcatgatgtccgtaatttactgtatttactttacaatacttcagccaagaagttaaaggaagcatatttaccataatgctaattatttaggttatgggtatatgggtgttaatgacattctctcttttgtttacctgaaaactctgataataaaatttaaaagcatgatttgttaaaagagaggaaattttgcataatgaaacataactttttttttgtctttaaaggaacccattcagacctctggatatatttgtaattttgaggatttagaaattaaatctgttcttttggatgagatattaaaggtaattcctaaaaagttacatttctgttgctagcttgacaggggattatttctggaccaggcggtgtagtatcctggttagcagtgtggacccaggagtcagatatatctcaggcccagccctgctctcttattgttcagcctttaggtgggtgccaccatctttttgagcttcactttactttcctgtaaaatgatgataaaaatgtataagtctcagttattgcctttataaaatacagataataatactacttataggattgttattatataagataatgtgtgaaaagcaattagcacaatgctacggccaagtgagagctaaaaaaaatgagtgctaattgttgtcattgtttttgtagtaataacgaggtactgaagaaatatttaagagtttagcctttttctagttctaagatacttgagtaacttttttttagagatctatctttccattttttccaggttttgtaaaataatccttttttctctttttaaattcaagacatgattttgaacccctgcattggcctacattgaccatcctttgagaattttttttctctaagaatatactgagagaa

SEQ ID NO: 92939 - DNA, 1182 bp, Homo sapiens
aaagcttttgcaagtcttaggatctttgtgattcttcgaccctgagaaatagttcaaaggaaaggcattcagattcagggctgctgcatttgacctgtaagcatgggcttctttcaagggtccaagggaaatttaatccttgccacaaaacaattgtgggaatttgacaggtaatccacaggataaccttgaggatgggagtagaatactttttgaatgttagagtctttttctatccttagccctgctcatactaaatcacaaatcatatgcctggagaagggagaatgtttgttgtatctggctgctcataatgtgtctatagcacacatggtcagtctggtaccaagtgaaatctttgcctggtggaaagagtttcttaagtagttttaacagaacagccttttaaaaacatactgttttttaatttgaatttgttttctggtttggcatgtagttcgatttctgttagatttagagctagatggatttcttaaaaccttcccactgtctggatttctttataaatgatgctgttctgttcttttcattcacaaggacactggcttactgtggtcgcagctggtttagctactctgctcatttgcttttctagctgcttattgatcatgtaagaacatgatctcttcaaagcagggaagatctgttttacatactattatatttaatagtatgttccttaaggacataatattctatattattatttaggagataagttattgtttgacagctaataacaatatatttttatccatttgagtgttgttaagaattctagattcatacctttatctaagctgtaaatcttcagattatttgagagaaaaagatgccatctgtgtgcaaagttttaattcactgataaagcacattttctttgagaattaggagatgaatatttaatgttgatattccctgcttgatcattttcatctccagtgaccctctgaaggtactgattgcgctgttttgttctttttcttggctcttccttctcattggcactacaatttcatttcatgtttctttcatatctcataatttcatcaatcagactcatttttgtacatttgcttctttttcaaacaaggggctcccaaacttttgaatatatgctcttatatatacatatttatttagaaattatttacatgacct

SEQ ID NO: 92940 - DNA, 1577 bp, Homo sapiens
aaaaacctagaccttcagtaacagctatatcatatgatcttctgttgatttttcatatacatatgtaatttaactcaacaagtactttgctttagcttttaatgtgccctgaatattaacctagataacaaatataaataactttagattttttttccttgtgatgtaagaatttgtgtattgccaaagtgctaggtttctgacttctttcttgaatattacatgaaaaaaaattagaatacttcagctgtttgaaaaaggtttaattaaattagtaggtaaatatgtacttaaggacatgattcattatcagaattgagaatttgctgtgacatcactttggttttaagacaaatgtatagacatatagagaaatagttgtagtttaatattattatgatacacgtatgcttaagtaatcaaaagtaatttccatagggtcgtgaatctggcaccattcagagatacagtctacctaatgttggtttgattcaaaaatattcccttaattgtcgagcctaccagttatccttgaattgcaactctaggtaagcctgaaaactctgctcatgtagatgttagacttagaaatgatcagttgggattgttagatttatatgtaataaatgtaaagatgggcgtgtctattatgaacttgtcttaaaattcagtatggttttattttatactgcatttggtttaaatgtttttaattgggcgtgtggaagtactagtataattttttactcttaaagcttaaaagcattgagactattttatatttcataccaattggttttgtctctggatacattttcctcagaagagagcaaaatagagagtagtccatatcttgtatcaaatttatttaacaaaattttaagccatttctactgtattccaggtttctgataatctgattttgaagaagaatggctataggtaattattctcatgattgctgatagtaattttatagttttttccttttctctaattgcattgtttttagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggtaaaaacaagaaatgagtgttaacagtctataaataatgagccaaatataaaaacctggatgattcccctttgtttctttaagaagtttgttgaatagcagtgccaacacggctgcatgaatttctgaaaataaataggaacatttctgtggattttaaaaatatttggtcttaggtgagaaaatacttatctattaaatattctctactttctctgaaaggtacttcctaggcatttatttatctgttctttttaaaaggtggagccatggtcactagtctttttttcccttgtcaaacttaagaaaacaaaatcagtagccttatttaccagaatttctgaaaagaaccta

SEQ ID NO: 92941 - DNA, 1009 bp, Homo sapiens
agaccagactgagaacatagtgaaaccttgtctctaaaaaaaaaaattacagtaaagttttgaatatcatcttatgggcaccccaagttttactgtacccttaatataagttcagtatgagaaataagaaagttttaaagctttcctcgctaataattaaccatttgcaaaaacagctatttatgaaagcagtacagggatgaccagccgagaagacagagtacacttacagtttctaacactgagtggaatgagccctgtggaagattgcatggtggtggggcagattgcatggtggtagtaggtattagaaagtttcctcctttgtgtagcccgatattttatgttggagaaagtgctttggctcagccactttcataagacttagaatgacgaggtaacatgtttgccagccagtaaaatagagaagcctatggcaaatttcagctgaatttttcaaatagaatcaatggcatagtgtcttttcttgagctctgagatttgaaaatattaattttagaaattaatgtttacttttatacagtaatgctgctggggttattgcatttgaattatgtaaacaaaaccttaatagtatatattctagttctagttacattcctcagccatgagctaattttatggggggaaaaatcttaagagcatagtatttctatagtattccctcctttctgataagccctcatgagactcatgctgcaaaagcagtggttctctgattaaaaagaagagagttaaagatcagctgtgtggaggcttccactttgtcccactgccatggcctgaggcagccaagggtttgaaacccacagttctctcatggcattatacttactgttgatatgtcaaccttaagatttgccctgagttgtgtacaaaattatatgctgctttattttttaaacttatttaaactaatattcatagtatccctgcattcagatcatctttccttttgctaaaaactagtatcagatagatgactata

SEQ ID NO: 92942 - DNA, 1057 bp, Homo sapiens
attgaagtcagacatagtaattgtaaattgtcatgcttgataactgtagtgtcttgattagtagaaatgttttttcaattaatttgattatctttaaaatttatgtgtttaaatttattaaaataaaagagaagtagaatggtttaataaagtccttagagataaagagtggaaagctgtgtttttataaggaaatggctgtcctcacttaccctccccaccagattagagttaatatgctatactaaaatatgattattcacttgagatcgaaggatctaactaagggtttattcctatacattagtggtataggttttcccaagagggtggggtgattccaatatcagtgaccagaggagaggcaggcctttagacacacatatggaagaagtctttaggtggggtgaactggggacttagcttctttttcttgccctggtttccaaggattctggagttggaattacttctagtaagtggggtgaaaagggctctgccacatagtagataggttagaagccaggatagagggattccccacagtaagtctgtaagtgaagaagcatttactgtgttttgtaagttatattgtctccattagtgatactctgtgtttgctgctcttctgttgttactctaagcctgtaagtaaagcattttgttgaatgttttaacctaaggattcttaatggggacacaggcctgtgttggtggaagtgagtggtacagtcatgacagaaatgctaggtgttttttcaaatcattatcctccctcacatccttgagatcttaaagcagactccccttgcctttcctttaagactcactcatgtgctaagatgggagatggatcctcagtaaaagtatgttgatgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagtatgttgagtatgcgaattcatgtggaggcaggaaaaaaagattgaaa

SEQ ID NO: 92943 - DNA, 1034 bp, Homo sapiens
gacttgggagatttttcttttctaaattagagtagaaatataagatgtggccaggcggggtggctcatgcctgtaatcccagcactttgggaggctgaggcgggcagatggtgaggtcaagagatggagacaatctggccaacatggtgaaaccccgtctctactaaaaatacaaaaattagctgggcgtggtggtgcgtgcctgtagtttcagctactctggaggctgaggcaggagaattgcttgaacccgggaggcagaggttgcaatgagctgagatcacaccactgcactccagcctgggcgacagagtgagactctgaaccaggtagtaattggtagtggggatgggaggaaggactgggattttatttattcatttttcaattaatggttgtttgagttgtttctacttttgatcattataaataatgttgttatgaacatcagcatatgagtttttgtgtggacatgtttttatttttcttgggtacatacctaggagtggaattgctgaggcatatagtaactctgtatttaacattttgaggagttgctgaactgtttaccaaagtgaacacaccatattacattcccagatttctccataaccttgctaacacttgttattgtctgactgtttgattctagccatcctagtgggtgtgaggtggtatctcattgtggttttgatttgcacttcctgatggctaatgttgttgatcatctttttcatgtgcttattggccatttgtgtatcttcactgtagaaatgtctatttgtatccgttgctcacttttaaattgggctatttgtctttattattgagttgtaagagttctttatattttctagataaaatttcttttcagatacacgatttgcaaatattttctcccattctatgggttgtctttactttcttgatagtgtcctttgaagcccaaatgtttttaattttaatgaagtctaatttatctaatttttcttttgtcatttgtgtttttggtgtcatatctaagaagccaatta

SEQ ID NO: 92944 - DNA, 1026 bp, Homo sapiens
gactgcctattagcattacaaagttcagttaatgaaagcataattattttcttaaaaactttttttccaagctgggcatggtggctcactcctgtaatcccagcactttgggaggctgaggtgggtagatcacctgaggtcaggagttcaagaccagcctggccaaaatggcaaaaccccatctctactaaaaatacgaaaattagccagacatggtggcatgcacctgtaatcccagctacttgggaggctgtggcaggagaatcgcttgaacccaggaggcagaggttgcactgagcaaagatcgtgccacagctctccagcctgggtgacacagcaagacaccgtctcaaaaaaaaaaaaaatccaataacctttctagatatttcaaatttttttcttttcagatattgaacagtcaaaaagggcatggagggccttcatcttggctgtgttcttgtcctaaaacattgtatctgttaagattttgttttgcttttcctagaagcttagtctagatgggatgaatcttaataaagatctagcaaaatatgtatagataggattatctacccatatgaatttgctgaaattaccaccttactgattcaaaagaacatatttttcagatatatttctattttttgtagtaactgagaatttatatatggttttattataaaatcctatgtaggtgataaaagtgaaaagaacaatagcaaccatgtctaactaatacttcttaatccttagtgagggtcagtctgctctagtagttaagagcagtttctggagccagattgaccaggtttgtgtccagctctactactttctaactgtgtgatatgggcaaattcacatgcctcagtttctttatctgctaaatgaggacaataacgcctaccttatagggaagttgtgagttaatatgtgttatatatttagaacactgcctgtcatatttttaaacattcaataaatactgtcttttaaaagtattattggccgggcgcggtggctcacgcc

SEQ ID NO: 92945 - DNA, 1071 bp, Homo sapiens
tttagtaagaagccttgtggatctatttgatttttggaactactagcatgtataactgataaaaatgaaaaatatattaaaaatacaatttgtggtattttgtggcagtaaataagcttattttaagtagtggaagagtaaattatgattttttaaaatatgatttttattatttggtttatatttatgaaattaattcaatgagttctttttatttttttttaaatgttatgggtaatagtagacgtatgttatctatggggtacctgagatgttttgagtaattaaacaaattttaatcgaatgctgaaaaaagaaaaagtctgtgtaaatagcacataaagaactgctttatttgaaattgttgttctagtcaggaaaaacatctaagtagaatagtattcttagtacaagatacagaaacagagactaacagtaagaaaaatgaaatgatcactttaaaacaatgtgatgtaaaatgtgcattacgtttgattattttcctaatattggtcattgatgattatttgtatataagccactttcattaggttgagtcatgtcttttttgagttaactgaatttttctgaatttctcctgtcatttatatattgcttcaaaggaggagaacgagatggagacatttggtgcaacggtaacaaatgaaattagctcttatatagctgatcataggataaaaatgagttttgaggttatagctgatcagaaactgtagcaatatgaggggacttcagaaggttcatggaaaaatggaattaacagataaaaataaaaatagaaactttatttttcaacataagctccatcaaggtcaagacatttttgtaagcaatgataacagatatttagtccatccctaaagaactgagggtcctgggaatttaaccatgtcaatgcagtcttttttacattattaactaaagataaatgggtaccctttaaggattttttaagattaggaaacaaaaggaagtctggagccaaatcaggactgtaaagtggatggatgcctaatgatttcccgccaaaactctagcaaaattgccctt

SEQ ID NO: 92946 - DNA, 1099 bp, Homo sapiens
atatgctgtgtatttttttgccttcattctctttgtgatggtaactaatatgctgcatttaatatgcttgtaattattcattggagagtttatgtgcatatgtataaagttattgttacttggagtttttttaattggttatgatctgaaccatattgttcaagtgggaaaagttaggctttcagaaaaatcagtagttttagctctgaaaaagcaaatgaagtttaatttttaattgacagaaagaaagagagagggaaagaaagaaagaagaaacaaaggatgggcatttattatgttttctgtgataatctttgaagcagttatcagttaagcccaagttaatttttcattttgtttttgttggatttggaagttttatagtttaatgtctcaggttgtagaaaactttgcagttatttgtcccatggcgtactttatggaatgctttcaattcttaactactatttaatagatgtgaaagttttgacttgtaattttttaaatttgtgaaaacaggctcttggattgaggagatgatcaacaatcgaaataaatcagttgttcgcagtatgagctggaatgctgacggacagaagatctgcattgtatatgaagatggggctgtgatagttggttcagtggatggtaatgtattgattggacatagaactaagatcaatatctggctgacagttttcttctttagagatttaagttagttaccatatgttagcattctgattgaaaaatagacataaaagggaaactatttgatatacaatttgacgacattcaagaaccgttctttgattttaaccatctgtttttatgtatattcaaggaaatttttttatttcctacagtggcattgaaaaaattgaattaacttttcagcattattttaaacatgtctgcctcattatgtaatttctttttatattggttagtctgtacaaatatatagactttagtttcaaaaagtctgtggtcgtttttattggaactgaatatgtcattgttggttgtagtttatagccttaaaaacctgtatttttcaaattctagtaatagataaaactgggtcttctgagagtct

SEQ ID NO: 92947 - DNA, 1474 bp, Homo sapiens
agcctaatgtgtgtgtcagcaacatttattctatcttaattgacagatgattgcattgttaaactgtacatgtgtactcttgtgttaccaaaacaactgggtaattagaactagtgatttagaggaaattaggtatcttttcctgacaatgttttcagaataaaggatatttttcataatattttaagatacttgttatctgaaagtagaattttctttagcattggtataattcccattctcacaaattcttaagatcttcataacatttgtattttaaatgaaaattttaaatgctatgttttatgtgtaacagatttctaagccaagattaatttattgagatgacattttaatattctctgtaggatggttagtaaatttttaagacgtctttagaggttttcattgcactttggataaaatctaaaattcttatcattttctacaaatacttcatagtttttcttgtgcctatcactccagccttgtttgatgcaattttctcccctgttcatccacataggccttcttagagtttgtcaagggctctagttgtctacctcagagcctttatgttgctgtgtcctagcctggaatactccccttctttctctacctttcctggctatctccagtttacctctcagtctcagcttaaatatcagttcttctgatagccttccctggttccccatcaatctaaattaagtcacttctgctactctttcttattatgctttcacattcccagtttatagttacatttatgtgtatgtgagtatatatttaatattggtcccttagactgaaagctctgagaagaaaggggaaatgactgttttgttcaccattttatatgtagaaccttttgtaatgcatagcacagtgtacacatttcataaatatttgttaaatgaatgaataaatgagtgaatataagattctgtgtaatctagtaaaaacccattttcaaagtctatgctcttttgatcccttgtaagctgtagagttttcaatctgtaggccataaatatttctatttgtggtcttttggaaaggaataaaaagcagtgatgattattaatatatgtaatgtatgagtaaacaatcttcatttatatattttgctttattttaccagaatatctttgcaaggggtatgtgttattgttcatgtttataccatgagaaaaatatatcagaatggggcatacttagaaaaatgattaatactgcccaggaatacaaaaagagtcaaaatcttataatatgtcacttttacatatttatcatagtagtttgttttgttttgttttagatgatgcaaaattgaggggccttgcagcccccagtaacctttctatgaatcagactcttgaaggtcatagtggtgagtcattcaatttcttttaagtcatgtttgagtggtatttaggcatttagaaagtttctacttaatgcagaaatgtca

SEQ ID NO: 92948 - DNA, 1062 bp, Homo sapiens
gcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatattatcatgtctatttttgatgactcatcaattttgtctattaaagatatttctttaaattatactgaattaacagttattttgatattcaacagtttcttatcaaaagacagaagtttgattctcctcctatagtttaatctcacactcctgaggctaaaagtgtaagttcaggttcaaaagaaaggcttcaatataaaattatctaaatttggataaaataatgatgagctttacattaatataagctcctgagaagcaaatatatcctacagatgtaaatataaaatataaactttaaggaaggaacaaaaactaaatataccaaggaaatatataaagcatctcttacttttcaaaaattttgaaagggtatgacatagagctacagtagtattttccagacttttttgagcccaaaatcagtaatacatattaatataccacagagaaatggtggtatagaaggaataaa

SEQ ID NO: 92949 - DNA, 3382 bp, Homo sapiens
ttgcctgacattgtaaccagtgggtgtatttttgcccctgtctgatgagagttgagacaaacgattgacatttagaaaaataattttccccttgtagcattaaaatggcccagtttatctgtagaacttacacagaactgagcatctcctgagttaatgatgcaagtgacacagggactgatctccagtgccatataggcgatagtgtttttccaaaggccagaaagatggaaaatagtgaaaagtaaagagaaaacgagctaaatttagactttttggagcattgtgggttatcaaatgtactctaagtgattgttagcatgcattaatggtgataaggcttaaaatttaaaagcactttgaattaaattctgcttatacatttttattaaatatcacttttgactttggtgcctttgtattcttcagatgctcttcaggttatcagcaagtgctagtgcgatggctgacttgtaaatgtgtgtgtgtttctttaatagcctgattttccctacaaagatgacctcctggccttggactccagctgcctcctgttcattgttcttgtgttctttgccttattcatcatttttaaggtacgttgctgactaaatctttaggggtgactgagattgacactgtgaatctaaacctttttgctgcctttcaccttacaagtcacaggagattgaggatttgtggggacagtgtttattctggcacatgagcagagatagcttctagggaatggtttctgttgtgtttccaaggaatggttgtaactgtcaggatccttctctgagtgaaaggacctactttttatgtttttgaaaaggggttcatgatttgtattgaaaatctgttaaaattcccaaggttcacaaacccagaatttcttctgcagcacagtgggttgacctgaattgaagctccatctctggtttctctctgaaatgttggcgatgaaactcatgacacttaaatgagagcaagtagggaaagggcctggcctgtgctgggtccacacagaggtcagctcccttctacacagaggatgtgtggggaaagcattctaagtcactggcattttagagcaggtagtctgttgagtttctagcagatgtcaactttgtttttattcttccaggcttatctaattaactgtgtttggaactgctataaatacatcaacaaccgaaacgtgccggagattgctgtgtaccctgcctttgaagcacctcctcaggttagctactgttggatagagtaaaaggtcaccagtcactattgactgttccaggagaagaacctggagcttgactttctctttcatgctgtaacctatggtttgggcatgaaccctgggtacttttatgaacagcttaaaatccacaggattcaacattttccacttggaatcctgagtacctgggtcgcttgtctcatccagtttggctgttagatttactcattagaggtcctcattagtgtcatgtttgtaggggagatgacaggaaacagctgtgttaggcccatgtagcctggggcttctaaggatggggagttccattgactgaaacttgtgttgttttcagaaaacatccatatgatccaacgggggagctgacctgtctggggagatgaatacagtggtttcatgggtcttttggggaagcctacctttcacagccctctaattgctgctgtgctaccttcccaggttttcagcatataaaatatatgtggcccatctagggccaggctttcagacttggagtcacttcgattagaatgtcactcctccactgcataggtgtgcctgttaccctcgaagacatgatataagttcatgatcttctgactacaaactgattctgatgaaagtcaggatccaggagctagcgtcttattgggtgtttcctattgcatggtttaacccaactcctcaacacctgaagtgtaattggcactggcacttcatcggtcacactggaatgagggcagagcaatggcacccactgcctgcctgtctaggaatccttgtccagaagcaggactctctctccccacctccctctctccaccctccccttcgctagcaatcttggtaaaattccaggttattgaggcatctacttgggaacattttagctaacagtttcttcagctcttctttatggttttgtataaccctatttagggcataaagtctgaaagctgaattatctcacaaaggattttaaaggagaattaaatctgatacaattttttttctctctttagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatacttagggttgtcattgtttttaatccgttacttttttttaagataaaccctgacattttccattacagtgtattcagagtgccagtgtttattttttttttaactttgagaatacagttggcccttcgtatccatgggttctgtatccatgggttctatatccatggagttaatcgactgtggattgaaaatatttggggggaaaaatggatagttggatctgtactgaacatgtacagactttttattcttgtcgttgttctctaaaaaatacactataacaatttatgtagcattcacattatattagatattataagtaatctagagatcattttaaaaatatgggaggatatgcatgggtcatatgcaaatactataccattttattataagggacttgagcaactgtggatttgggtatctggagggagaacctgcaaccagtcccccatagataccaagggacaact

SEQ ID NO: 92950 - DNA, 2122 bp, Homo sapiens
agtattttttttcttttttcatttttaaaacatcttttgtgcatacagggtcttgctatattgcccaggttggtcttgaactcctggcctcaagtaattttcccaccttagtctctcagagtactgagattacaggtgtgggttgccgtgcccatcccccccagtttcttaatctctgcccagacggatcacctgatgttgggagtttagaccagcctggccaacatggtgaaacctcgtctctactagaaatacagaaattagctggatgtggtggtgcttgcctataattccagctacttgggaggctgaggcaagagaatcacatgaacctgggaggttgaggttgcagtgagccgagatcgcgccactgcactctagcctgggcgacagagcaagactctgtctcaggaaaagaaagaaaaaactgtccagagtcacagaatcaactacagatttgtgctaagaaattcagtaagtcaggcacggtttagaattgcttgagattacttggctgttttgtgaaaaaattagtgaacatggattaatggagagttggaacaacctgaggaagagttgagaaacgaagaagaaagtagtgtgtgttaacatagataccagggtgcaggaagcaatgaattttggtgtttgggaggttgggtggggaagtgaggttaatggcgaaatttgaatttcaggttatatttatctagagcaaagggtaatgtatgtagcattctgagtttaatacacttgtcttttaagcaattgccagccattccttccagctaaaccctactcataagacccatcttgtgtcatttcttcatattttttcctgatgcttcaggcaaagcaaattgtttctgcctctgttgtagcacttgacacattggattataatgatctgtttgcacatcttcagattcctgggctcataagggcacagggacctgtttctctagcagagaatgtggttcatgtgccatcctacacccatgtcagtgagtcgttggagcgatttaacaaataagtgctttgtgtgaatgtctcaaggttccttacttcatgctgagactttgattttttttttttttttttaccctcttggccttagatctttttatagccaattttgaaaatatttaaatttaatattttaaagctagctttaagtgaagttttgttctttttgttgtgtaagtagcttaattagatttttgtttttgttttcttagataatgcctgtgttctttttgccgtctctgttcttatgtttataatcagttcaatgctggtttatggagcaatttctgtaagtatactgtattttcatcttttagagtttgaccttaggggagcttagtaatttcctatatgtgatacaatgttatggttgttattttttctccagtatcaagtgggttggctgattccattcttctgttaccgactttttgacttcgtcctcagttgcctggttgctattagttctctcacctatttgccaagaatcaaagaatatctggatcaactagtaagtgtgtatgctcattaaacttatttttttttcattttgagtaaaatgtttacatttaaattctgaatcagccttaggtattatttttaactactccgcttgcttttgaaagtgtcttaaaataattatttctgctctcttagctactgtgacaaaactggcaagatgaaagtagagtaatttcttaccatccatttggataatgcagtattaagagttcctagaaatggatattatggaactagtagttcagcttttgtttttgagcatccaaaggtacagtaatttgactgtgtatggcactctttaagtgactagcttattgtctttacagacatctgtagcaagtattccagtgcctactatgtttttagccctttgctaggcactgttggtgaatggtgtggatataaagataactgcgaatattacagtttagcgagcaaactgtaatatttggggagtcaagatacatgaagatgttacctgtgataacaagcgggagctgtcacagcagcagcaaataaggaacttcgattaatgtcatatggaggggggcagggaaaactctgggctgggtgg

SEQ ID NO: 92951 - DNA, 1097 bp, Homo sapiens
agtatcttggtaagtctcttaagcatttgagtctagctctagaggaaatagtgagttctctgtcacctgatgagagatgctgtggaggggtttcgggcatctgatgaataaatataacagatgaacagtaacttcttcaaatccagaaattctgagattggtatatgaataaataggtagcttcgaacatgaaccatttgtaatgattctttagttttaatttttttctggtgtattggttaagcatcttatctctcaaatggttaatattacttatactttataaaatatttatttttaaattattctcatagtggtaattgcgtattgttttatctcacaggtagtctcccactattttatatctttgttacttcaagtaagacaatcttaaatatgagaggacatctagagattgtgctaagattgcgtcgtgatggtaattaatgtaactgatagaatgttatcttttccaggtagtaaacctattgatggcaattttgctgactgtggaagtgactcatccaaactccatgccagctgtcaacattcagtatgaagtcatcggtaattactattcgtctgagagaatggctggtatgtgtttaatagaaaaacaaaaaaatctcccctgctaatttttatatacagtcctgtgttgtttaatgatggggacacattctgagaaatgtcactgggtgatattgttgtgtgaacatcatagggtgtacttacacaaacctagatagcgtagcctactatacacctaggcgatgtggtagagactcctaggctaaaacctgtacagcaggttactgtaccgaatactgtaggcagttatcatacagtggcaaataggtgtgtatctaaagatggaaaaatatagtaatactgtaaatacactattacagtgttatggaaccctcatgatatatgcagtccattgttgaccaaaatgttgttggcccatgtctgtctgtctccacacacactggttatttaggggattgattagattatgcttaagttacatttcagaaagttaaaatggttacataataagggtaacaagttaaattatatttaagtcattcttg

SEQ ID NO: 92952 - DNA, 1740 bp, Homo sapiens
ccttgcctctgaacaatgcaaggaaagaggcttgctgctgaacatagacagtaaagtctaaacattttatagccttagataatggtttctttgggaaagaccttaaaataggagttactggggaatgtttattaataatcacgtagtgctgagaaggaggatgtcttaaaaaccagacttgtgtcctgattctcccatctgtcagctcagcaagcttaacacaagttatatagctttactgaatcttaagtttccccatctacacataggctttggtaatacttacttcacgggttgttgtgaggaataagtgaagtaatacacgtaaatacacatgtcataaagcatatcctcaataaatattggttgattccaaatttcatattgtggcattgtttagatcacctaccctaaaataaaacttgatctgcttatctagcggatgttagtgaaatgacttcagctgataaaaggaaaatgcatttcctgtgtgtttatcattcaaggtgaaacaggagagaagtatataatagtttgtttaaaatactatcgatagctggccgacacagtggctcacacctgtaatcccagcactttgggaggccaaggctggtggatcacttgaggtcaggagtttgagaccagcctggccaacgtggcgaaaccccacctctactaaaaatacaaaaattagccaggcttgaatggtgcacgcctgtagtcccagctactcgggaggctgaggtgtgagaatggcctgaacccaagaggtggaagctgcagtaagccgagatcgtgccactgcactccagcctgggtgacagagcgaggcttggtctcaaaaaaaaaaaaaaaaaaaaaggtcccagctacttgggaggctgaggtgtgagaattgcttgaacccaagaggtggaagctgcagtgagctgagattgcgccactgcactccagcttgggtgacagagcaaggcttggtctcaaaaaaaaaaaaagtcccagctaccccggggactgaggcaggagaatcgcttgaacccaggaggtggaggctgcagtgagccgagattgcgctactgcactccagcctgggcgacagagcgagactccatctcaaaaactaaataaattaaaatactactgataggaacttaacccttgaaaattccagatgttcacattttcacaaagggaaggagggcaaattctgtgaactttactatgctagataaggaagcctaactccaatcctacgtgagatttctgtcttgagtcgttaacaatactctttctgagtacttaaatgcagtgaagcctcctgggataccacagggattggccaacaactacaggcacaactcatttccttttaaaatggatttacaaccctgggagactaggaaaattcagatattataatgggatttcagcaggctgttcctctaaagagctaaacaattttattcagaagttgctagttaatgggaaggggcagcctctggcagctttgtcctcacctctgttctcttttgttagtaacttagatggaaatactgattacatgctgatcctaaattcaggaagttgagacagtaaatctgtagtgtgtcagaatccacatccagaaaatcttcataggcaagaatgtaataagatgaaactcaattacaggtatattaaggcctatgcttgggcctctgaatccaactgtacaggtgggagcttagcacaatcaagtgt

SEQ ID NO: 92953 - DNA, 1041 bp, Homo sapiens
agattacagttaattttatgtattttttgaaaagctaaacatgtaatttagaaatatcaactttaatcagagataagttgccagggcttacatgtgagcacaaggtaggcgttcgttggtgaatatctttaagatcaaaggatgccaggagcggtggctcgtgcctgtcatcctagcactttaggaggccaatgcagtaggatcacttgaggccaggagttcaagaccagactggacaacatagtgagactccatctctacaaaaaaaatttttttaagtcacaaggatgggttttccagtgtaatactttaagatgtaagttggggttctaatgaaatgatgtgatctaatggaatataattaactcaaagaagatttggaaaaagcttttaatgaagtagcattgaaatttatttcactgtttcttggtccttctgattggccctacgatttattttgtttaatatttagtggtatgacccacagtgaaattaaacttgaagtgtctctagtactaaaagaagataatagtggatgagcgtgtgacttatccatggaagagaagaaaagtgaagagttcttttgttttttaagagacagacttagtattgttgcctaggctggtctccagagctcaggcgatccttcccacctcagcctcccaagtagctgggactataggtgtgagatttttagaaatccttcatgtaataaaaatatttaagaagggaaaatagaactcctaaatgtttttggcatgtcattcccttcatttagtaattgggtttgcatgcttttcttgacaaaggaatttctgtaccgcagagagctttttcactgtgactatgctgtgtttagcaaagaagagtttgcctaattgatttcaaactgatttccatacacagaacatataacgttttagtagatatatctgatagttcagtaattaattcacctagttgtattagctcatactcatacaccacacacgctggccaaaacccattgcagcaaatgtgggcaacaaaaaaaatcagctt

SEQ ID NO: 92954 - DNA, 1378 bp, Homo sapiens
ggctgggcttggctctgtcccttccccgcaggccccgcccccagcccgcgcaataattgagctgcgcgcaaaggtcacgttatcagcctgtgacgcttcccatccagtacgtggcacacattgctcagaaaagccccttgtgcccgctttctgccatccgcgctgtctcgtgtctccctttttccattaaatgcctcttttcttgcgggtctcatctcgggaatagtgcactacggggacatacctatccccaactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtaaggcgggcaggcgtggcgcgtatgtccggggggcctggggagcggggcctggtgcggagggggtgagactggaaacggggtgttgggtggggcggggacttggaggggcgctgctttttaaggcgcgccaactctggatgaagtccaaggactttgggaaagtaaccttgttcaggaatcggagtcgggggagcggggggcggtggtaagcatggggagattgttctttggcaagaatttgaggagagaagcgggcttgggagagcagaggctttgcaggcgaagggacgagggtggtaggatttggtgggaattcctctgttttggttcttgttgtatttctacgatctgaaaggcagcatctcccttcctcctatccagtgctccctggaattttttcctctaatgaaataattaggagcggaccttggtaaacgcagtctagtttcgacattggtcttcccgttgggaaagcgaaagatccagcggtaacccggttgtccgcgtttcttggactttgttttgtttcatgcctctcttgcatctccagaatcgcttgggggcgatagcttttgcctgagttgacgcctgaccagcttttgtcctggtgcagcctcctccctgcgcagtaggtgcttttcgtagccgaccggct

SEQ ID NO: 92955 - DNA, 1111 bp, Homo sapiens
cattcatttacatggagagattaagattgttctaaaatacttaccaaaacaacaaaaacattattattcaccttttgactttcaaaataagagttttatagttttttgatatataattgaaatacaataaactgaatatattgaaagtgtacaatctgatgagtttcaacgtaagtgaaatggccatcacaatcaaaataatgaacatatcctcacctccaaaagtttcctggctccccaactcggttctcaggcaagcactgatttgctctctgttactacagattaatttgcattttctagaattttatataagtggaatcatacagtatttacacattttgtctggtttctttcactctgcataattattttcagactcatttttattgctgcaggaattgatagttccctcctttttattgctgtgtaaaattccattgtatgatacagtgcaatttgtttatttaccagttgatgggcctttggttgtttccagtttttggctgctacaaataaagctgctatgaacgtttgtgtgcatgtctttgtgcggacatatgctttcatttctcttgggaaaatacctaggagtgtaatgtcggtgtcacctcatagatgtatttttattgttttaagaaattggctgttccaaaaagtagttgcaccattttatactcccactaacagggtgagttccagttgctccatatcttcaccaacacttaatatggccagtctatacttttaaccattctagtaggtgcatataaggtaatatggtttggatctgtgtccctgcccaaatctcatgttgaattgtagtgttggaagtggggcctactgggaaatgattggatcatggggctggtttccaacggtttagcaccatctccttggtgctgtcttgtgatagagttctcgtgaggtctagttgtttaaaagtgtgtagcacctccccctgcttcctcctgctccagccatgtaagatgtgcctgcttcccctttgccttccgccatgattgtaagtttcctgaggcctctccaggagcagatgctgccatgcttcctgtacagcctgcagaattgtcagccaattaaacatagtttc

SEQ ID NO: 92956 - DNA, 1357 bp, Homo sapiens
aggctgagacaggagaatcgcttgaacccgagaggcagaggttgcagtgagccgtgattgcaccactgcactccagcctggtgacagagcgagactctgtctcaaaataaataaataaaacaaaaaataaccggggctgggcatggtggcttatgcctgtaatcccagcactttgggaggccaaggcaggcagatcacaaggtcaggagatcgagaccagcctgaccaacatggtgacaccccatctctactaaaaatacaaaaaattagccaggcgtggtggtatgcacctgtaaccccagctactcaggaggctaaggcaggagaatcacttgaacccaggaggcaaaggttgcagtgagccacgaacctgccactgcactccagcctgggcaaaagagagaagctccatctcaaaataaataaataaataaataaataaataaataaataaataaccatcatgggtatgagtggaacactatgcagccattaaaaagaaaagtagctctgctaggcacggtggctcacgcctgtaatcccagcactttgggaggccgaggtgggtggatcacctgatgtgaggagttcaagaccagcctggccaacatggtgaaacccatctctactaaaaacacaaaaattagccaggcatggtggctggtgcctgtaattccagctacttgggaggctgaggcaggagattcgcttgaacctgggaggtggaggttgcagtgagctgagattgtgccactgcactccagcctgggagatagagcaagatttcatctcaaaaaaaaaagaaaggtagctctaaatgtactaagaacataatatatatctccaagataaattattattaaaaaagccagatatagaacagtatataaaatatgctaccattaaaaaattttttttaaataatacagtcatgcattgcttaatgatgggcatacattctgagaaatgtgtcattaggcaatttcattgttgcatgaacatcataggatatacttacacaaacttagatggtgtaacctactacacacctggctatatagtatagactatgctcctaggctataaacccatacagcatgttactgtactgaatactgtaggcaactgtaacataatagtaagtatttgtgtatctaaacatagctaaacatagaaaaggtacagtaaaaatatggtataaaagacaaaagatgctacatctgcataggacacttaacatggatggaggttacaagatgaaagttgctctgggtgtcagtgagagagtgctgagtgaatgggaaagtctaggacattatgccactgtagactttataaacactgtacgccagcagac

SEQ ID NO: 92957 - DNA, 1102 bp, Homo sapiens
gacagtcagagcacctgttataatcatgccaactagaggccctcaccatgtttcatgagtgtcaaataaggattcccttgtgatcctgaaaggaaaagtggtctcaaatatgacgtttcaggaagggaggggcttaaggcaaaattaggctgagctactggaaataaagtggtgtttcctgaagacctaaatgtggaccaggatttatactcactattcacttaaggtgaccagtggtcccagtttgcttagaactaagagatttctcaggacataggactttcaatgctaaaattgagaatgttctaggcaatctgggatgaattgtttaccctatttaaagttctttctacaaaatgataaacttacaaatgaagtcaggtcataactgtctcttaccatggccttggggctccgtggtgatccggatcctgcctcgtacttcatccagctctgcccggttccttcctatccagccaccctgcctccatcctgccttcagccgacctagtttattcctgtctcttaacctatcacctgtgattccttctgcctgcaccaccttcacccttttctcctgctctttcccaaggtcacctcccttccctcctgcagaggtcagctcagagaaacgatcccacaccttcctctctgaaatcgcttcctccacctcagccccagtctctctctggctgccataaccctctgtaatttactcgtggtactgatctcatgtgtgaattagcttgattgtgcacttgtctcttttccccttagcatggaagctccaggagggaaccctgtcctagactctggctcaggggtttacacaaagtcggtgttcaacagttgttgcctggctgattgcaaaaaaggctttgtttttttctctgttctttttcttattttactaaaaaaaaaaaaagcagtaagtaagcaggttaaattttttcaagattaacccttattttggtggagaaaaaaaaatcatttggcctggttagtgctggggtttagtagagtaacctttgttttcttcttcttgatgaacattgtggcccatttccctttcaaaattttctttctagtctctataacaaag

SEQ ID NO: 92958 - DNA, 2383 bp, Homo sapiens
tattcctcaccaggaagacagggcacaggggcccgccttcccctacccccagggcctcgcccagagcaggacagactaactatgagatcagagcagaagcacccttaaagatcacccaagagagggctccccaaactcacaatccaaacttgcagcccctgctgcaagagtgaacgttataccaagtccaattttttattttatagcttcgtgggaattttacgctttacactaaaataagtctgcttatttccatacaaaaatgtgtgctttgtatcactttttgtgatatccatgccatggtccagccagggtccggagttgatgtggcaagaaggcctggctttcgggccctgtgcgatcctggtttgggtgcatctgagtgggtggtggcaaagatcagggaggcaggagctgcttctgggtcttgtagtggagctggttgctgctgctggcggtgacctggccaacccaatctgcccctgccctcccacaggacttcacctttgaaacctcgggggagaatacggctgtagtggccgtggagcctgaccgccggaaccagtccccagtggatcagggggccacgggggcctcacagggcctcctggacaggaaagaggtgctgggaggtgagttttctttcaggggggtagtttggggtgaattgctgctgtggggtcagggtggggctgaccacagccaaggccactgctttggggagggtctgcagcagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtat

SEQ ID NO: 92959 - DNA, 1023 bp, Homo sapiens
agggctggccaggacaaggggctctgctgagacggaggttgccaaggagagtggccctctttacctctgttacgggagcgaaagctggcagttggcttgaggctgccttctggaagcttctctgccagctctctgcccacagacttcagatgtgctctttgtaatggctggcagccggtgatgatgactccccatccctggtggcacaggtcccgttctggtctacgccatttcctctccacctctcaaatgtgggctggtccctgggtagcgtcaccactggggcaggctcagcgactccagctcagtgaaactccatcccactgaggagccttagacaggttttccttaaaactgattgggtcaactggtagggctggggagagagaaggggatggcaggtgaggagagcagtgctgctgcacggggagttgtagtgtctgggcggccttgggcaagtccctcacctttcagagtctctagtccttatctgctagagacagtgatctcagccccgctgcctcatctgcaggggagttgtagggaagaaagaggaatgggtggaaagtgtttccagccttagagaaggccgcactccttcacactctctttcttgctgggtcagagccctgaccccaggattctctccagggtccccagggtatggccaggagaccagcatggctgagatggagatgggctgacctgacccttactcccttactccctgtccccagactccaggcagttgcctcttgatcccccagcccctaggcgagccaaaccttgggctttctaatcagtgagcttctagggtctgcgctgtgggtggggaaggggcaaggcatcccttgctttgaacaacagaatgagtggaagcctagatcttacctagcacaaagttgttgattcgttctatgaacagttggttttcctgggacttacagaggttaaaggctggttagcctgttgccttcctgggcagggcattaggtagtctccaagctgaggccacctgttcct

SEQ ID NO: 92960 - DNA, 1050 bp, Homo sapiens
ggaggagtttccctggggtcaggcctggaaagtccaggaagctcacccctgagtctcctcgggtgaatctgcagcagtgactggttgtcttgggctcagggaattgtagaaagggcatagagccccctgcctccctccccacctcccgtgaatgaggttcattcttagagatcttgtctggaggctgggcatgcagtgggcactctggcccacctgtcttccctgtgtaaggcagtcacctgagcctgaaggcctgggccttcctgcctttattgagtcctgagaccttggggcttcacagctgaggtgggaccgagaactagctggcgtggttagtcccggctcgggctggagtggagaggtgttgtggaggccaggaggagcacaggacacggagtctagcccacctggatcacatccggacttcattgcttcctccctgtgtcatcgtgagcacgattcttcacctaccccagcctcagtttcctcatctgtaaaatggagtttctcatatcctgccccagagggcttttgcagaggttccatgaaataccatatgtgatatgattggggccccttccttgcctagagcacagagaagcaagtctaggggagcactgaggctgacctgtgggaaggggtgcagtctgacccagcctgagcgtggagtcactctgtgtgaatggcctgctggtctgaccccagtgctgctgacgttaacagggcctgcaaacatggcttttgcccttctcagaaacatgagccttcactagcaggctagactttgctctcttccacccgagcctctgccaggggctgcctcctgacctgagaaggtacgggctgggttgcctcctgacctgagaaggtatgggctgggctggcagatgggagaggaggccaggcaaagccagacattggggcaccctggcaggggctcaggcctgctgggcaggacccctagcaatggggcacggtggcctgtccccagaacttcagactgatggctgtcctggagaaggagctgggttttctatggatgccgacaaa

SEQ ID NO: 92961 - DNA, 1119 bp, Homo sapiens
tccattggctgagacaggatttgtgtgtgtgtgtgcagtgtgtgtgtgtgtgcgcatgtgtatgggtatggtgtgaatacatcgcaagactgtcaagtctcccctgagaagcctggcatttgggggctggctgaaccctgcaaggctctactgggcatttgctggtccgtcctgaagaccatggatatgagcgttttgggctgagggggctgggccaggctgagctggcctgaacagtgccatcaggcaaacaacactgggttgggttcaactgatggcccctcagggacaggcgagagctcctcacaggaagtaaattgggacctgagagagcagggtgggaaccatgtggactgggtgtggaggggcctgtttggatggcgccctcaggccagaccccaggtggtgcccagcttgcaccatcttttaccttgggcgctggggaaacattcttggaattagcagattcttttgtaagcctgggaggcgggcagcatggcgcgggtggtggccagaacccaggactcctggctctggtgccacagtcacctcctggtcccctccaacaccaggtcctgctgggggtggggacagcccatgaggaactggtcattaggcgattgccgggcttcaactgttgcccgattgccttcttttcaccaaccagttttggaatcttgggttgaaagggcccctgaggccctgagagattcagggagtttgtggaaagagggctttggtgctgggatcctgtaccctgtcacttctctctcagctgttccagcagaggttgggttttggatgggagcatgtattctggaaccttccactgaatgggacatgcgtgccctgacaggctccaggggaaggctgatgtgtgtatgcccctcaccacaaggaggtatgtttggggtgcaggttgtagaggtgaggccgcagaggcaagaccctgggcttggggctacttcagcaactgtcttatccagctgcaggtggtcatggggcccacgccatcgcttcccctggaagagtgagctttacctgtgatgttactgcttttgcccgccctcaggaagctttcatttaggtggagagacagtgtgagaaggtccctggcat

SEQ ID NO: 92962 - DNA, 1424 bp, Homo sapiens
agatgtggagctcggggctgtaagaggcctttgggtgggatgcagcatccaccttcagcggggctgacgctccactaaagagggacgtggccgacaaagagcagcctgagggtccccagaaagtggctctcccgccccggccaccggccgctagcccgccttccccaatgggggcgctttgttctcggcccctgtaaccctttcctgggaacagccccgtaacgccggccttgacgggggctgggacctgggccgcagccaggtgtcagcgcgggccgcccggtgcccgagtctgccgcccgagttcgcctccccagcccccgcgcccggtgctggcgtcccggggtccctcctgcgggccggctcggccatccccagggatgcagaggggaggtgcggagccaggggcgcttccccttccggaagtggcggtgtctcgccactacatctggacagttcgacttccccagctctggcaaagggaggcacgtgggcagggaaggggcgggggcggggtgggcactcgggttctccactgctaatgtggcatctggacaagtctcagcagcgctgaccctccgtaagcgttgcctcgtgtagtagctgccagttattgagcgctttggttttttttttctttacagagtctgtctcatgggagatgaggtagggacagtcgtttctgagaccgatgtgtaaagcgccctccctgcttcccaggtgactcgtgcttccagacattttccggtccaggagaggtccctgtgcctattgaactgtgaatgggctggactgtgaggggtatctgggagcacggggagggccatgatttccgagctgggtctcatgcactcctggctttcaggtccaagaagctgctctctagggtggtggtttctgtggaactgagactgtgcttggagtcttcgctccgagtttggagaagagaatggagctgggtgccttacctccctggaccgctgggcatcacctcactgccccattctcgcacatgatggggcctcagcaggggcggctgaagttgggtcctccacctatttccggctggatttaggagggctgctggttcccttgcctgcctggggtaaagcagacattccagagccctgggatcccaccgcacccgttaatgctggggaggcaggtggagtttgggcttccccgtgaactgcctttcctggagttttctgtgggctggggcagatgctgcagtgtgaggcattatttcttgcccagaaacttggacatagggcccaggaggcaggagagtctcaaaaggggaaaggagggagactccctggagctgcagggagggaaggcttcctggaggaggtgcttgagctgagcctgaaagccccacctgagctttggggtcagactctggcttgaagcttaggtgttct

SEQ ID NO: 92963 - DNA, 1050 bp, Homo sapiens
ccacccagggagcagccgagctgaaaggccgggaaccgcggcttgcggggaccacagctcccgaaagcgacgttcggccaccggaggagcgggagccaagcaggcaagaaccttaggagcgggccgggggtggggcgttccgaaggggccgggaggggtggctggggggcggggtcctggggggtgtggactggggctggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccggtgagtgcggccggcggccaggcggggaggcggcgggaagccgggactggtcacccgcggatgccggcgggtgcacgtggagggggagggggagcgaagacttcccttcttcccgcgctagcccagcgggtcccgggacggtgagccccgagaccagggctccagccccaatttcctccgctgtcggtgggtgccgcaccggtcccgcgctggggagggtggggggccggggccccgcgctcaattatgtaaaacgtctccacatctgtcggagcccgccagcccacagcggcgcccggggtcgcccgttcccaccctcctcgccccggccaccgcggcggccgggcccccgtcggtgacccggggggatgcagtgaccgcggccacaacgccccccctgcagaccctaattcaaaccagacccgcgggcttgcgccccagcgccgccgagcccgggcgccccgccccttgcgccagggcaagtttg

SEQ ID NO: 92964 - DNA, 3919 bp, Homo sapiens
caatcttatttttaacagctgcgttagttatttaactggtatcatatttattatatttggatcctccctaattgtttaattgttataagtagtgctttgtacaaaagtctttttgtaatttttttggtggaataaattcctggatgtggaattactgggtaactttcttgctatgtttggggcctctgcctgtttccacgtgacatagttagatgtagtgttttattcattgaacaatttcgagaacagatgtttggagggattgagcagatcacaactgcttttgcaaaaagtagctttctttggatttaaattttttttaattgcagttattcctctaaattacccagaattgggggtgcttttttaagaaatcagaaactaaaatgacttagattttctaagcagattatttgtttttcagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctcagttataacttaagattgattgcccattcaggtttactccgacgtaaagaaaacaaacatttttaacacatgggtgctgttctggagccactgattcctctgatggtattaattccatgctttgattagtatttaggacctataactgcatacttcataggataaaacttttagcccgttttcacatgaactcgaggaggcagtgttgtctaaaggtaaacaatttaagttcagatgtggatttaaagtttaccttatttacacaccttgtgaacttttctaaaccttgagcccttagtctgtatcaagggataatactacttaactcattagttttaacagtggagaatatacaaaaagatagttagaacctatttttttctttttaagagatggattcttgccttgttggtcaggttggtcttgaacttctggcctcaagtggtctttttactttggcctcccaaagt

SEQ ID NO: 92965 - DNA, 1049 bp, Homo sapiens
ttctgttataaaagtaattggctgggtacagtgtctcacacgtgtaatcccagccagcactttgggagatcaaggcaggaggatcagtcgagcccaggaattcgagatcagcctggacaacatagagggagatcctttctctacaaaaaattatccaggcgtggtggcgcatgcctgtagtctcagctatgggggaggctgaggtgggagaatcacttcagcaagggaggtcaaggctgcagtgagcggtgatagcatcactgcactccagcccgggtgacagaacaagaccctgtctcaaaaaaaaaaagaacaaaataaaataaaagtaatcataagacaagagaatcccatcctgacttctgttttattgttcattggagaagattctttctataagtcaaggaaattttgctgtgaagaaaaaaataacaaatctttgtttatctgctttaatttttagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaaggtaatacagcatgtaacactcagataactgtttgtctttgtgtttaggctacacatttaacctccttgggctttcatttcctcccgtatgttataactggaggaaaaattaaaatcgatggatatcctttggcagatatattggtatggtttccatttttatgcttaaggttatcatggccaggcatgggggcttttgcccataattccagcagattgggaggctgaggtgacaagatcacttgagcccaggagtttgagaccagcctgagcaatgtggcaagaccctccctctacaaaaaaaaaaaaagaaaaacaattagacaagcatcatggtgcaaccctttagtcccagctacttgggaggctgtggtgggagaccacttgagcccag

SEQ ID NO: 92966 - DNA, 2234 bp, Homo sapiens
gctctggcacccaggctggactgcggtggtgcaatctctgctcactgcaacctccgtatcccgggttcaagcgattctcctgcctcagcctcctgagtagctgggattacaggtgcacgccaccgcgcccagctaatttttttttgtatttttagtagaggtgggatttcaccatgttggtcaggctggtctagacattgttccaggcaccaggtagctagcatgtaaattaattttatggctcttggattggagatggggctggggattcaaataaataatgcataatatgctatgtaataggaagttcaatgaaaaaaagtaaagctaggacagtagggacagaaagtgaaagaggaatgttctaacccaatttactctccaggatttgactgttttactgctctctgtccttgtagtccttttcgacctttaatacctccgtatagctttgcactgacagtgtatccttgggaccatctctaccctgtggcctggattgtatatatagtactactctgcatagattttgcatataataatagcatgatgctggtagtggattttgtttttctgaactctactaatgtgtattttacaactatctatacatttttcttttttaaaaggacactgtcaagtacttttaaactgttaattgtaattttaaaaatttcctgcatgtatttatttttatttctattgactgctctttgattttctttcttggaacggaatgtaagttaaaaatgttttttatttattgtaaatgataaggctctaggaataataactgctgtttattaatactattgtttgtgaaatagtggatttatgtcaaatatatatatatatatatatatatatatattttttttttttttttttttttttttttttttgagacagagtgttgctgtgtcacccaggctggagtgcagtagtgtgatcttggttcactgcaacctccgcctcccaggttcaagcgattctcctgcctcagcctcctgagtagctgggattacaggtgcccgccaccacgcctggctaatttttgtatttttagtagagacagggtttcaccacgttggccaggctggtctcaaactcctgacctcgtgatccgccctcctcgaccatccaaagtgctgggattacaggcatgagccacgacgcccaaccttatgtcaaatattttaaataaaaattttaaaatcttaaaatagtgtataatttagatttattacctaatattgtggctttttaaagttcataccatcagtggtatgatggtaagaattgatttatttttacatagaagtatatatgaccgaatgcaaaaactagagatttaacattcaatgttattgtgttaataatgctaatgaatttcagtctatttcagtggcttaaaatgtaagtttgctagcaatttaaacttgcttgttaatgtaactgaaaattttgttggtagtttcagtgttctgacatttatgagtgcatatgacactagatcatataattaagttttaaactaagctgctgaagaataaatacacacttatttttctcatgttttctagtctctttatcatatagccacatacatgaggtatatgggtgagattttcccctcccaattttaattttctgtcataacaagtaggaattagtggggggaaatatttctttattgactgaatttgtagctaaagtaaattttatttgaggaataactttgtcaaaaatacttgctgaccatagctgctttgttgtaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctaggtaggtgattatgatatttctcacttcatttttgctttgaaaattgctgccttataaaagcttaaatttttctggactttagtctgcattaaagttggaagcttttaagagctaaaattcaatatggattatatgttttttctttcatgttaggataaattataaaaatacgggttttaattttttat

SEQ ID NO: 92967 - DNA, 1708 bp, Homo sapiens
tgtcatcgagtttgtagctttgtggtaaatacagataaaaacagcagttacaatataatgattgtaatgttcttgtcttatttcactttatttcataatcttattctgtagaaacatagtgatttcattggaattattttcctttatgggttttttgaaccaaaattagcacacattggattataatggaattgtttctaggtttattttctccactagattagaaacaagaaagcccaggcctttttctacaactaaaaatactcagatttcattgaatgtttgggtaattgaatttgagtggttttgtttctttgttttattgatgaatttattattgagtaaggacacttcctttttaaaaattacttggtatcctacatagattactatattaaagcattatttggctgttctcaatcagtgttttctttgttcagtgtgccaagatcatactctttagaacattgcattatgaaaatgaagttttgacagtcagttgtggagtttttgttttgtgtgtgtgtgtgtttatttgttttttaccttcccagttcttcagccctcttcccaccaccacaatgaccccatcaagagagacaataaatgtacccataatgtttgtgtaggatcagaatttattccagtattcacagcttttgaagcaagctttaagattgcataaatccttagtaatcatggtttaagagaaacaatcccagctcctataatttttcttcactccaatcagaaaggcaactggccatgaaatctcagctggaatatttaaaaggaaattcagatatggcttgctcgtttgttaacttattaccaaatgtattaaccaaaggaaagaatttaggccaaatctgacagggtcatatgacatatgcagggaaaagccaacaggttcctattaggctactcgaactcatcctactactactactcttttgcggggttaggggtaggttttttaaaatgttcttgtgtccatcagtcacaagaggaggtagttttcactaaagataaaaaattgaggcaacttttggaactatacattacccccttttgatagggtaatggaaattgacagggtgggttattgatggaaatgatgtcataactagtctgaagactatgttatgttaactaagtatgttattacttagtctgtttaaattccccttgatgaatgagggaagattgttaaataccttgtatggtgatagtctgccctttatttttttaagtttaaccagtaaagactataataaaaggtaagatttttaaaaattgctgatagaaaagaatcacaagcaatagaaacggaaacaacagatttttattttgtattttagaacacttggcttgtaatttgcatctaatgtttgcttgcatattgtcataaaattaacagttttaaggtagtacgtttgacatgtgtgtatttttataacagcctattaaaatgatgtggaagattatacttttaaatatgcccactttgtttttttaaactcattgtagtcttagtctttcctccaataaaattgttgtgtctttatatggcaaatgtatagttattataagcattctcacgcatgtgatcccagcactttgggaggccaaggcaggtggatcacgaggtcaggagatcaagaccatcctgactaacatggtgaaaccctgtctctactaaaaataa

SEQ ID NO: 92968 - DNA, 1638 bp, Homo sapiens
ttataaagataccagctttcttctagttggtctaaagattgaacgctatcaataaaattaggttttaaaaagaaattgataagctgatgcaaaaaatgaaaatggaaaagcagaaccaaaagtagtgaagacagttttgaaaagcaaagttagaaaacttaatactgctggataccagaacttagaaagctacagtaactaaaactacggtattggcacaaggataaataaatagaacagcggaacagagtagtgcatccagaaatagacctactcatttagatacctaatgaccaagttgccactccagtgtatatgagaaaaacaggtgtttcagtgacttgggcaggagtagttgaatatccaaatgagggggaatgaactttgacttctgtttcacaccacacatacacatatgcacacaaacacgctttattctcaaagaaattacgtgacttatattcatgaagttagtaagaggcagaaccaaaattttgagcccacgtttatctggcttcttccagatgttgtactgcttctcaaaggatgcttttctatttatttatttatttattcattcattcattcattcattcattcattcatttgacgaagtcttgctctgccccccaggctggagtgcaatggtgcgatttcagctcactgcagcctgtctcccaggttcaagcgattctcctgcctcagcctcctgagtagtggggattacaggcgcctgccagcacgcccagctaatttctgtatttttagtagagacgggttttcaccatgttggtcaggctggtcttgaactcctgacctcaggtgatccacttgcctcggtctcccaaagtgctgggattacaggtgtgagccaccatgcctggtcaggatgcttttatttctaatacctatccgaataaattaaaaggaccatgtttcctatgtttcacatctttgtaaactttttataaaattgtagtaaaatataatttaacctattgtgactttgtggaaaaagtgagtttgaatgtcagtgttattggcttttttgggtttttcacttgctaacaattgatctttaatccaaattaaatgctatttactttaagggtcttttaaatatttcattactaattttaagttaaaactgatcatgtacagtggctcatgcttgtaatcccagcattttgggaggctgaggcgggagtattgcttgagctcaggagttcgagaccagcctgggcaatgtggcgaaaccccgtctctattaaaaatacaaaaattagccgggtgcggtgacatgtgcctgtagtcccagccacttgagaagctgaagtgggagaatcgcttgaacccaggagacggaggttgcagtaagccgacgttatgccactgcattccagcctgggcatgacagatcgagaccctgtctcagaaaaacagaaaagaatcttgtttgtaatactttaaaatactgtaaatagtatataaatagcaagttttgtttttatttctaattactgaaagtaattgctattttatcttttctatagttttattagactcctttttagaattatgtgattaaaattgttacttattcaatattgaatatctgtgttcaatacaatattgaag

SEQ ID NO: 92969 - DNA, 1494 bp, Homo sapiens
gtaatgtgggctttgaacccagtaaaatttattgaaaggggactatgaagtctgaagaatgtcatgtattcagcaggtaaacagctgtgctttagtttgctgtggattataaaatttcctaacctgtcttccagttacagaaaattttaataataggcaagatattataaatttttagaatcattctgtttaaattgctggcctttggcagacttagtcttgtgcttctcttatgataaaatattcagagaagtaaaattagtactgcaaagttgatagtaaggccacctgccatttttctgagtttcacatacagtcattaatgaaagcagaaaacaatatgaattattcgaagcattcactgaaaatactgttatcctttagcagttacagttctctgtaactgaatagcattcgatagttttttttcttaaagcaccttcatattcatatttcatttcatcctaattgttggcatagactgtcagagtggtttgttgattaaagatgaagaaattaaagatcagttgattaatagactttcccaaaccagtgaataacagaattaaggctagcatccagttctgactcgtgatactattcttcgtttttccattatgctattctataggaactgaacaattttacaaagtatataaataacttattctaattagcctctcagaatctaatgattacctcattatggtataagttatgcttttctttggttaaagtatgtataggattaccagctttttaggttcctttctcagtttagttattcttgagatttagataaaaatacttgtctaagcacatatgttatatttgtacttcttatttgtaataagaatacttgttaatctaaggcaggcaatttagggactgtgtatagagcagcacacccgactctcaacagaatcttacttacaggttctcatgttaatataaattgaaaaacagctacaaccctctggtagacctagaagtaatttatttgctgatgagtaggaaataatgttttgaagaaattacgttactagttgtatggaagaatttgtgatgtttggttttctgtataaaaatgtcttgatcttggttgtacttgttttagattactaattttttatttattatcctttaataacattatcagtgacattgtggttctaatgtctgagaaagttttcaccagttaatttacttagttaagataatcacaaactgaagactagaaaatacttgatcccatcctgtgttttggcatcagaatcactctggccacttgtttaaaatgcctcgtagtagacttcacaaggatgtgaacagtttgcaaatgtgcggcaacagggtttgctcgttacaatgattgtggggattctattggcattaaatgcctggtagccagatgttatactttgcatagtcagcacaaaaatagtttcgtcccactgaaattttcagtagcctccacatgaaaacactgacttg

SEQ ID NO: 92970 - DNA, 7053 bp, Homo sapiens
agcacaagctggtaagtgtaactgacatttttaggataatatttttctggtgttgagataccatttttaaaatacagaattttctgggtggtttaaagaagtatctgaaatttattttacagcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggtaagtttgtttttacgatgagtgtactctgctaagtggaagaggtatatgagtgtgtttaacattaaaataagcaataatagcatgtaggataggaaggacaggaataaagtattggactactggtttaatttgtaggaaaaaaaaatcctgcaaatcttttcaacactcaccaatgtttaactcactataggcagcctgttctttactcatatataatacatttcctttttccctggctctaggaattgattactgtaatttttgttttagtagggtttatttgggtcaatatattattcactaattattagctcatcttcattcactacataatgtttgtggaggcaaatattttgccgtcttaaatttttggtattttaaagcagttatctttgtgtccttattagatggtttattcttattaaatgctggtagtttattacagtttttaaatttggcctaatataaaaaatacatatgtgtatgtataaatactgaaatgttctacacagaatcccctaagaagctaccagtatggttatcttttagattaaataagttagcctttgtcactaaaaattcacttaaaagggtatctattcatgtatcttagctttatataacacttaacaaatcaaaattttaaatagcttcactaaataattgacccactcaaactggttcctggatcctgtggtagaggaagaactaagtgaaatcagaagaggcccacgttgacttcttgttgatacacttggtgttttctgtgaggtttccacagtactcaggaaacattagggaaaaaacagctgacccagttctatcggtgcagctggcagcttttacttcatgaggataggactatttggacctcaagagattttctgtttctataacataacttgctacagtccttaatatctgtttctgatctcttttcttaccacatcaaattatattcttttctggtgtggaaaatggcagaactaacacatgccaggcattattaacaatgcttgccagttttctaagggagtgtcttctgaacttttatcattcatatatacaggaaggatggtctagaacagccacaaacttttagatggcagaatcttttttcatttattgtaatgaaatacaataagtggatgtcatattggactgacacaaaattatctgaagactgctcataagaatttctgagggaaaatccagtgaacatggggattgttaaatcttttcaattttgtacttgagttttttcattgcttttggagttgtgtatctctttgtccacctcacgcactcccataggactcattccttgtttctaacacaattgggacattttctccaaagaatcctaaatattctgaggaaaactggaagaacaagtaacataaaaaacaaacttgtggaaatagtttttaaattataaattgtaggccctaaataattcagaaaaaagagagcattgattaaaccccatgtttcctttctcacgtagtatgtcactgatcgtctggttcagatttctaggcccctactcaattctttcaaatttccatttgtttcttagttaaggctgttttccccctttcaggaattgattgacatgaacattttgtccactacagatgccctgtttccccaaaactaaccttcacacctccattatttacaagcatggcttacttaattctgactccaatctgtaagagcttcattttaccttgctttagagagcattagtgattgccacccctgaatgccagtaaagagtccatcgtatctctcctcttgggcattttgtgggagttttttcaagtgctatatatatggactcttacaagtttgcacactgccttttcacattatggcaattacatacttacatgagctctaaaacataatatggttgtgtgcctgtatacacatatacaagtaacatacacagtccttctcttacctctatgatgaaattattaatgtttaacagtgttaaataccccattttatgatatagttggccaagaagcctaaacatcgtaacatataatttaaatcatcttttctatgacctgttattttttaaagtgttgttacaattgaaagtttataatttagccttttttcacagtcgatgaatgattagcagtctgtctaccctcttagatattttaggtacactttgtttcatatctcatagtcatactgttggagataatttagacatatagtaaaacttaaagagccagcttctttatatttaaggttatttctgaattatttttaaatgtttggcttgacttttcctttttggaggaaaataatattgcatgtgtcaaaactggtttcttggattatttgtcaggggaataatgctgctcttattagagctgttgtcttttcattgtcagttaaattgttttctgaaataaataggaatttaaaatgtagccatattttagaaaaatcactttgacagtgtccttttaaattagcatagttaatgtagcatacattgccagttttaccaaaaccaactcaagaataactgtttattacatgtgcttataattcacttttgcaataaaaatgcatatagacacctagtattttcttactatgatatcttaaaatgtaaaatcttcaacaaaacatgatcagtctcagaaactgcattggctggtataaaaggttgaatagcattataatcttttgcctaatgtggtagcataagcctggtttttttacccctttatagaattttgaatttggcaaaaccaacgtaattaagttttccgtctgtattatactcttaccttggtctacccatgatgtactctccttaatttttttctttataccctgtatgacctatttatatatgacttgtgcttaaataagatttaatagaaacttagatcccttgaaaagcattgccatattggtccgaatatagagcttgtcatttaaaaatgtatttggcaggttcagaaatgtggtttgaaattttcttagatgtaaaagttattcagttaaaagaggctagtgcttagaaataggaaggaaacgtacttgaatatatgggctttaagtgagacttgagaactgagagtttggacagcccttagagatgcatgctgtggaatttgattatccagacaggtgttgattaacagccagatcttgattagctcttctgagcatgtatagctcaccagggcctacatgacctttattttctgcactataaaaggaaaaaggattagaaggataatagttacatttgatattaagtaaaaatttggtatgcattgtattaagggatgtaaagtaagagaaattgtgtattatcaaatgacaaaaacctgatcagccttgagtaaggggctcaggaggcagtagtactagcatcttaggagtagaagagtcctgtgggataagtgaaagtatgtctttggtttgataacagtgagagctattaattttagaaaagtcgagttactttgtaatgtagttaaagaacaagggagaatgcgtagtgtaaaaaatactgttgagttagctgctcactgtatttcacaactgatcaatattcgggccaatatggacttaaagggctatgttttgaacacagctagatgacaaattaaatatgaatggtgaaggaaatgtactaattatttattcatataatcttttcttggcattgagttaaagtctaagaagcaggtttcagagattaggatactatcagaatttaaacttaatggaatttaatctctagcatgtcctaatgcagacaacttgcaattccagggtttataaatcataccagggtattaaagcacagtaatcagatgtgtcagtggtaaatatgtgtgaaataatgaatcatatgactgctctgttaagtatttggttctttattggggtgcatttatacccttttatgattaataagttagtatatatagttatcacagtaattatcttctccaaaatgtttctaaaaataattattgtgatcacttctgttattgcccagcgagagttggggatagattttattcagttaacactgtatgtaattagggttttttttatttcttcttcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggtaaaaaaaaaaccaaaaccctttttatttgtatgtatacatgtatgtgtgtttgtgtgtgtgtttataatatatgtaaaatatttaatgttggttaaaacatgccaaattgcttttgcttttagatattagtcttttgaaaaagttctactttcctgaaaattcaaagtgagggtctaatgtacaataaggtaaagacccccctattgtttcttatgttttttttatgaaatataatggtgtgttttttcttgtctgtgcttttgatttgtgtgttttagagcatctgaaaagtcaactatataaacataatagtgaaagagaaatttcactatcaaaagatttgcacaccataagaaaaacattagttacatagctactgaactaggttagtacactggtttttgctttggtctttctatgcctggccattttaccagataattatttcagtgaatttgaatttagtgtatttgtcacttaaggaagcttataggcttgggccatatacttcttttttggatatgttaaagaaaaaaaatgttttaggcttgttgtacccctgaagttggagcattgagaactttgtttatatttgtatattaaaattgttcccacccccaaattattaaattggtgattaccttttttccctctccaggaagtatttatccatgtagataatacgttttgaagggctttggatatcaggggctgtgtatgaatccctatcttgtcaaagaaattatttttttaaaactttattttgaatttttataattctagttattcagctgaaactgagggattctattgccagcttttatgtaattggaaagatttaaatcagcttgtgttttaaaaagtaatgttgctactgtaagcagatgtactgtaagttagtgattatgtttgaccaccccctccaattacatgggtatagctatttaaaagaaaaaaacaaaaacaagcaaaaaaacttactaatacaataaatgtccatgtaacaaaggtatctgttgcagtgttcattttgatttacattattgcacacacactgggctagatttcttttttaaagactctggtcttccaccccaaattctgggcctttgctcatttggggtattgatactgaacatatacagccaattaatgtattcaaatggagccctaagatccactttgcagtactagatgtgtagatttacctatctttagcctaatacctttcttcatttatcatgtattcttagtcgcaggagctgctcagctcctgatttctgttattactgcccaggcatcctcccttcataagacatgcctatgaaatggacacaaaaatttggaacacaacaaatctaagacttatcataatagttttttgttttattgttaagattttgtcatgtcctgtcatcttttcataggtaagtttcagatcagattcttgttcagctcttaactgctgtgttgtgctttagtgcctgtataaatggcagtaaataggttctacacagcttgcttagaaatcggatataaatgactttttagatgtctctatgattgaacagcaatctagatatgtgcttctctacctttctttaggttgtaaagaaagcagcctaatagatgcttagggaaggaattctggtcagttgtgggaaataatcaccactgggccagcattctgcattatagactaacatagcttcagcttgaaatctgatattttaatacacctctgattggaattagcaattacctgtgttattttctttttgtgacccccagtttcccatagttttagtggtggtatgactggcaacattgttaacaacaaatagacccatgccagactgaaaataacttgaaggatttcataaattttctttttgcatactattcatggaaataatctactctgcacttccctatgaatggatcatgatgcaaggctgtccaaaaaaaagaaaaatatttctttatgaatcaagtctcaaggctgatagtataaaagacttatggaaatggaatttgcatatttttaaagtaattttactgagctcacatatcaagaatatgaaatcatgagatagagataagttctctcaattctcattagaattggttggaattaattccagattatttttctgggagattttattttaagatgtgaatgttacaaccattacagttacctgtaaggcttgagatctgcatccccaaagtatgttcctttgttagtgttagttatttgagattcacagaaaatgccc

SEQ ID NO: 92971 - DNA, 1614 bp, Homo sapiens
tattttatttttacgatgtatccttttcattgttttatttttacggtgtaccctttttattatttttacaatgtatctttttattgttttatttttacaatgtaccctttttttggtaaactctattcggtgttttaatagtcctcatttcaggttcagcttacctggctatctgtagaaataaaagctttttattttagtgattcagtcaaatatactgggcttttttcccctttgaatgcaacgtgaaaccgagagtttgacttttaaaaatacattaatacaaataaagatgtcctaaaattccactgataacattttaggacatgtttgttatgtaagtcaggaatcatgacattttattcattactttaatggtgaagcttattgtgcataaaactatttactttctaggaatcaaatattatcttgaataaagtagactagagcaggaacaatttattcttattttcctagtttcccttctatttttctttctgcttatattatctagtgctttcttgtcttgactcagtttcattttcctaaccacataaatgctgacgtctcatttgttttcttataatttgcagttgttctgtgagaatcgtgactgaaatatgaaaaatattttaaaatttaaggttttcaactcaaataccattgtagcatgcttggtaccagaatgttccccagttttgtgttatagattggaaagtaaaatattttaaaagtatcttgtaatccatctcagtagtcaaaattctctgagagaaacgatgaatgagcatttaaaaaatcttagttttatggaatctgtgttccctgaatatattatctgtatagtgtcagacccaaaaattggcattcattaaatgttgaatagatggttaagtgtcctatcagtttattggtagccttgaggttggattccttgaggatggattctcatcttttccctttaagaccattgctgtcacccatcaatactttgtcttttattataaagacatgttcttctctaagtcttcttcctgcccccttttataatctgatgataggtagctaacctcatgtctatgtaaaatctagtaactttttattcgggggtcgggtgtggggtttaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggtaggccttccttctattaagtaataccaagtattctttgaaattctttgagctcctaatgtttaagatttgtgtttttcgacttacgtttcctcactgtgtaacacgactcctggcatacagttgatacgcaagtatttatgcatgggattttatttttcctaatcagtattatatgaatttaaaagatttggttatattcagtttctgtgtttctgttattttgcgatcttgaaatctctagcagtttctaaatttcttttcatcacttcatgttagtgtgttaataatgttcctatcaaaataattattccttcatatttttccaggtatttaaattacaa

SEQ ID NO: 92972 - DNA, 1357 bp, Homo sapiens
cactgaatccctagctcataatgtgactttataagattgagtgaaaaactactatttaccagtagcagttctggctctcacatttattttatgccagtctcatgctaatacatactgtgcagtcatttctttttgaatttatatttttattttctataacatacctcgagacagtacagttatgtcataatcggtattacatttaattctcacagcaattctgcaaaacagctgtttcttaaatgaaaactaatttagagttagcggtacatgcccaaggtcacttagtaaaaatttgaaccattatgcacactctgctccccacccccacaccaccccagattcagagtagaaatgtttttatctaatgaaaaaaatcatactttacattgttgtttattatttctccccttttaaaatatagctggtgtattctcagcaggccttgctccagctgcatttgtgccaaatccatacattattagtgctgctcctccagggaccgatccgtatactgcagcaggattggctgcagcagctacattagcaggtaacatactatttgttcatctttattatggttgctttttaatgtatttagttttgggtgtaagctttatttttctctatttgggcaatttgaaattcctaagaaaaactgaaacattatccagaatgaactaaagtttccaggaagttagtactatttttcaactgtaatgctacagggaaaagcttaagcaataacttttcctcgtatacgtaattggcttacatttcagctttatagttttagaaatctatatagtcaaccatgaatctccattttaatgacaaaccccattacccgcagagacaatgcaaagtaaaattacttctcagaaaataaaatagaggtaggtggcctgcatacataggtcaggggtagaatagagtaagataaacagatacagtaattctgagaaaatatgtatctaaaatttcttgagcaatgctaaaatgtacaaacaaggtgggggacaaaaagtttggatcaagttggaaagaacgtactaaaaactgcccagcctgagactaccacccagaatctgaaataaaagccaaagctggccaggtgcagtggctcacacctgtaatcctagctctttgggatgccgaagcgcctggcctgggtgacagagtgagactgtctaaaaatgaaaacaacaacaaaaaagctgtatttattgtctgtgtaagtaaggaaaagttgtgtgctgatcaggcacagtcttatttgaacaaagcgatttgctgatcttagttggggttcttgggaagagtttgttttaggttgaggtggctacaaagacagaaa

SEQ ID NO: 92973 - DNA, 1248 bp, Homo sapiens
acggggattcaccctattgtccaggctggtctcgaactcctgggctcaagtaatccacctgactcagcctcccaaagtgctgggattatagacatgagccactgcgcccagccatttctttcttattttaatgccttagagtattttaataatattggacttacgtaatctttaaagatgtggcagaactttcatgtgtgagaaacctaatataaataaatttgaaaacctagaaagcatagtgtatcaaaattgaccccacattttaactcaattccacagttaagcaaattcattattgacaatcttttttatccaaatttgcctggtcacctcttagctggccaatagctcatttagaaaaggactagtcgatagaaatatgtataatatgtaccatataatttgcagttatttagtaatcacatttttaaaaattaaaaaataggtgaaattaatttgaatattttatttagctcatatccaaaatattgcaaaatgtagtcaatatggaacttactaatgagaatttttgcattcttttctttatattgtttttgaaatatagctgatctcaagtcagctttgaatatagctgatctcaaactagtcacattttaaatgcacagtgactatatgtggaaaatttttagagtgtgagttgacaaatgtcttctgtacaaaaggctgttgaatatttaaagctttgcataccatatgggtttggtcacgaccactccactgtgctggtaaagcatgaaaatggttattagatgatgcataaatattgctatgttccagtaaaactttacttatgggtgctgaaataggaatttcaaataattttcatgtgtttgaattttatttttttgaaccatttaaaaatattaaaactattcttagctagtttgtacaaaaataggtaagacgcaggcttaacccatgtacttggccagacagaaataatagataggatagaatgaaaacaaaaagacagggttatgtagttggttggagagttcctagagtacaaggagttgagggagaatccataggggggtaaattgggaataaagccaggtgacctacagatggctagaagaggaataaacaaacaaaaaggggcctatgcagttcaggctttgggggttgagttgtagtaaccatgtaagagctcccccagctactaataaaagacctggtttggagatttgaccctatagtatgtagtttaggcaataattctga

SEQ ID NO: 92974 - DNA, 1359 bp, Homo sapiens
gccagtttttctaatgtgtaaaattgcattatatctttatgttattcagattgaagggagtaatcattaataatatttttaaaatcctcaaatcatgccagctgttaagaggaaagttatattaaatagaaaaaaatgtgataaggtggcatagtgacccagaatgccttattcattgtgttttatgaccatttgtttttcatgatttttctattttcccatttcgctatttgacttgttacttttattcataatgcttttctattttctttatgtagtcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcaggtaaaagcatgttctttctttaagaaggtcctcttaactgtatactggtttagcctgaagtgctatgtggcattgaaaagaatggtaggggtttttgagtactaaatgttttattgattaaagtgtcctgtatttgagaaagtcctcccaaagaaaaaatgtttaaaatgttttattcagatttctaattagaaatgaaagattttgacactaatctttgtgttaaatattttccctaatagctctttcagaggactaatgcactaacagttcaacagttaactgcagctcaacagcagcaatatgcattagcagcagctcagcagccacatataggtgagtcttcatacgttctcattttgaccaaagtcttgttaaaatgtctaggatgtttcacttttcgtttactgattggtgaggttttgttactttttgaaacatctgagatcaacaagtaataggttgtatgacaaaggtgtttattaactagggaattgtttctgattattatttgcatcactggtttaattaaataaaaatctgtaattcgataaaagttattatcacataagtttttctccaatgtgaagttgagaaagtcagacacttggaaattcaaatttacttgtgtccattatcaagtcagtatgttcatttacatttttttgtaaaatatttttttccatgaagttatttggtctttgacttttaatctgctagaattcaagcttggtacatgatgttgtctgtactaggtctccccactacctcccacaataataatatgggaataacttccctatacccttt

SEQ ID NO: 92975 - DNA, 1320 bp, Homo sapiens
agcctttggtcttagattagacagtatatatttatctatatattagggagttgtttctttgtattgattttctgtagtatttcaataatgaggtgctttggagcttgtatctgaaaatgagttgtttctttgaggtcttatgaccatggaatcttacataaaaaagtattaggtatatggtgggtggtatacttttacatttattgccttcaaaagcaaagtaacaatgcttcttaaaaacagtgccatttctatctgttctgagtgcaaaaaagcatccaaaaccagtaaacctcttttaacaagaaatacatttaatgctattcagatttagaaatttatttcgagtttgttcttcactattacctaatctaagttttagtaaaggaaatgcatgtaaaattaagtagatgataaacccttcagagtatacatttataattgaagtgttaatacaccattaactatagcaagaaaatagcaccactgatagcattactttttttcctaatgtcctctatttttgctatatacgagttactttgtgtgagaggttatacgtctcccctgaaatattaatgtggactttacatttattagcattctaattttattccattaagtttttaggtatcttttaaattactaattattttagatacagtattagttactacttgacagtattaaaatgtgttaacacaatcaacagctgtggtcatacggtcactatgccagcacatcattaatttctacattaactaatatgtcatcaatatatacattattggagtagaacagaaatgagtaaaagaactattggacacttattttttaaagaaaaattggctgattttaaagaaaatgcttttagttttatcttttcattccatatgttccaaatgaaaaaagagcctttgggatgttcacgtacaaaattaggtgtggcttaaagggaaaggagtttgaaatcttctgattttgcaaggacaaaatggttgatgtttaagtgagtgtaagtttgcttacatatctacagagaacaattcttgtaatcaagaaattgctttgtaaactactctatatgttagcaaatttattccaattcagaccacctgaagttgggaagagttagctgtagcaactggcattaaaagccaggtagaacagttactgccatttacttaatgtactcaagtttgaatatcctgtgaatgcatagttactctgaacaataaactctttcttacaaaggaaaggatcctatataaaacatttatgtataagataagctataaatgaggattgataatgggctag

SEQ ID NO: 92976 - DNA, 1890 bp, Homo sapiens
agatgtgttatttctgaggcctctgttctgttccgttgatctatatatctgttttggtaccagtaccatgctgtcttggttactgtagccttgtagtatagtttgaaatcaagtagcgtgatgtctccaactttgttctttttgcttaggattgtcttggctatgcggactcttttttggttccatatgaaatttaaagtaattttatctaattctgtgaagaaagtcagtggtagcttgatggggatagcattgaatctgtaaattaccttgggtagtatggccattttcatgatattgattattcctatctatgagcatggaatgttcttccatttgtttgtgtcctatgaagagctttatataaagattatagtaataacattcaaaataaaacaatgtgctgatttttcttacttcagtatattaatttaactacattttgtttaacttaaaagtataagtatataattgtgttttttcttccaaacagaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttgtaagtattttgaataaagaaatatttaatatttgcttgagagttatttggttacgttacttttatttttaattcaatttgtttttctgtgcccttcctatagctaagagaaattttgtaactattattgctattcttctgcttagccacttgaaaaacgtgaaatgatagaaccattggaaatatgtataatctgaaccatgttacaaaagtcaaatcatactaatttttaaacataatctgtaaaattaaaattgcttattcctggtagtgcttgatctgaaagtaactaaacaaaatcgtctacgcattaaagaaaattttaatctagtttgtggtgttaactgcttttccagcaccgctatagttaaggttgccttagcccttctgttataaatcactagtttgtacgcaattttttggcctttgataaattaattgactacgaaattaaataagattcaatgcttttattgtttacatgcactgtagtgtagtgttaggtcaccttatggtgccttttttttgtgttctattaaatattcagaatcaaacagattctttttcctcagggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaagtaagattttaactttctcaagaagaaaagcgtatctttttagggattattactattagttgatgtgactgatttagacattttcatcatttaggtttatttcctttgaactttgtgttaatctggacaaattttagttttttactataaagaaaatttgtgattatgaaccattttaaaaaaataatcttcaaaccagcctctgaaacagtgcattctgttgaaggagtaatgttagaagctgtgcttacttttctggtaatataatagtctaaatttgaactttttcctctctgttaaattttagtgaactgtaggtttactctgatttttttttttcccctcttgggagtgcttttgagcacctttcagtggagttttcttccttctgagtatatatgccctgcctcccatttaacttttaagaggagacaaaattagcttaggagcagtaatctttcttaaaa

SEQ ID NO: 92977 - DNA, 1026 bp, Homo sapiens
caggagtttgagaccagctgggcaatatagtgagaccctgcaccttcccaccaaaaaaaaaaaaaaaaaagaagcacacttcctttggtggcattgatttgaagacttggaaggattgatgcccatctttcgtacttttgctttttttttttttccttaaattttactttttcctttaagctctgttagacttgaatgcccatctttcagatctcatagtatcatggattatatttttgttaaagcacttttttctattctaattgccttttattaaacctgtactcttgaggacaaactgtgttgttctcggattcctcatgtatagctcattgcttagcatacaagagaatgaatcaatatttcaactgtgtaatgaacggatacatgactgaaagaaaggatataatgactaatctcctggatgcacatactgaaatggaaatgttttgatttggtttaacaaacctggccatcatttcaaaattattacagttaataaaatgataactggctaccagtatgacatttcagcctcaatagtttaaatattgagtatttatacctgtcacaaacaagtcagaggtagctggtagcttaccggttctttcaaaaaagtttccagcaaaaactatttgaatgttgcctcaaatgtattactatatttgcattccattaactctcagatcttaaatactacctttacttttcattgcaaaagtatggagaaaaaatatatcaaatgaataattttgttttaaaataaattgaaaaattttaagatagaagataatttagtttttttttaaccaagaatagaaaattctgtggtattactgatttttctggacttactcatttgtgattatagcgttatagtcgtgagttctgatctatccagtgcgtaactgtgaacttgagaagtgtttctgccaaatcgaaagtttattttattttattgttattttaatttatttatttgcagtggggagcagggtctcatgtcacccaggctggagtgcagtg

SEQ ID NO: 92978 - DNA, 1025 bp, Homo sapiens
ccattacctttagcgaacacaggaacagaaaaccaaatactgaatgttctcacttatgacgagaacacagggacacaaagaggggaacaacagacataggggcctccttgagggtagagggtgggaggagggagaggatcagaaaaaatacccatcaggtactttttttagtacctgagtaatgaaataatctgtacaccaaacccctgtgacatgaatttacctatataacaaacctgcacatgtacccccccaatctagaataaaagtttaaaaataataaaattctgtattttcatttaaaatgggggatagattaatttaaccatagaaatttttagtcttaaattgtactaggtgatcgtgactgatttatctaattgcagctcagcctagctttattagatatttgccacacccaggaaggaagtagactgtcttggtaagatagagctcccagaaagggagcagatctttaaatgttttgatttcaacttcataagtagtggggagagacttaggtctaagaaactgttaagggaaaattaactggtgtataaggagtataacatgcaggagtgacagtgttggcaaattaaagatcatagttaaatgctttttttttttcctttttaagagggtgttgctctgttgcctaggctggtgtgcagtggcatgatcttagctcgctgcagtctcaagcttttgggctaaaaagatccttctgcctcctcttcctgagtagctaggactacaggctcacaccatcacatctggctaattttttttttttcccctgagacagagtctcgctctgtggcccaggctggagtgcagtggcccagtcttggctcactgcaacctccgcctcccaggttcaagtgattctcctgcctcagcctcctgagtagctgggataataggtgctcgctaccacagcctgctaattttcatatttttcgtaaagatggagtttcgccatgttagccaggctggtctcgaaatcttacctcaggtgatctgcc

SEQ ID NO: 92979 - DNA, 2712 bp, Homo sapiens
tagatttatgttttgttgaatatttacgtgaatcttttatgatgagatttttaaaatagaaggaatacaagttatagtttacttactgggatctttgttagagcagattattgtttaaaatgtctgctctttataaataccagtcatttacagcccagggccatcctagcatttaaaaactttttttaaaaaaatggagttttttttttaattaaaacatttaaacattttaattaacattttttaattaaaacatttagtttagcaaaatatatgtaattcaggaacatgctcaaattgaatttcttctcttccctttaaagctgcctctcctggtttgttgttgttttcctattgtggtcaatagcagtaccatttacctttttagctgtttaagttattaaacaggttattctttttagttatcttccccaccatttgtattcagatccttttgactccaaggtgtctcagatccattttattttctcagctttctctgctagtaccctcttttttgtttgtttgttttttgttttttgagacagtctcactctgtcacccaggctggagtgcagtggcgcaacctccacctcctgggttcaagcatttctctgcctcagcctcccaggtagctgggattacaggcactggcaaccacgcctggctaatttttgtatttttagtagagacaaggtttcaccgtcttggccaggctggtcttgaactcctgacctcgtgatccacctgtctaggcctcccaaagtgctgggattacaggtgtgagccacctctcctggcccagtaccctcttttagttcttgctctcttggccctcttattgtaaattgccaaaattcatctccttgttctttctatttgttattcttaaaacttacaacttgagttttttgtagtacatagtgtcacccttgctaactcttctctattccctgttgcttcagtagagcatctaacttccttagcatgtctttaagggtcttcataatctgatctgccagcatctgttagctttgctagcatgaacttttgaccttcccacatgtttcatcttacaccctattctacacactgcattttctcaagttttgcgtttattaatggtttactatgtcacacacacaaacacacacatcttatctcagaccaatttcaggtattactgagttatatttattatagtttatatgtttgtgagctctctaaaggtgagcagaccatgcccttaagaggtaaacatataggtaattgagtgtgataagtttaatagaagtatacacaggttttattgttagcactgaaaagactggacacctacttaagagttgagagtgatggtgtcttatgaatgcttctttaaaatgctaagttcacttctcagaaaaccagtctgttcttctcaaacaaacatatccaagttggccacctcctaagcgacagggacagtagggagatatgaatgaatattaaagaataagaattgtccaaaatgttcattttgagtaatcagtgaatgattgtatcaacacaatttttatgtgctatgcatgtcacagtataggatagagcacagggccttgagattgtttcttttctatgcatgttttctaccatccatagctttttgttatgggtttgacagatagtactcagcagctagtaagaggtgtgaatttcacttccattgaataactgagttaaaaatgaaaaagtattttctattctagaagatatgataggaggtggtctagggagaggacttggaagtgaagggaaaagttcagtcattcctatggatgtgcttattaaatctgttactgagtaaggaatttaataagccttttgaataaatttacattgtaataaaaatgtatgaaaagtgaagaaaagtcagaagtagattttgatttttgtttaaggtctagaattactagcaccagcacacaaaaataaatggggagttaatttactattaacaaaacagcttagaaaataggtcactctgaattttcattagcattgaaaactaatgtatacatagcagtgatatgtttgagacttcttatatattaattctttgtaattagaataaaatttaactgtaatttttcctccaaatagcttttgcctaccaaaaagttttgggaacctgatgattcaacaaaagatggacaaaaaggcatatttcttggggatgatgaatggagagagactgcatggggagcttctcgtaagttactggtatatgtgtgagaattgtgaatatatttagcattttataagtcataatgcacctttttttttagagtgagtctccaaatttttgcattttttgtatagttttgcgctattgcccaggctggtctcaaataactgagctcatgcaatcctcctgccttggcctcccaaagtgctgggatggtaggcgtgagccaccacacccagccctatgcacattttcttaatggcagctaagaaatgtaattttagaagtgtttgtcacagtaagattttatcaagggtttttttttaattgattgtaaaattctgtggctattattaaaaaataagatgctggtgaggttgtggtgaaaaaggaccacttatacactactagtggaaatgtaaattagttcagccattgtggaaagcattgtgtcaattcctcagagaagtaaaaacagaattacc

SEQ ID NO: 92980 - DNA, 1013 bp, Homo sapiens
attttatatttatttatttataattattttattttttaaaagagacagggtctcacagtgttggccaggctggtctctagctcctgggctcaaactatcttctcacctccctcagtgctgggattacaggcatgagtctctgctccctgttacaacttagttttgaggatctgttcttacctcttttgaacttccattataagtagagtgactttacattctgatttgcccaggacagctcagatctatatcttctcatggcatgattattaatagcatcttttttcactaaagtatcccatttgggatgataaattatataaataatttaaaacaatttacattttaaatccttttaagtcttgggattatgtttatttggttggtttaggggttttccataacaatttaaaaagtctgaagtataggtatactcatgtaaatgcctgagtgggagtttattttatttttttttttgatgcagcatgcctgggtgctgataggtttctttggaaatggggaaagcaagccatacatttgaaggaaaagacactgtatattccctcaaacactggagttaggatagaagagcagattgataagaaacactgagttgcctgaccttcttttagagtttgtgaagtagggaactaatatgaagtggtattggataacatattttatagatcttaacggtttcttaattttgttttctgtaatgttgtatggttgctctttctactacagtaaaagattctccaggggcaaatctcctatttttattgctgttctaatcaatgcattgtttaacctttttttttcctctttaactgtgttctatcctgaattgttgccttcccctacatttagttcactttaacctattattagtcaccagctagtagatcccctaaaagtatttgagtcagtatctaaactgtcagagcaaatagtttttagaatatcagtgaaggcctttggtagagtgttaatttcaactattaaattttcct

SEQ ID NO: 92981 - DNA, 1038 bp, Homo sapiens
actgagatttctgtctctgggttctctctcccacaagcctttctatctttcctcatctcacaggcagcaaggaaccttctgggatttccttctttgcctctctctctcaccagtcttctcctcctttcctgacaggtgaggtttttttgtttttgttatatcccagaattcattcattggaataaattaaaagcagccttgagtttctggctcttaagttttctaaaaatgcttttttttttttttaatgcaaaacggtttttaaaatagattacccttgtcttgactttctttaaaaatagtttttgcttactgttgtcttaagtgttgtaaatctctaatgtacaaagtgttacatctacatgtaggactaatttcaaatttactgtgttttgtagatcatgatgtctttactgagccatcatcagaaggcatccacaaataagagatttgtattcacctattcataaacttaccctctctgtttttacactgatagcatgtttctgtcgaaagacctactgatttgcattatgtcatgtggcttaaaaagagcaaaactaatctataggagattgaactctgctttattagtgtagtgttaagtcagacacactgcataggctcatacctattagcttctctaggttgttggggcacatatagctgggtttctgcttattttttaaataacaggaaagagggccctgtctgaaattcttcagaaaatccagaatctaactttaaatcactgaattaatatcttttattttgagaatatctttatagcttagtatgataagcagtgctctctcctgtctttccaacacaataatatataaagaaagcattaaagaaagcctgtgtactaagattctatgtagtgtggtgaagtggaagacttactaggtaggggaggaaggagacttgtgttttctcctagatctctccctagtgttatgaccttgagtaagactgactgactttaaaaataataataagaataaccttttgtatgaatcacatgtatctctgaaa

SEQ ID NO: 92982 - DNA, 2328 bp, Homo sapiens
cgtgtcctctctgggattccctttcttactttccagcagctctggttgctctagactgtgtcctttggtttcttcaggccattaaggctggattcttaaaggaatttaaggaccctacttccacatctaggccttccctcgggcagaaatgccatttaaaaaaaacaaacaaccaaacaaaaaaccttactctgtgctactcctttctttaaagtatagactgttctccagtttctgggctttaattgtttttcattgccttcacatagttgttggcacacagaataattcaagaacccttgacctaatgtttttctacaggttttaaggtagattgctgtcataaactgggaaaacctgtcttccctacagaaatcagtgcttccctttctcagatcatgctaatattagtcatagcagcaatataatataaaaatagttgaagaagtctgtttaaacatttctttgtactaatttttgtttttgttattcaacaggtttgatctgtggatgaaatgaatcatgattttcaagctcttgcattagaatctcggggaatgggagaggtaaatgtttgcaaatactaagaacttacacctcactttattttgagccattgtaacttattttttttttttaaccatctcccttcctggaaatagtggtcatatcttccaaactatatggaggggtttaaatttcagattgtacaattctgttgtgatttttagctttaaaaaaaaagcttttagcagtaatttttagtgtgattatttgtgtctaggtgatttgattgacttggtgagataatttcttatattttggtaatgaactataattagctttgcttgaaaaaaactctttagccttgttctgctgttttatatatgtatgctgtgtttgctttagccatacttgttttactattctcccttccaaaaatctcttgttcacccaaaactgtttacttaacaaacttctaatcttctacaagactcgactgggatgtatctattgtctagttgctatctgccatagaattaagcccttcatctggcttctagttcttcatacagacttttattatattgctggttagtttgttttacacttgtctcccctgtaaattattagctttgaatgcctagcatagtaggcacttcgcatttcttaatggattttatcattctcgttaatctatgattttctttggagcaccaaagttaacctcatcattatatattttaaggcatcaaatacttcatttttcatatagctaatgaatacttagagaactttgattatggaaactcttgtggtgacatctgtattttgtcatgttctgtactactaacgtagactttgataatagaagataacagtgaacagacctaagatgtgtaattaactgcttgctcctggagattattttaccttggtagaatagagaccttcatgagactcactccatccaatgctgtgctcttcagatgcagaaaagagtccaagtctctcctttgggccacaagagggcaccctgcagctagctaaccctccccttcttcagaacagcgttttccaaagagtatgtcattttcagaggactgatttaagggtgagttaaggtgcttaagcttaagtattgccaaaataaatttgttagaccagtgcataaggtaaaattctcaaccctaagaaaaattgaagaaattgaattttttttgtaaacaaaatctgtagcttcactgcagtgcaatatctggttaggcattatttatgctattggcaaataagaggcagatgaaaagggcttttgttctttcctggccactacttttctttgctctttaaaaagcagaataacatatattaaaagcagggttgaacagtgcttcaaccttcttgtctatgacaaacttgaacttgctgataattctttaagagcaagagagtcaggctgggcacagtggctcacacctgtaatcccagcactttgggagtccaaggtgggcggatcacaaggtcaggagatagagaccatcctggctaatacggtgaaaccccgtctctactaaaaatacaaaaaattagccgggcgtggcggcaggcgcctgtagtcccagctactcgggaggctgaggcaggagaatggcgtgaacccgggaggcggagcttgcagtgagccgagattgcaccactgctctctggcctgggggacaaaccgagactccgtctcaaaaaaaaaaaaaaagaacaagagagtcatactcctacattaattttagactccctttatcacttcttagatgtatattgtatatatgtttt

SEQ ID NO: 92983 - DNA, 1879 bp, Homo sapiens
ctgtaggaagaaaaaaatgtggattgtattgtatgatttttataaataccaaaaatgtatacagattggaactacttgtatcttccattttcttgaccatgtcatttttaagttagtttattaagaacatctccatagtagcttatcggtagttttagcatgattacatgcaaaaacattcagttatctatgataaaacttgaatctttaaaaccaattcaacatgaacagaattatgttttgaagttgagaggatagtggctccaggttttgcctataggtgttttcttggaccacctttcaatggaagtgtaatttattactttttttccaaaggagagtcttaggtgccctcgtcttaatatctaaattatgtgcatcctacactagcaagaataggagtgctctacgctcttgctaaaggtaaattgtttgccagttctttcagaatcgtggttgagaaaatattcatggagtatggacattcagtccatttgtagtctgaatattaaaattgtgtcttttcatcacgctaaaatacctgcacaagttttttggagacagagtttcgctcttgttgcccaggctggagtacaatggcgtgatctcggctcactgcaacctccgcctcccaggttcaaccgattctcctgcctcagcctcccaagaagctgggattacaggcgcccaccaccatgcccggctaatttttgtatttttggaagagatggggtttcactgttggccaggctggtcttgaactcctgacctcaagtgatccacctgcttcatcctcccaaaatgctgggattacaggcgtgagccactgtgcctcgccccacacattttttttttgagcgttgcagatgtatcgtgccacactgtccttagatgctggtgatacggtgatatgtggtccttgtttttaagacctttataggaaagtggagagaagattaaacttgtgattacagtgcagcatgctagcctgccactgaggtggtattataaaagtgctgtggtgtgggcacgtggcccatgcctgtaatctcaacactttgggagactgaggcgggacgatcacttgagtccaggaattcaagaccagcctggccagcatagggagaccttgtctctaaaaaaattaaaaaattagtctggcatggtggcacgcacttacagtccaagctatttgggaggctgaggtgggaatgaggtgggaaggtcacttgaatccaggagactgaggctgcagtgagttgtgatcgtgccgctgcactccagactgggcgacagagggaggccctgtctccccggccccgccgcaaaaaaaaaaaaaagaaaaaagtgctgtggacacatgtaggtagagactgcagggacaggaaaagctttccacaagaggtaaagcggaatcttcttttcttttttttttttttttttttttgagacagagtctccctccgttgctctggctggagtgcagtggcactatcacaactcactgcaagctccgcctcccgggttcacgcccttctcctgcctcagcctcctgagtagctgggactacaggcgcccgccacgaagccctgctattttttttgtatttttagtagagacggggtttcaccatgttagccaggatggtctccatctcctgacctcgtgatccgccggcctcagcctcccaaagtgctgggattacaggtgtgagccactgtgcccagctgcggaatcttaaaatgttatagaagttaatttagtcccgagatgggtgaggtggcattcagccagagggattaatagccgtagtaatcctgatagggtagaatgacaagagtttaaggtgcagttatagggaggagggtgacaaaagaga

SEQ ID NO: 92984 - DNA, 1037 bp, Homo sapiens
gtcactttagaataaattctcaggcattacaaatactgtatataaattaccaaataatacttggattttgtttctctcaagcattccatacttgtttatgaatctttttttcttgtttgagacagggtctggttctgtcgcccagactgcagtgcaggtggtgagatctgggctcactgcagcctccgcgtcccgggctgcaactgttcttccacctgagccttccgagtaactgtagctgggggtacaggcgcacgccaccacgcccggctaatttttgcattttttgtagagacagggtctcactgtgtttcctgggctgaactccgatctcaagcgatcctcccgcctcgccctcccagagtgccgggattacaggcgtgagccaccacacccggcttgtttataaacctttctggtgtggaaagataatttgccttccggagtaggtacttatcttagttaacaaaagtaattatgaccagagatttgggccaggtgtgaaatccacagccaattttctcagtgaccaagctgtctcctttttatagaccctaacatgatctgcatagttttaagtggaggttgattcctgtctcctaaactcaagttctacatacgtcctaacttaaataccttgttgggtttccaggatatggaaatacttgtattttttcatattcttaaaatttacagatatttaaaatatccgaatatttgagtctcacatggctttgtctacatggctgcaatcacagcttgagaccattttactaacaggtgtgattaagataaaaattacacttatagccaggtaaattggtctgtggcatattaagatttcttgctttttttctttattattattattattattattaatttttaatataggtgaggtcttgctgtgttgcccaggctggtctcaaactcctgggctcaagcagttctcccgccttggcctcccaaaatgttggtattaaaagcatgagccccggtgccagacccttgctgtttttaggaaatgcattaaaata

SEQ ID NO: 92985 - DNA, 1986 bp, Homo sapiens
gtccggctcttgtgggcgccagcactctggaagcgaaatgccaggagtaccccacggtgggcggcgcgggcgcagacacccgcacacccagttgggggaaaacagtgagcaaccgggtaggaagccgagggtaagaagattcagaaggcgaggccccacgcgggaagacagtcgaacacagcgtttggcaacagtacgcctgcgctctccgagcccgccgcggcggagcccaggagggaagcgcgagcccgcaaggtgagggcgggggagggcacgccggagaggcggccaaacacgtgagagcgcggagaacgtgcgcacgcgcagggcgcccccggcccgcgcggcggcagcgcgggagcagggacgcaaggcattaaaaggagccgcgccttggtgagcgctccccctcccctttctcccggggtgcactgcgcgcgcccggtgggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcagcgcggccgcagcagccctgtaagtcagtccgcgttcgctctttctccggtcctttggcgccgtcgaggatggctccccaggctttgtgcggcggcctcggcgggagccgatcgccagcgggagggcggatagggcctgctgagtgcccgggccggtgcggcctggggcccgctcgcacaatgcagggggaggggtgccggaagggggtgtgcgcgtgcgggggagggggcgccgcgccggccgctttcccgcttccttccctctgcggggccgccgcctcgggggcgtggggcgccgacccggttctccctccgattcggcgcgctggaggttagagaccgagctgtcggccctagggttcggaaagaggggagaggccgggtggccccagagaagcatgcggattgcaagtgggtgaagaggaaggagtgggtttatgaaaacaagtgtgggcattttcaaaggcccgagtgtgtccgggaaaagcttgccgtggacagatgtgggtatgaagcagtgacttggattcgccttgtttaggttataggaacggatttcgatattcagaaaaatatgtaaattaaaaccaaagacaagattagcggcttctactatttgagcagtagttttgtatctgaattgggtcaggttttggggaaaatgtttaaagtttcatgcccaaacacgtgtaaaagttagtgttgtttctgaaaacacagccagagaaaacctacttaacttagctttttattctaacatacgtaaacttttgaagagaggaatgtattgccagcatattaggtgcaataagacatcatgttaggacttagtactttgagatttttacttgttgagaaaacggggcagatgttttggtgaaggaaaacatgagaaaaatgcttgtaaacggtgaagagaaatgtaatacctgtaaaggtactgtatgtcaagaaaacaattttaataaagggagttaccgaaggattttaaaagcttgtttaatggttagatttcgtgtttaacaggtgactcttcaccatgtgacctggagtattggaagatgacttaaggaatcctgtaaataaaaaaaaaaaaacaaaaatgagtattttcaacttgtttctcttcctagcctccttttaaacaatgatttacttcatttgctcaatcattatgaataaaaatgatggcattttccgtgctgcaagaatttctttaaaattccgatttttggtgaaattgcattgtgtagaattttcttggtgtgcatgagggcagtttttgtatgcagaaaaggtt

SEQ ID NO: 92986 - DNA, 1036 bp, Homo sapiens
ctcaggtttaatgcacttttcattcattcctcagaatgaactgaatgtctgttcaatacatttattgggggactctaggtcagctgggggctgaggctgcaacagtgtgaaccgatccaagtgcccaaaacctctgtgtctagacccttccctgcctatcttctccattgggcctcacccatgcagaggccgagcagtgaggagtcccattttacagacccccagtgattccccatttccagttgcagaagccaagggttgcagtagaagccccagtgtagtggccctcagtctgggccagagtcctgagaacccaggaactaggcagggttggggcagtgggtcctgaaatactccagctggattgatcagggagtagcagactaatgagatctttaacttctctgcctcctgtctgtggttgctcctgctgagaattcttctccttcctagctacctgaatctcttccattcttcaaggagagcccagcttctggtcctcctcattccagaagctttggtgatcactccactcttctcccagccctgccagcccccttgtacctctgctgctctgattctaattaatgaccctcacagcctcccagcccatctgcctgaatgagtgtctaggctgtggggggggggggggggcgtgagctcaggaggaggggcacctggcctgactcatcccccagggcgtggcacaactccttgctgctgggatgagctcaccactgtgctgtggagcttgtcctggtcacctgagcaatgcctccctggctaacatgtgcccccttctccctgaccctgcagcagaacctggtgtgggcactagtgagggccatcccccctggtcaccagcctgtatatcctggtcaacctcagttacctgctagtgctatcacccagtgagaccctctctgctgacgctatggctgtgaactgggggtgactgcatcacacggtgtgtcctttggacaccgagcagactttccaggctggggaaggaaagtgctccctgtgtatttaaact

SEQ ID NO: 92987 - DNA, 1990 bp, Homo sapiens
agctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttcgcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaa

SEQ ID NO: 92988 - DNA, 1029 bp, Homo sapiens
caagtgtcagaggaagctgggaagttttggatcctggattgagaaactggcctgtgtttttaactctaggagtcatgatctgaatgtgaaattccaagggctacaaacacagaccatgggcttttatgactctgggtgacctctatcctctggctgtcatttggggatatttttcttctccttttaatcctgaaaaggaaagaaaaaatgttacaagaagcaagttactcatcactttgttaaggattgattccatttaattccagagcttgtttgacccttggataaacaattgaaaccttctggaggtacctaaaaggaatgcaagaatgcatttgccatttaatggtagaaaaattttaaatgggattctgatagtataaaaaatagtatttgtataagtgcttaaaaaatcacttgtaaaatatacgctcttcaataatggccaaatatgggaaactctgatgtttggtcacataaccaggctgattttgcaaatgggaagatccatctatccccatttacttaggttgagcaatcttctggctacaaatttcctccaaagatgtctagaatcattggccaaatggagatccagactaaatgcataagatagcaccaacataagttagccagcttgggttctctgaggtgggtttagccatgccaaaggagaattgttcaaagttttaactttatgggtaatggtagaagttacggattatatagtttgtcacctgccaaatctgcaagaacaaataaagatgaaatgcaatgaatgtataaacaactcaaagggaaaaagtgctaaccaggtttagaaagccaagagtttcctagcaggctgatatgacctaatctctttccatgacatactgaccaactggtgagtaatttcaccagtaaactaagaagtcagaatgtcaagcacgaccatgaagggggtaactggaggcagaagcagctgagccccagattcaccctgggcctctgcaaccttctcatccccagctaggtaatagaagagat

SEQ ID NO: 92989 - DNA, 1968 bp, Homo sapiens
ctggcattgcctggggtcttgttcctgtcacggggtggcagtgttatgctcagggttcctccctgtggttccctagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggcctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaaggtgtctttcttggatataattcttcatgttcagagctagttttttgttttgttttgttttgttttttaatgaaacagtagttttaaaggaaatgcaaccactattgctccttggccctgtcctgcctggcagaagcattgagcgggtgggactaggacctcagacccttttctgatagacaccaaagccagccctgagggagcccccggctgatggtgcgggtggtttgcagccatcagtgttgagtgtctcagctcctggcccgtgccaggacctgtctgctctgtcctgcatctgatcacgtccctctccagctgtggcgccctgtcctgagcagcttcccctccaccagtgctagagtgagaggaaacaggtggttttggggtcgagagctgactccctcctcctccgtcttaacccaggctcagagggtcagctccctccccagggctctgagccagctctgg

SEQ ID NO: 92990 - DNA, 1011 bp, Homo sapiens
tggggtttgtgccccatcacaggaggttgagccaggaagcaggcagggtgtccggagctccttccacagctggctccaggcaggcatccacccctgggggtgctgtgctggacacctccatactcacacaggctctctggtagtgccaggagttgtcctgatcagaggtatcgcctctctatccccacccctgcccggccctgccccagggcaagaagccgctgctcatgagcctgcctggttcttcctgttcattctcattcccacctccagacctctgctgtctgctcccttcttcagaattctctcccctattcatgccaggctcacccttctgaaaagacccaccttcccaggaggccttcccagcctgctctggcccaagggctcactcccttctctggacttcaacaccttctttccaggcctttgcaattatgtggcccctgtctgactgggctggggggtgtccctcattgtaggtggaggcactgcttttctgtgtcttatgcccacttgctcagcccctgtggctgtcagtagacatcagtacatacagccttcctgtacatttggaaactactttccttgtgttgtcttatttgatccttgtaagaatccctgtgaggatggtagagcaagtacaatcccactttatagaagagactgaggaccagggaggaggagtggcctgaggctgcctgatggaggagttgcagggtgaggaacggaagccagttctcctcctgcagtgctgtgcttctgtgtacagttccgtgcagcagtgccagtgacactgttactcctgcttgtagatgaggaagccgaagcttgtagagaccaagtgggtgctacaggtcttctgccttcactcacctgattccagcatggctgagcgatagacgtagagatgcccgttagcacaagggaaaacctcgccgtgacactggagtctaggtgccccagccaggggaacacaccccagagaaccagccacatgcaggccaagtc

SEQ ID NO: 92991 - DNA, 1044 bp, Homo sapiens
tcattgcccagtctcagccccagcctcctctgaggggaggaccccaggcctgtgaaaagtagaagcctgtgggtgcacattgggtgagaggcggtgaagggggctgagggggaggatccgcagcccagggctgctcagctagttccagaaagagagaactttgtgtgcacaaccagtctttcttttcacaatcatattttaacagtttatgtaaagaataattaaattatataattgcaagagcaggtataactggcataagcaagtttgggaacaaattaaacggactcatggcagcatgcagcccacccagcgagggggcaaagtgcagatgtcttggtgatggcctctctgccggagggcccggtcggcagctttcacagaaggaagggagaatgaggcctcagctgtcacatggaggtcaattggcagaacctgtgccggtgacagctcctatttcctgagtccttgctgtgtacgcagtaagccagactccttacacgctctcttatgtaatcttcacgacagccccctaaggtggatgctattttctccatattataagaaatcaagtgtgggacgccacctggctaagacccctgctctgcccctggcctggcctctccacttcatcagggactgtctgagcacttggctgggtgatctgcctccccacccagccccccagttctccccaggcctttacctccactggccacattctcagcagactcagtgttgtgcgtgtctccagctcccactccatgctccaggacacaggactgtgcctgggattcagaggaagccaggccgcctctttccaggaacggcttatgtgacaccaaggcatgcaggccctggaggctgtcatctgtacccctcattagcagcctcgggctattagacagccctgcaagtgcccgccaagcctgagtcaccgtgacggcttctggtatttacatgtccccaaggcccctggcatctgttcactctcatcctgtgtcctcgctcctgacatcccagcgggctggaagaaaccaggat

SEQ ID NO: 92992 - DNA, 1131 bp, Homo sapiens
acgatgaactgagttatgtaaatttagcaatcagctaccatcatggccccatctttcagtggaatcagaccaggccaggggtgctgtcctccccgctctctaccacaacgaatgtctcttagccgtttaccaaagccctcgggcgccagatgagtgtaggtcctgccgcagaaaggaattagagcccagtagaaattaggcagaagcaagttcaacttcatcagcatgtagaattctctcctaaaatcacagcccactctggaaaggccttcttcgtggggagggttatgggagggtgggctgcagggtggccatgagaccagcgtccaggggtgaggatttgcactgggaaagggtacgcggcgctcagggagctgcagcagaaacaggcctgagatctggggtcctgcggcacctgggcacagcaagtgccctgcagtcgctcctcctggccctccgtggctggccttgtccctgagtggggtcagcggccctgagggagaggcagccagagtagtgggtgatatggggacaagcctgtaatagtcactccttatcagcctggcccaacgcggcaggcctttcttgggctttattttggtaagggtgaggctttgtttgaactcacattctctgttgttctgagtaaccacacgtagtgccaaaccgagatggactttggtggtctgtgccaacctttggctgaagaacacacttagccgagcggctccttttttgggtaggaaaatgttctttgtggctggcaagtgctgccttgaacttcctacttacttcattagcagattgtcaggggagatgtgtcagctatcctgggaccccttggcggggcggggggggcgggggcagccccctccccagctctgtactctggggccctcacccctgaatcctgggaaagcttagcacctaagagtaatcctgccggcttaagaccctcccctgctggggtttctttttaaggacccgtgtgacaaggtgctgatgaatcaacgttatcacctctgtcaggaataataagtaaattttttgagagtttatgaaatgctgggaactaagttagcatttgcttgcatgatctcattatatctgtaagacagcatttctgaaact

SEQ ID NO: 92993 - DNA, 1044 bp, Homo sapiens
tcccagcccctctctggtggagaggcaggatagaaacacaagctgctctatgcctcactttgctcatctgcaagatggatgtacagtagggatctctctcatagggcttttgtgatgtttaaatgtaagatgcttatgacatgaaattgaaggtttgggagattttgaatggcttttcacatttgtccaagtaaaataacagagcatcacataatacgatatcgtcattatcactcagtgcatcctgtatgccagacactctctaagttctttacctacaaggtgattttattaaaagtcagttgttttaaactacccagtaagcacttggatagaaatgaacaaatagtctgagcccacgcttctcaaactatctgtggcaagggctagctcttttattcccagcctgtcacagatggatactttcacaaatacaaaagcacacttgggtattgtgatgatggcagcatgctatgaagtttctggatgcttgctctccctttctctacttacctcattgtggtcacacagggggcattctctgtctgaagaccacacttcaagaagcgctcatctaagccagtttgtaatggagtgattaccgtttgttctggaatcttccacatgcttaccctgggcacccatccagtccacagtccaggtgcccagactctcggggcaggtctctgtctgcagagttccttgccgtgcctccaactgtaaatggttctggctgtactggttctttttgaatcaccctgtgccctggctgttgtatcccaccgctcacccgggaggagggtgcagccatccctgcggcgcacacaggctctgggccttgggttcaggaaccgctgcccctgtcttgctctgaagctcccacttgtgaccactccactccaggcttccttggtgcccgtcagcccttggggggctgcagcaggcacttggctgcccccgaaacggaggtcaccttccatccacccagactcgccatcctgcttaggtcccaggagggacgagtttggtcccaggaggctgcag

SEQ ID NO: 92994 - DNA, 1036 bp, Homo sapiens
agcctggatatgctgggtctgtggtctgagcctgaggggagcagtcgggccagcagggggcgcccggcccccaccgtggcctgctctgcgggccgggctggagtcacagctgctgtcggagcctgtgttagcaatcgctctgggaaggggtccgtgtgcctttccctgagggctgttttcaggaaagtctggagccaggctcttgtgctgacaactgcaagcagcacctgtcccaggtgactccccactggaggttctgaaatccccccagctgcctcctggtatcttgacccttcacaggctgggcattctgggtggtgttgctggagccaaggatgtgtgttccagacacaccctgcaccaagggatctccccgagcccgagggcgtcagatgcccgcagcccctgcacgccagcactccagtggcacactgtgggcacagtccgggcctgggagcataagagtgagtgacccacacttcagtcgggggagacaggcccagtctatggggaaagcacagaggagcgaggagtgagggtaggtgccaggatgatggtgtgtgcatacagcaggtgatagaggagctaggagtgagggtaggtgccaggccgatggtgtgtgtatacagcaggtgacttcgctgagcacccacatggttacagacacggcgatggcactgaaaccactgtgagactgagagcctgctggggtgtctctgtacagagtgaacatgcagcaagagctccgtgagtgaaggggtgaaggcttagctgcccaggagctgtggggagaggccaaggaggcagcgggagtcagccgctggccccacgggaagctgagtgctgccctctctgagtcagatggtgctcaaggctgccttctgatgacagcaagagtcctggcctgcttgactcgggtgcctgcgtgcagagaggtcctgcctgacgcagggcagagaacaagccttggaaatatctgtctccactgcttgcattggctggcccgccgaaggccacactggttcacgggagaatg

SEQ ID NO: 92995 - DNA, 1054 bp, Homo sapiens
gacctgttgaaagagacactaaattttaagagaaatttacagcacaaatgtttcctttttttaagagataggatctccctctgttccccagactggagtgcagtagtgtgatcatagctcagtgcagcctggaactcctgggctcaagcaatcctcctgcctcagcctcctaagtatctaggactacaggcacacaccaccatgcccagctttttcttttttaatttttttggtagacatagtgtcttgttatgttgtccaggctggtctcaaactcctcaagctgggcttaagcaatcctcctgcctcagcctcccaaagtgctgggattacaggtgtgaacccccacgcccagccacacaattttaagggacattcaacaacgtcatgagaagcgtctagaatagcaatgctgtttttcatttgattgctcctgtggccgactcttggtgagaagcaacgtgtgatgtcaggggtgattctgggcctgcattgctctgagagtgaatctgctttacagggtgctttgcagctcctggtaatttgacttgatccaggttggagctcaatgcacccacattttcagagacaggagcagaagaggagagtatttgagcttgatgttgcggggcatgaaggagggagcattctgggaagcttgggcttcagccgcccagcccacttggttctgtgcagagggccggccttacatgcaaggtgtacatgagggtgttttaacacctccatgaatcacactagtgccactttttcctaggcagtgacgcccactcctcgtggagtgtgtgcgtgcaggggcttgtcagacatttgaaagtacttgcgagggcaaagaactcctttactccccatgggatctcaggatggagcctaaagttacatacccccaagcctgaagtctctttgatgtttcatgaattaactcaaagaattaatgagcattttgtatctacttaaaagggcatatgtgttttaatataaacgtgtactgatttgctgaccatggagtaaaacagccgcaggagggggcaccgca

SEQ ID NO: 92996 - DNA, 1082 bp, Homo sapiens
ccgaaaatctagttccccatcctttcagagctccctgagtcccaggcccggtgctgggcactggggacagaggcgaatcagacaagctcgccctgcagggggctgcagcggagagggggtgatgccagcagcgggtagtaagctcaggttgccatgggaacacagtacagggcaggaacccggtttctgggaggatgagtttgatgagagaccagggagaggtcgttgctgcttgcgaggcagctcaggagagcgcaagttacagcaaaagccttggaggggtccaggcggaggatgcagaatgggtcggccctgatcgagacctggaggacccagcccaaggtggatcctggcaaggctgggaggcacgtgcttttacttctttccgcctttaaaacgctgtaaagtgatttacttcaaatattttcatacacttcacccttgctctccctacacaaagtcttaggctaagatgccaatttatgacataaatgaacgtgttacccagccaactgttgatcttccagttgtaatcaggaattccccgtgacttcaggtctagaaaggtatgattccttttgtaaaccctgatgtcggaggctgcttggtctttcatgatcaagtgtggttacagttgtatcttcatgggcagaagaggtttccctactgccacttacgtcacctcctctcaccaagcctcagtttccttttctgtgaattggaggtttcagattggcaggcatgagcaacgtcagtagtatatgcccctcagccatgtgcagatggatggggtgtgactttggtgctgggtgcttgggatggggtgggtggcttccctccctgccccgctgcacagcctggacgtggcttgttaacagatgtgggggcgctggcggtggtaaggccacatgagtcaggctcatttcttgctgagggcaccagcacacccaaggatcttgcctgcagggtgagtccaaacgccttagcccagcagcaaggccggcccttcccagtcgcaccccagctcctctttccagcccgatctcctcccacatgtcattgccacatgcactcaagcttga

SEQ ID NO: 92997 - DNA, 1039 bp, Homo sapiens
catgaacccagcttctctgttgcaacccccagctggaatctccagtcaccatggatgggagaactgacaggcagggagaaagcatgtcaagactgtgaggaaaggctgtcccctcaaccccaacctgaggtcaccaaagtctccctcctaaagtaaacagaattttccattttgtagggagaattgtgcactactagttgacatcacttgaaccaggatttcctgctagtgagtaggatttggcatccctacttagggagctcgggacaggccagctggggcccaacgggggctggtgctgggtctgtcaaacacaatgatagcctggtcactgctgcttgaaaccagggctttcgtattaaggaggatcacccacactggcaggcgggcatttccactgattcccaaacacacttgccttgttgaattctgactttccaaacagccgcactgggtcttccagagaaggtggcaggctttgctgtgttagcttggggaagccaggcttgagctgtgctcagtcattgtatccatgctccccttcaccataccctcctggcaacgatatgaggtgtggattgtgtgatagaagaatccagactccacgaagccaaggacagtcacttctccctggcagctctcatggtgtcggcaggagtgggcgcctcaccttgggtactgaagagagtaccgataatcccgtggatggaacaggagggagtgtaattcaatccctacacattgtatatgctgttggcaatttcatttaaactcacagcagaaaacaaccaggatttgtagactgattttcttcttagagcagggagaaaaattacgttctttccaagagcagctcgtgcacagataaggtcagacttttcctgtgcttgaatctggtctccaggaaatccagtggcaggaagagagtgtcctgaggctgcctctgggggcacagaatcactgggcctcgctgattctcatgagaacctgtcatctcagtgagacaggcctcccactggccctcagtgggccataggcc

SEQ ID NO: 92998 - DNA, 1038 bp, Homo sapiens
caagtataacctaaaattcaggaatgaaggaaaaggtttttttgtttgtttttgtttttgtttttcggtcagtgttaggatttaggacaagaggtgattagtgtggtactaggatataatctctggtttagaagttaatagcgcaatgaatatcttattttttctaaagaaatttttatatttcaaaattaacgccagtctaaaaagttgcattattttttaaaatcatacaacacctccagttgtttttcactttggtgaactcagtgtcgcttaggtaagattatctgtttgcagactaaattgattatcgtaatgaccacagtcctggcttatagagaaatacataataaactatgttgactacgaaacatttctccaaattatgcagaaagtttagaatgggagaattatttttttaggtctagttttcactttgttgcaacttggcaccattggaaaggtggaaaacaacctggaaataaataaataaccgctgaagaattttcccttggaagaaggtttcatctgggtttctaagactatctggtcctacttaaccttttgacaaaccctgctggtatagcctttctgagtacccagccttactctgcctacagctgtgttggcatgtggggctgctcatgtctccagaatcttctagtcttgcagctcgtcctcaaccctaaattttgttcccacacagccctgcttgacttgaaccttcctaacttccctacactcagcacatcttgccagcctcaggaatagtcagaatatgtgctaggaggagctttcctgtgaaaggctctttttcagtcagctcctaccctgcctcctctcaggcaagccctggatatgtgcagatgccactttctcccccactcaagtaccagagcctgataggcagttaagcacatcagcccttgtgctgtgaccaaaaacacccagaatattcaaaggccctatttctattcacttttatcatctgggattgagtttgactatagataacagaaaaccaaattacagtggcct

SEQ ID NO: 92999 - DNA, 1770 bp, Homo sapiens
tacaatttcgtctgattcttcattgtcttttcctctgagttttatatttgttgtgctgtctttcatgttagaggctttacctaatatctgtcaatctgttgtttctttatagtaaggaagtttttccccctgaaatcaatggatgaatgggaattatatttttaagttattagaataagttaaaaatgtgtaaatagaataaatgcatttgcagggcatttactctcataagactgagggagagcatatgtgtgtattgtggcttattgttacaactatctcctagattcattgaagatagaagttacgtttgtttcatagtctcctcattggcttgtagcaatttttcaaaagaaggaaggaaacatttttaccttacaataaaagtctgaaaccacatattttatggtgatctataggaggactaactggaaccagtcacagggtactgtccctaacagaatgtgcatctttcatgcagtaattatattttactagtggaaactacattccaggaaacctttacataaaggttttacaatgttgaaaataaaagatatgctttttacctttaaaaagaaaggtggaacttaattgagaatattatagaattatttcaaaatcagactgcttttaaaaaaacttcaacttttattttagataccgggggtacatgtgcaggtttgtcaaacgggaatattgcatgatgttgaggtttgcgatacagatcctgtgacccaggtagtgagcatagtacccaataggtagtttttcaatccccccatcctcaagtggtccatagtgtttattgttcccatatttatgtccatatgtgctcaatgtttaacttccttttgcaggtgagaacatgcagcatttggttttctgttcctgcattaatttggttaggataatggcctccagctccatccatgttgctgcaaaggacatgatttcattcttttttatggctgcatagtagtccatggagtatatgtaccatattttctttatccagtctaccactgatgggcatgtgggttgtttccatgcctttgttattgtgaatagcacaacaatgaacataagtgcatgtgtctttttggtagaatgacaaagttagtctttgatttaatggtgacaaatgtgcttaattacttaatgcaaactttgctgtatgcatttgaaaagcgtcagttagttctatcaattggaaatattagctgtacttactgaacaactgtctagagccattgagttaggtgaatttcttggttactgactaacacagagtatatgatcctcagtttcatcatagagcatattcagataccgtggaggcacttttgatggacaaaggctatcagcaatgctatccagtcccattagggaagttaagagtctccccagagtctgttgtcctttctctgagctctgcagaagctgagacctcagaagtttagtaaggcagcccgggcacagtggctcacgcctgtaatcccaacactttgggaggctgaggcaggtggatcacctgaggtcaggagttcgaaaccagcctagcctatgtggtgaaaccccgtctctactaaaagtacaaaaatcagctgggtgtgatggcatgtgcctgcaatcccagctactacggaggatgaggtggaagaattgcctgaacccaggaggtggtggttgcagtgagctgagattgcaccatggcactccagtctgggcgacagaatgagactttgtttcaaaaaaaaaaaaaaaaaa

SEQ ID NO: 93000 - DNA, 1050 bp, Homo sapiens
ctcttatcaaccctctatatgttaaaaatgtgtcacctgattttgccagtaaatctttttcataaagttcaagtttgggagttgagttgaaagcccttgattcttcactgagtcttggggtgaactttaattaatataactttaattttcctctaagaatttatataacctttaatgataacatgttctcctcttcgaaggatatcagatccttcacaaacttaattttttatattatttggccttctgtgcataataacacagagtttcctttgtcttctggttagcaaaaatgtcttctctctgaatgaaatttctggattacttaaactcactctcttaagtaccagactattttacccaactggataaaaatttgtctaaaatatattacttacttatctgccttcagcaatgcatattgactatagaggaattttttcttagtgatttaagggcagtggtaataacactattattttgatagtgttatgctagaataaaatgtaatcaaaaggaatgtgcctgtgtcctgaaatttcttaggtgataatgctttttcattttttaaaaaaaatgtttcatgtatgtctattttagtttttctatctcctctctcagtgttaagtacttcttctcttccctacttctaatttattgctactaatttgctgtgggcagagaaaaccagtaactacattataatttttttcagtaggaatgaacaggtcctaaatagataaaggagtaaaattgacagcattaaatgtgtggacattgttatcactcagcctttttttctcttcttttgagatcctcaaaaaggatgttttggggcattttaagtactcaaaattttagagactcaacatacaactatagctgagaagtttgcaaaactttactaaaagaattagaataacatgttagatcatatatgttttgattcaggaatatacctcatccatactaaggaaaaaatagcttcagtgttctccaacaatgagattattgagactgtggtttacttacactattctgctgagcctt

SEQ ID NO: 93001 - DNA, 1022 bp, Homo sapiens
gagggaggatatttcaggtcaggactgctgattatttaaaagggacagtttttaacatttctacctaagtttttcgatctggattctttaaataaataaagattatctaaaataattaagtcatgtcatggactttcttagttgtctattagtaatataaattagcctaagcagctggttctcaatgtgtggtactgggacccagtgcatcaacatctcctggaaacttggaaatgcaacttctcaggccccagcctagacctactgaaacagaaaccctggggtgtggagcccagcaatatgttttaacaagcctttaaggggattctgatgtatgctcaagtttgagaaccactggcctaagctaacagtaatacacagaattattgaaagttcatggactttgaggatttggagacctgaatttgaatctcacctctcccacttaataagtttgtgactattaatctgtcacctaatatctatgagcattgggattttcacctatcaagtgaaggttataatgtttccttcccaaaattgttgtgaaaattagttaatataatgaatgcctaatattatcactggcacactgtaggctttcgataaatggtaactgctttttatcatgattgttatctttttcttgatcttttttcagtgattacttttacttaatgaaaacgtgctcatatttttgcttttagattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaagtaggtctccagaggtaactgtgggtgctggactgtgtgcctgcacaaatcctcctcacctttcctatgttcttttgtctcttgttcagttgataaatagaacagagagagggatatttgctttctgcctttatccttatc

SEQ ID NO: 93002 - DNA, 1081 bp, Homo sapiens
gcctgctgccatccatgtaagatgtgacttgctactccttgccttccaccatgattgtgaagtgtcctcagccatgtggaactgtgagtccatgaaacctcttctttgtgtgtgagttgcccagtttcgggtatgtctttatcagcagcatgaaaacagactaatacatttctcttctattttctgaaagagtttttatacactgggcatttttcttccttaaatgtttgatagaattcaccagtgaagctgtgtgggcctggattttctttgtgggaagatttttaacttaaattctaattaatccaatcaatttagggctatttaggttatctgtttcttcttgagtgaactttgatagtttctgtctttctaaaagtttattttatctaagttgctaaatgtattgctatgaaaattttcatatttttcctaattactcttttaagatagaagactttttttaaatttaaatctgattatgccttaaccctgctcaatctcttttaatgttacttagattaaaagccaaattacttatcatggcccaaaaggtatcacatgattgtatttctcttcctcttcaacctgatctcatacaagatttgatatctcttgttatgctttagccacactgatagattagatgcaaagggaagaaccaaggattatggactgtcttccatttcttcaagagctaagatctttatttcttgagggcctttgaattagctcttcaagagctaagatctttatttcttgagggccttctccctccttagtatttattctcttccctcaaattttcacaaggcttatttcttgtcattttggggtcttagctaaatgtcacctcctcagacctttttttcactctattctcttcccttctctatcatgtgaccctgtttattccttttataggagttctcacactctttatctcacctatttagttatgtgttgtatattctcccactagtacataaattccaaaaaggccctcatctgtcttttgcctgacatagtgactttcatacagtaagtgctcaataaataattgagggctaaaagaagctgt

SEQ ID NO: 93003 - DNA, 1091 bp, Homo sapiens
caccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatggtaagaaatatcctgcctcctctcctagatactgtatattttcaatgagagttatgagtaaataattatgtatttagttgtgagtagatgtacaattactcaatgtcacaaaattttaagtaagaaaagagatacatgtataccctacacgtaaaaaccaaactgtagaaaatctagtgtcattcaagacaaacagctttaaagaaaatggatttttctgtaattattttaggactaacaatgtcttttaactatttattttaaaataagtgtg

SEQ ID NO: 93004 - DNA, 1009 bp, Homo sapiens
acaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctgggg

SEQ ID NO: 93005 - DNA, 1041 bp, Homo sapiens
tttttcccaatgcctgggcatccatctctgagattcttcttctctctgagaagaacttgtctaggatcaagtgtttttcaaacttctggtgaatttatataacagctacattttcttaagaaacaccttgtagtcttcactggtcaaagaagagaaggctaagcagggaacgggtgggggatagaggatcttctaatcttgaggatcctggcatactggagaatagggacccctcctctcatcccaccacatcttactatgtctacagattttttaattaagaatagctttaggagtgccactatccctgacaagaccttagttctttaatctctgcttagaggaattagcctggacttcagtgtctccctgttcctcacctggagcattttttaggcccatcctggctgcatcagacaggtcccacattgggaactgaaaggtgtttgacattgctgacatctcactggccattttattactaaactctcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatggtaagtcagcaggccccactgggggcccatgagaccagacgttggtttttttttagatcgcccagactcccttacgatcccagctgcacaagcccgaaaagatgcttgtactttcttcagagatggaggtttgccttgaatttcactgaagatgactcttggatcacatggaaatgttaacatttagaaattaagctattcataatgttagctgtatttttaagagcattaatttattcatctggaaaacaatgttcggtataccttcctctacctttgctgaaggtccttttatttttatttttatttttttaattttttgagatggagtcttgctcccaggctggagtgcagtg

SEQ ID NO: 93006 - DNA, 1100 bp, Homo sapiens
gtcagctgggcgtggtggcgcatgcctgtaatcccagctactcgggaggctgaggcaggagaattgcttgattctgggaggcggaagttgcagtgatccgagattgtgccattgcactccagcctgggcaacaagagtgaaactccacctcaagaaaaaaaaaaaaaagagttaacatcagcattcagcattttctgtttcttagtttgtctagtccaactatatgctaaggacctgggaaaaggaccgtaggatgcgtccattatcatactgagctgtctgcaagactgatttgtatctgaactccatttatctgtgactagtttacaatagtaactttctggattcctagggtttaacatttacttaatgtgcaacagttgcctaaagatctaggcatttccctacccctaatggcctcaggtgcccttggggaaaattaggaagaggagttatggaatgtactacaggtagctaacctccctttcatttaagaagctctgggtctgtgaactaactcagacctaagtattatgtgaaaggctgtgtctctattttggtgactcacgtcaggcctgtttaacagatccagaggtttttgagttatacaaatcatatagaacttccgaaggctgcctatttctctcaggcctctcatcaattatttaataccaaaagtcactactactcagaacatcctggctaccactcaacaataattatgccctcttttctttttggtggtgaagttcagcccctaggctgataccgtcctgagatctaatcattccaatagaatcatcatccttgtgtctcttgtggccaccaccaccagcatcctgctctacagagaacagacactatgacacttttcacagatgctggtacccgcctcaaccaaggtatttctaaattacttaattagagaatgtcttctaggttttcttgggagacaaaggaggatgagtgagtgagccattcatgataaatgaacttcagccttactatctccccaaattgctggatacctttcaatgcattataccaaggatttcctgacagacccttcgacttcatttaatgtagtgacattgagaaga

SEQ ID NO: 93007 - DNA, 1120 bp, Homo sapiens
tttttctttaacaaaaagagtaagggttaaaccttgtgttgcatatagagaagttggaattctgagatatttgtctgagaaaatgtaaggtgtcaactccttttgttggggcttcagtgtaattaaatgtctaaacactcttagtttatagtaagagttatgctggatcatgcaaacatattctggttttagacctgacactaaagtctgaagtgtcaatgacttttcagttttgaccatagttagaatgatcttagttatccctctaaccaataaaatgcctgtgaccaactccttcagttgtccaggacttagggagctctcaggatgtgatactttcaatgcttaatctgggaaagacctgggtaaactatgataacttggtcacccatgtcattctaagtttttcttttttttaatctttttttcatgttccttgtaatgattaacacattctcttctgtgtgattgattaaaaaagacaattcttatttgaatcattgagcatatagctctaccctcaagattgttcaaatgcagtagagattattttcatattgctggtggtatgccttttaattgctaaaaaatctccagggaccatttgcacatgtttgtagacaccactataatcatgtagttgccctggtctaaatataccatgtttcatagtttctgggtaggagatacatgaagatattcattattgaaatattactaacccttatttttcatttctggcataaaatgataccaacagaatttctagcaatcaaaaaataaatataggggtctttattcatttaatatatcaataataacttcatttcaccctgtgctggaacactggatgatatatagggactaaattatctataaaaaatggctctggcccagaatcttactaaagatagaaggtgtttcttttgctttgccttctatagaatatgtctttttggtattcttcttagggtttttgtttcttctagtcctttagtccagttataggtggagcaataggaacgtgtctgaagggggagagatggaatgagaaagcatgagtaaacaccgaagacttgagactaaaaggaaaatagtgattcaatccaaaggttgaact

SEQ ID NO: 93008 - DNA, 1052 bp, Homo sapiens
ggagttcacaattttattgaacttaaatagcaggtagagacaactaaacaacaagcttatattgaatacttcctctgtggccagcataataatgggattgtagtcatatgacatgctctcttaagtaaaagagattataccctagatcaggaaactaacgtatatacctaatcaaagtatttaagcattacttttattgttgctattatttaaatctttccttgaatttttaattggcaaataataattgtgtatatttatggggtaaaatggaaagttttgattgttgtatacattatagaaagattcaattaagctaattaacacaaccacgaacttattattttgtaatgagaacattaaaattctactcttttagcaattttgaaatttacaatacagtattattaactatggtcattatgcagtgaaatagatcactaagccttattcctccagtccaactgaaacgttgtaccctttgatcaatgcctccccttcccgcatcactcactcttccacccccgagcctctggtaaccgcctttctattctgtttctatgagatccacttttttagattctacacttgagtgagatcatacagtattggtctttctgtgcctggcttatttcacttagcataatgtttgaaagttgtccaacaaatggttcaaacaaagtgttgcaggagctcagatgagggagtagatagaaaagtgctgagaaacaaagtgagggatctcggggagacttcacatagaacatgggacttcaatagggttctgaagtatgagtagtgggtttcaacacagagacaacttcgtggtacagtcagtcacgtcaaagagttggaactagtttggcacttgatacagtttcacttctcttcttgtcagtccctacagaaaggcaagaagcctgaagtgtcagacaaatgaacaaaattgtgaagggagcctatttataaggtataaatatgaaatcaagacatttggctatagtagagataattttcaaacaaatctatgcacttactccattggcatagct

SEQ ID NO: 93009 - DNA, 1003 bp, Homo sapiens
gagagcaggcaagggagggaatgaccagcaagaggcagagagaagtctgggaggcatcattaccccacttcccccaaaggaaaaggagaaaacctctaagaactggctgctcttgtgggaaaatgcagtctgtgcaattgctcaggttttttttttttttttttttttttttgccatcactgagctattcagcactatccaggagcagagaagtttcaacatgctgttgacagctaagctatccttgtttcaaaaaaactccctgtccaaaatgtctacataagagacatcgtttatgagagataaaaatgcctagattgatatttggagatccccaactcatggttgttcgaaataatgactttaacacaaaaatagaagatgaaaagattattttccatggcgaactcactttcatgaaagtgtttatgttacgtatttgagggagataaaggatttaaactgtcaggttttctgggcagaatgcaagcaagtggtgcttgaactgggccactgaaactggatggttttgtggtgttaactcctctagccctccacctccttaggctctgtttcacctggcagcatgctgagcatagagcaatgctcagcggatgcactgcttgatggagtgagctccacttgaggatggggactgcctgctctttcctccagccccatgggaggccttgaagacaaaactataggggaagtggcagggcagaccaatctctagtcccaagacgactttcctttgcatattttgttgttctcttgtccacctatgtcacctttgactttccaagtgtttcccattgttcaagatcagcttaaagcatttttagacatcttttatcatggtctttcattgtctgaaatgctacagcccctggagctggcatcccacaattaacaattatattgtcgatggttatatgtgattctgtggtggctccagatgtgaaatcctgtttccttaatgacactataactgtctccagca

SEQ ID NO: 93010 - DNA, 1046 bp, Homo sapiens
gaatccaccaaaatgggttagggtgacagttgaggaactgtgtcttatttatgttttgtatgtatgcaaatcaatgatgtttactgaatttatggaattgtgcaactgtcaccataatccagttatagaatttttatcagtctcagaaacttctcttgagctcatttgtagtcagtctccactgtaacttcacccacctccactgccagagacatcttcttatctgctttctatctctgctttttttttttcctggacattttatataaatataatcatacagtatgtagtcttctgtgtctggcttctttcacttagtgtattgtttttgaggttcatatatattgtagtttgtatcaatgtttcattcctttataatgctgaataattcattgtatggatatagaacacatttggtcatattatccatttatcatctgctatttggattgtttagtttttggctattaataaatgtgctttatgatcattcgtgttaaaatcgttgtgtggacacattttcatttctcttgggcagattactgagggcaaaattgctgggtcatatggtaagtttacattttactttttaagaaactgtcaacctgttttccaaagtggctacaccactttacatttctaccagcaatgtgtggtggttctattttctccacaaccctgccaaaattaagtatggtcagactttttgattataatcattctagtgggtttgtaatgtacctcgtgtgtttaatgacattttctcagtgacataacgtatggtagctttccatgtgcttattatccatttgtgccttctttggtgaagccatgtgtacatcgttcttggaatacacaagctttgccaattttaagaaaattggtcatttgtcttttcagttttgaatgatcatatgtatcatataatactattttatggtattatatgatgctattaaattatatattacatactatgctttataatatatattgtggaggaaagtcctttatcagatatatattttccaaatatttttcctcag

SEQ ID NO: 93011 - DNA, 1431 bp, Homo sapiens
tgggagcatctatcaccatactgtactcatagaaacagactttttacccctaaagttgtttttgggttctacttcttagggtaggggtgttacaacagggatctgaacatatcttttttttttttaatcaagttatctgtctgccatctcagagtgacttttgtagaacatatacatcttggctgcacatttttttttctaaatgagtaattctaaaatcagtccctagtagataataggtggaattcaatgtttctcatttcagtgttggggaatgctagacaaaaataaattttgtagttttggtctagctgttaaaataataaaatacttcgttgttctaattgtttctctttacattagtagtcagaagaataaggtaaattctgaaaaacagataattaatatcctaatccattaaataaatatttgttactatataaagaccatatgtaaggtgttggtcttcaaagatagaatggataagaacaaaggtttagtaaagaagaaaaacattcaaatatataatcataatataatgtgttaaattctttttttttcttttttttctttttttttttttttgagatggagtctcgctctgtcacccagcctggagtgcagtggcgcgatcttggctcactgcaagctctgcctcctgggttcacgccattctcctgcctcagcttcccgagtagctgggaccacaggcgcctgccaccacgcccggctaattttttgtatttttagtagagatggggtttcatcatgttagccagaatggtctcgatctcctgacctcatgatccgcccatcttggcctcccaaagtgctgggattacaggctgaaccgctgcgcccggcctataatgtgtttaattcctaaataatagtctgtatggtgaaattatgaatggtctactagaagattctcgattttctttgtcctgaccaataaccatgcttgcaatatatctaaaagataaatcatattatttaaggatatgttaatgtgttatggatttgagggaaaatcctcactatattactttataattacatgcacacagtcaatgcactattatttctcaggctgattctgcgagatatataaacatacaatccttaaagctacactaatatcctgggaactatgactaacagctcatgtaatatccttttccttaaatcctacgtcaaggtagtcatactgccaataatcaatatatagacatacatggtatatttagcaaatgcacaaatatatatatatataatattgattatttattgaatgacctttatagaaagtatttggatattcattattgttttccactacttttgttttaaattcaccttcaagtatgtacagggaacactgtgacaatcaaaagctcattaagagattgaatatggattatgtaagtt

SEQ ID NO: 93012 - DNA, 1060 bp, Homo sapiens
catgcctctcccagaaaaagagcgtgtgtgcgtgtgtgtgcatatgtgtttgcatttgaggagggaggcctggccagaagaggtggggggtagctgtgggcagagccctcccaagaattctggagactttgcatcctttctcaggagcaatcctcgatgcctttgactgcctacttctctgcagcggtggttccatgatagtctccttggcagcctgccagaggctgtaagtgtacagagaattgtgttttaatagaaggctttacctctgatacagatttaaaatgaggaagaaactttctgttcctcagccagaacgaaatgcgttttgcttcctgtgaaatgctggtgattacaagctcatcttacataattttattattttcaattgctgcccgtcaatctcaggtgatggttccctgggagcagaaaaagaggcagattctgggcgatgactattaaaaaaaaaatcactcagtcattagcaaatcgtacaaaaatttagaaaggagaataattatctttgtgatgatgctgtttaagataatcagaacttgcattgctaagttagacacgccgaagtgaattgaggactgtttaatggcctcttagaaaatgtatttttgctttaacaaagcattgatgtttgagatttaaaaaaaagaaatcctttaaatctcgtgaaggaattctctggaataaccacattttcagaaatccgtgacatgatcgaggtggtccactgtcacgcccacaagagggcattttctcatcaactactgtaaaaacgatttgttttctaaagggaagctgagaggcctgggggaaggagagtgttctgcagagcaggaagtggagagctgcttgcaattgagttgtatgtatgcttccacttaatacgtcctgccgagcctgtaagccaacacttccggccaggaatctgccctctgtgtttacctactctctttttatgtcttattcccagaatgactggggaccaaaggaatcctttgcaggagttttctccagacagacagttccacatgctagtatattgtcg

SEQ ID NO: 93013 - DNA, 1032 bp, Homo sapiens
ctgctgcttgtgacgacactctgacttccaaagacagtacttcccaggtgtggaggagggcattgcatttcctgtgtatcctccaccatgtgctggctgagtcaagaatggaggtaataaaagagacgtaaacacgggaaaccacacgtctaaagcgtcccatctgtaaactcttgcttactctccagactcacaggccccatccttcagagtgagtctcttgagtacagagatggaacttggaagtctctcctgctccctccctcctctgaccagagccttcccttcctcccccagcccctcatttctgaacaatgagccttcaaataccttgccccttaaattacgtgcttaaatttaagatcatttatctaattattcatgtaataaatgtttattaagcacctgctctgtgccaggcacagtggcatggataaagatggtggaggcacaagatggggttataatgtcgatatgacaaatgttgaaatatagggatgtccaaatctcctgtgaggccaggtgagggaggggcagttcaagggagtgagagaaggcctagggatttgtgacatgtagcaaaggttgaggacagggtagtgagaacatttggggcagaataaacagatgtgtcagaggaagtgttgtgggaatgtgaagtagttcccatgcctggagtatattgggtatgtatgttgcaaaaattgtgtgtgtgtgtgtgtgtgtgtgtgtgtgtgtgtgtgtgtgtgtggtcaaggtaggatggaagggcgaggtaatgggtcatgggggtagagagagggagatgggttatgacctctaagctgccaaggtaggtaacatccaaataaggcaggacctcgagaagagagttgtgaggtcggccagatttccttctgttgtgtgtgtgccgcaagagttttctcagcctcatccattcccgctgtcgggagatgagacaaaaatatccttattcttcttgcattgggaaatgcaagcttgcactggaatcttaacaggtactgctggttc

SEQ ID NO: 93014 - DNA, 1070 bp, Homo sapiens
tctgtttgactgcttccaagtcacctttcatgttgtaaaccactgcttgtcactttgccaaattcctatgctcttacttaagtgtgattcaagcactagatgtttttgacatttgaagattacttggttctttgggcaattttctcgtttgccttcaaaaaaatgcctgcagttctctatttcatccggtggaaaggtgaggcccaggatgcatgtaatgaactgatggcactgtgaggcactgggcccggtgaactcgcagggtgtagctgagatacaaggtgttttctactaaaaggatcaaggcagctcctcgacctcacattggggatcatttgtactgaagataattcttcagcggagtcgtgctggcactgagttagccagatgagctgatctccatgctgaagccaaccatggggccagccatttccatcctgactgcccacatgctgtgtgatccattttctttgtggcagagggctggtcactgcagacccatggacacgggtgtcaccatatggtcactccagacatggacgtgggtttcataatatcatcctttctactccactgagccaggactgccatcaccgggcagaggttaattgaaaattcatgtaactatccgctcatttattaagacccacctccttttcttccctctcccaatgcctctctaatgccaaaatgagtctccacccctggggagagacgggagaaagaacaacctgctccccaccttgaaagaaaccattgacttcatggaaaaaaccacagattcatggccctgcagtgtttgtcttggaatgtttgttcattttcccatttgttccctttgtaagctgtgcatctgtccccaccaagcccggtgctctgaaggtggcatcgatggccctgagtttgtccctagctcccgcccttcctttgtaatgtgtcccttcttcccccacgggtgcggtgggaggcccgtgcaccctgctgtggggtaaggtggcatcaggcacagagagagtgacccggggttgtctttggtcactcacaaggtaatttcacttggcaaatgattg

SEQ ID NO: 93015 - DNA, 1058 bp, Homo sapiens
gtattagtatactaatactttgtatactaaggacttccccattcctggaagatccacaggacgtgtgagaagactaggaaagaggttcccaaatcagaatatactagatgtccccagtccccagagtttgtcaattgcaggtgctctgacaccagcaggtttctggatttacaaatctaagaataataagatttgaaacactttccttattccaggcactgttctaagtgctcagtatgggtaatctaatcagatccttgtgacaaccctttgaggcagttgatatcaccatcccttaaaccatgaggaaactgaggtccatgcaggttaagtgaatccatatcagttcagatgcccgaaaacacaaacctcaccagctatttaagaaaagattaatagaggggattgggagtttccagaattagaagggcctagaggagcaggatggaggctcagcttccaggagtgattctcaacaggacactgcatggctggaccctcaagattgctgcttccacagtcaggaaagttgagaatcaggactctattgcaggaactgtcaaccccaggaacacccactcaaccaccttctggggaccaggagaggtgaccatgactgtttgcttcagagttggcatgccttttgctgcacctgcaatctgcttttcagcacacctgcaaaactggtgactggtctccttgcctgtgcttgccagagaacggcagaatctaccaccgtatggcctccacctcatttccttagcttctcaaagcatatgcaaacacgtctgcttggtagaatcttaaacacatctagaacctggaggtgcaaaggaataggtcgttgtcattttgccaactttggcatacagcaaggcacatggggaggaaggtccaatggatgttgattgagccagtctgcagacccacacattaaataacttcccagagcttacacaggaagtggtggatccaggatttgaagccaggctgtgtgttcccagcatctaagctctgtgaagtgtactgcctcacaggaatcccgtgagctcatgctt

SEQ ID NO: 93016 - DNA, 1052 bp, Homo sapiens
ccatcagagaatctctgtgacagttccttgcttacctgggtcttggctttccccaggaggttagatctagggatggccagcaactagatgacctttaacctccttaaaaactgtaattaagttttataattaagttttggtattaaaatgtattattaaatatcatgaaaatattatttattcattataaagggattttaaaggatagtagctaaaagtatataaatgacttataatcctgttccccagagataaccattttagtgtttctttccaagctttttcttatgcacatacgtaaacagtgcacacaggatctgactgtgggtactgttcggggggcatgttatttagattccacaatgtatcaagccatttcgtatgtcggtaaatagaaatctatatcaccatttttacagactgtctactctgtggatataatagcatacatgattcacttaatgccctaacgatggacatttagcatattttaaatatttcactattacaaataacagcacaacaaacattgttgcatatgtatctgcatagtcatttgattacttctttggcttaaatttttagagtcctagcttaaacttttgactccaggttctccaagcaggatcaggcagccagaaatgccggggaacctggcctgccttgggagggcacaatcttatgaacagaatccgtgatctgggatctgctttagcccccaccaggcaggccaggaatgtgcctgcagaggcaaggaggcctggagctggagttgacaacgttcaccacatttcatgctactgaagggacaggagctgggcctggaatgaagcaggctggagggcagaggagtgggctctcggatccaggacagtggaggcccagctggcccagccttgtatgtccttgtgggacttgagcctttagaagtacaggctgcgtctgcataacacacagggcctagtgctgggtgagcacaggccatagcagccccgggactgctgtattctcagccgcccaccctcatgccttctgaccggtggcctcctggc

SEQ ID NO: 93017 - DNA, 1101 bp, Homo sapiens
cgtcctgagctctggcaatcatgtactttaggatggggagggactttgagggcagtttcaccaggcatagctggtcagatgcaccctatgtgggcctctatctctgtgcccccagaccagggtccctgttgtgaactcaagtctgtcttccctagcactcggccagttcctggaggatgggaatcatacctgatctgtctctgtgttccgctccctctgccactcataccagtacctgatgagctctcagtaaacaaatcactacgtgcagctgggactgtgcctgggagtgtccgcaacatgcagcctggtgctggctgtgccctcccctcacatgcaggagtcccattgatttccaagatgataggaaggttccgaggcccctagatggttctgtgacccctggggatcagtggaagcagctatcagtttactgtggaaactgggccagctcacagggtcctgtgtaacctgctacaaaacaggccagttcaagagccatgtgtggagggctgcgctctgcttttctgtggtttggtggaaatcacccaaataagtaagaaggccatactggaaccagctaggaggagtgaaatctgatacctgcactgcaggaaagaggggtggggggagttgagccgaggactcagtttgcgcagagcccaaggctgagccaagaatggcattagcagacacctcgggctctggaggtggtgaagggcagtgctgatcgtcactggtgctggagccaccctgggcagcatcccctgcctccatcattgaggccgtctcagtactgtctgtccaggccgtttgtccccctgccctcagcaaacgaaatgccctagatgccgcctgtgtcttcggaggaggttgcaaatgtctccagagctaacggcagttagagaacaccatgggccatgtcctgggcttccacaccccccgcctttacttcccccagtccatcctgcaggcgtcctctctgaccgcactcccctgcccgctgcctgccttccctccctcgtgccatggacagccttacttcctgagctctccccttgtccactcccctcttggcctccgtggtgtccacctcaagga

SEQ ID NO: 93018 - DNA, 1030 bp, Homo sapiens
gaggcctttcaaatgaaaaaaaaatgaattactgaatgcaaaaacagtcttatatctgtggcatccttccttcagttgtgatttaatatgtgcacggtgcaatacagaaatacaaagcagcttgggaaaaagtctcagccctaagaatcttatagtattaaaactcgagtaatcctacacaagagaaaaatacagcaaagcctgagcttggcccctgcaaaccagtgcactccacccgctgtgacccggggggtggtgggaggcctctggagagcggctgggtgctgcttttgacagctgaattttattaactgttttttcattcctcctgacggacctggcaatgaactcttatcagtgtattgtggcgagtacaagtcaattaatttcttttaaataacttcaactgaaattctatttgatttatattccaaaaaagatttccattccatcattccttcctgagattatggtcccggcagagttaatcacactggctacacagtcacccataccccagggagaaaacaggatcaaggagaggaggaaatgagacggaggtggagctgagagcatcctaaagaccctttattcagtgtgaggccatgtgctcagtgacaggggagtttgctgaaatcttgccctcagaagagcttatttctagtggttatggcaggggatggattggggagtgacaggaaatgtctggaagatgggggagacttaaccaagaagcatgactgggggcaccagggccgctgaggtttgctgctgagccacctcctcatttagtatccagtttctagggctggcatcccaggacaccctcccttagctcagccccagttgtgagcacctgacccttctatggcctgctgtgtggggccaccccagccatggtggtggtgatggtgagctgtccctgtgagcaagcctcaacaggctttgctgtgggtctgtccatcccttaaacacaggctgggacaagcagagctgcccccttcctgagggtctgcccacagggtccccc

SEQ ID NO: 93019 - DNA, 1037 bp, Homo sapiens
ctgccccatgttagaccctcctcagtccttgcctgggccatttgccttcatgtcccccaggatcttctgtgtccaggctcccgtcctgcaatcccgccccctggtacctgcccagccccccagaagtggtcactttccctcacacttcctctgccggggccgtggtccacacctgcactgtccaatacagtagccactagccagtatttgtatcaattacaattaaataaaatgtaaacttcagttcctcgatcatgctggccaattgtcaagtgccaacagccccagggggcttctagcttccatattggacaacacagatcatagaagcgtttccaccattgcagaaaatcgtactggctagtgctggtccacattgtcctttcctcttgagcatctttctttcctctccttctctccaaatcctccctctttcccaaagagtcacatagacacatccttacatcccaaacctcatcttcagtagcgcagaacttggcacttctctgagggtacactggaacatagaactcttttggttgcagtagatgggaacccaactcaaactaactgaagcacaaaagaaaatgtgttaactcttgtaatggagaggcacaactcaggcttcagcacagccagattcagtcactcatgtactgttggacctcgtccatccctcctccactgccctctgtggccagcttcatgctctgtcctacagaccgtcccctccccatgaccagagaggacggccaggagtaggccctgcttacatcttttctgggcatgatcctgaaggaagagagacctttgtttttggagttcatatatcgtatctatgggatttgggtctgtttgggtcatggaccctgattcaatccttatggccagggggatagaacaccctgatttgcctggcctggtcacgtgcttaccccaggggtggggcacaacacccagccatagctaatgggctccctgtgggaaagaaagatcctactatcagataaaggagggaatggatcagacaaaatgca

SEQ ID NO: 93020 - DNA, 1065 bp, Homo sapiens
attcattttaagtgggttttgggtgggagtaaagcgtccttggtagtgaaatgtctgtattcagtgacttcaagctgggcttgtgaatttatatgaataatttgttaatggcagttacaggagttgaagtaatttacgtggtcataagggagtaaaattctgccctggaatgtgcatgtgtattcaagcctccccctctgtggtttgccacaggaaagcatggcaggtctgaggtctttggaagccttgctcatgattgcaaacgagaccaggccagggtctgtgagagcttagccatgcacccaacctcattgtgatgtcctgacatcttctagattgcaaacatcaacgtgttcctttgcatgagaccactggggtgggagggttactcttagctctgagatacccagtgagaagcgtgagggcaccttccccactcagtagtgcatctgaggttggtaggttcccaggctagcccaccacactgactgacatgatcttgtctgatggagacccaggggtttccatcccacatccgagcatgttgttattcatgccccagcctttgcacagggccgtgctgtttgcacaccaagccctccgcagtgtgggggtggtagtggagggctcagttaatagctgctgctttgatatcaggctgtgaaggacactcttggggctctggagccaggggaggacaattgacgggggctgaggcagggcagagggagcagaatccagtggctatggcagtcactgccctggagaaactcacgaaggggcaggggacacagcaagggtcccccagtgcatccctggtccccctgtgccatgacgagcacagagtatccactgctcattttccccagaatttggagacagccagagtgtagggccttttcatcctaacacacagagacagcccgtgcccgtcggcaagacatgacgtcgttcctgtgcctcccagagcatctcctgagtcatccgtcccagcacccccctgccccagggcctgcccaaagcaggcgtattgtgttaccctttctccttgcgcttttcttggta

SEQ ID NO: 93021 - DNA, 1038 bp, Homo sapiens
ctaagactgtgaacagtctggttctgcccacaggcctctcactaccttgccctcccctcttgcaaatgacctctcggtgtcattgcttaatgcctcagaccaaggtctacacacaatgccggtgtgtattcgtttttcaccaacatcagcaaagtcaacgccatggctacatcttagtctgctagggcgtgtcttccctggtcatgctccagcctgtcaagtgccttttaaaggaacaccaggtgacaggcaaggtggcccagggagagggattgtcacctccttggtcttgagcatcacactgtagatattctgacttttcattttgtgctgccatcacaaaatgccacaaattgggtggcttaaacaacagaaatgtattttctcacagttttgcaggctggaagtccaacataaaggtgcaggcagggttggcttctggtgaggcctcgattcttggcttgcaaacagccgccttctcactgtatcctcacgtggcctttcctctgtgcatgaacactcctggtgtctcttcctcttcttagaaggacagcagtccgactgggttagggacccaccctatgacctcatttaaccttaatttcctctttaaaggccctttctccagatacaatcacattggggattagggcttcaacacaggaatttggggtaggaggggacacatttcagtccgtaacagtctacaagtctgtctagttggcaaatggaaagggtagcccctcacaaggcacagttcccatgtagttacaatgtctgccttctacctgtgggtgttttcagtgattcgcttgaacattttcataaatgcacttttgccatttttatcctggtttagctacaggctgctccctctgctttgttaactaagcattggatatatttcccatgattagcatcatccatacttggggttaattgtttttccatagaactttcatgctgggagggaacctaccgtcaccactgggaactaagcaggaaccaccgatcgctagacagtttgtcctgttaaat

SEQ ID NO: 93022 - DNA, 1049 bp, Homo sapiens
tggacatggtcagctgctccagggcaccctcgaacccctatagagctcccctggcattctgccctgaccccagggcactcagagctctccaaggtgctgaacttgtctcttgcctctggccccaactatctatcctggcttcttcaatccctccagccaagaaccaccccatcttccaagagcctacctccagtggaaaagcagcagcacctctgaataaataacactgtagacaaaacacagttcttccacatgaagacatggagggctatgagcacaggaggaggagtgagacccacccaccctcacccccaccccagacattggattcagttcagtttctggggccagactcgagtctctcttctggccctgaggaccaaggcacctcaggacaccccactccctggtaacaagttctaacccctggtggggccaactacctcataaaaggacggtagggccaccctgcccctaaatgcctccccctctgtctgctcccatctgccttggccctcacctggccctcccccagcccaccttcaggcttccagtccccacagagctcttccaggtcctgccttgactcccctggatgtttaattccccacacaaagtcctctccacctctggctctggccactccagagctcttcacaccactggccttgaccctgtttctcacccaagtctcccaagccctggccttctcccaaggtctctcggccctgcccgcaccccatgacatgttcttcctctcccgctcggaatattcccatcacccctcggcctccatcctccaagcaggggaaggagccaagtagcaacctttttgctggaggcaggagggactacgtgctgctagtgtcaaccaaaccaggcacttactccagctgcagccatggaatttgcccatggccttccctgctcagcccaggacccacccccacctctgcaatgcccaccctctggccaggttccttgggctgggatggggtcctgacactctgccccctgtcctcctccgttccttcctaaacaagagactg

SEQ ID NO: 93023 - DNA, 1050 bp, Homo sapiens
tgcgtcccggactctggcctctcctgggcacccccacgcccagaagtaggtgactccaggaagctctggtcttctgacagaccccatggggcctgtgtggctggggagcaccagcctgccctcactctataccccacccccctgcgtcagcttcatagagagggttagtgctgcccgtctgccctgctgcagtccctccaaagccacatcatgacctgatgggccagcagcaccccaagccattcactccatggggcccggtaggacaggacaagaaatggcttggggcagggacagaacagccacctgtggaggacgcagccctcgtcagcgaccagggtcacccatcacgggggtgtcccctctggggtccctgttcagagagaagaggcctaaggagcactggggtccagtcccaagacagtctgatgtccagggatacagaggcgcccccaccccctcacagctctgcaggccatgcacgaaggcctgtgtggatgagaaccgtgtgtgttggtaagaggcacagccctcgccctctggggcctcgcctcctctttgaactcagattctgaaagagcccccatcacattcccctgtgcctctgcggcctttccctgcagatcatctgcccagcggccccctccaccccacaggtgaccctcacaaggggccaggaggaacagagccacagccatgcctcctgtggccaggggtcctcctcagtctagacagcacctgcgatgctccacggcacctgtgtccctcctcctgtgcctggtggccaggacccactccctggctcagactgtgggcaagacaggcagcacccctcagggcagccatgtgagtcccatcgcacctgtcactcagccatggactgtccgtctgcccagcacccctccccaccgggggacttcacggctcttagggtcagtgcatatgtgtgcgtgtgcatgtgctcgcacatcctgaagtccccctgggctcagcccttcactggctttgagctcctctgcctgaggactcctgggtggacaagtgggctgg

SEQ ID NO: 93024 - DNA, 1040 bp, Homo sapiens
gggcattttccagcctctgtcacaaaatctccaagggaattcagacctcatctagttccatcctcttattttgcagaagaggaggctgagggcccgggagaccaaggctgcccacctgtgggtggcagagcccaggcacccagtgcccccagctccctgccccctgctctttccgcccacccacacacccagcagctggcctctctgcggccagcctgctcgcttgctggacacctcgacagccccaccgccagccgcaggtgcgcgcaagggacccgtcacaagcatcttgccctgtggcctcctgagaagcgagtgagtggaccacagaggtcatttcccagccacgtggccaggcccagcccgaggcaggaccgggctcagggtgggaagcagggctactcagaggagccaggatggggcggccaagccgacggcctgcggggccgcctccggactcctaacgcggcaggtgtttttactcctgctgtcacttatgtatcagtgtcactcttgcttcatcttatctgtttccttccaggtccagctttaggggcagctgccaggccttaggagcctttgcaatggttttgtattcctgtagacaccagatataaacagatttatatatttgtgtccctcccctgctccccccagttccccagcccgacgcacactctacacgcaggccactctgacctctgaccccgtgttccatgtggcaggagggcccgccccgggccaggccccaggtcatggctgctggctgtctgtggcggaagtccttggttgtttcctctcccctcctcccggctctcaccattctgtccgtctatctcgtcttgtcctcagtttcaaagcaatgtcacgaagggcttccttttcatgcctaaaaggaaacaatatgtttttggaaagaggtggggttggagcgggttctggggcaacttggggccctcggtcctggggcgatcagaggatatctctggattggctggcatcacagccagttgggagcctcccaagcctgggtcacgttg

SEQ ID NO: 93025 - DNA, 1050 bp, Homo sapiens
ccctgcaaggacagttggcagactctggtgggctgaggaagggctcagggcccttcagggcacccttttgtccttcatctcttggggttcccggggtggtctcgctcacactgtgcccatgctgaactttcacagccagaaggagggccttgccccccagggaaggcccatacaggcaacccctggtcttggagaactgctccaggaccctggaagagtagagcttgtctcactgcttagttggtgcatttgatccttgaacaaatccctatatttatcaacagtataagtttgcaaaatgagtaatcagtgtcttaggagattaaaaatagccgacaaaagcaagacagaatgacggatccagttcagtttactcctacagagaaaatgtctcatttttcatgtgtttgtttattattggatgacaaatgatcggaagccgatgcttccagaatgcttggggtatgcatagctgggcagtgggtcacactgaaggctgccagcaccggggccaacccagctccagcaactgcggtaatatcctcattttcacgtggcaatgcccatgattgccagatcaatatgataactaaatgttgttactgagccatctctgggctctacttgggggaggagttaaaagcccacaatgagcattcagagcctgcctcactctgcaaccgtctttgctgtaacatttgtcaagtgtccaattagccaccaagggggaaaaatacaaattgaggggtatgtgtggcttcataggcaacatgatgtcccacgggaagatgtgctttctggtgacacatggcggtgggggtggtgggctcaggtgcaggaggggctctggcaatcttagctgtctcccctgggttgtgctttgggccaggtcagcctgacgggttaccctccaggcactagtttctccaaaagcaggactaagcctccgttctgctgcctgacaaagcttcctgagcttttcccccaggcatctgttctctgtaagaaagaacagtctccctggctcaagggaaaaggattttgtattct

SEQ ID NO: 93026 - DNA, 4549 bp, Homo sapiens
tgggagttagtgaaatataatgaggaaggaagggctcagtctctggagtgaggctgcctgtattcaaatcctgactgccacctgttagctgtcaaattatttatcccctctgtgcctcagtttctttatctgtaaaatggacctgatagtaatacgtttgttcaatcttcaatgttatgggagttaaaactatatatataaattatatatatatgcatacatataaatataaatatttacttatatttatgtattttatatatagaaatctcttagtaaatatctggcataataacttactcattaagtgttgctatcatcatccttatattcatattactcatatcatacctcatactgatattactggcataataagttagttatttgttgagtgtgaccatcatcatcatccttattggcctaaatataaaataggaggtacttggaagtatctaggggagatagtcttaattacctatggtattataatcaggaaaatattcaaagtttaacctgtatctcaaattcattccctaaaaatttaaagtgaattcttccgtaatgaggaacacttttgtctttcccttaatagataacatgcattttttttccttttataggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatcaagttgcttttgtttgtttgtttttttaaccgtaatgtagatggagaaattggaggcaacctcagtataggaactgccactttgaacagtttaggtcttaaagagaaagtcaatctaatgccaaggggagaacaatgagctgaaattgtaccaactcctctggccctccttccctcaattaaaaaaacacacttaccagttttgcttattttacagatatctggtggttctatagtttaaagcagcttgtgaaattaaaaaagtggactcaattttgtttacctttctgtaagtttttcatttttgctgtatagcattggcaaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaatgttgtttcatgacttgatttttctcataagccaatgtatttgtaggtttactggattttatttttagggagtgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaagaaaaacatgtctttctttagcttaattatgatcactgttggctacaaatgcagtgctacttttctagctgatttagactgttttagagagaggcatattgctggttattaagcacccaaaaagtcgtgttatatgttccttttagattttaagtacacctcacgattttttagctgaaagctttttatgttgagaaagcgtggttttagttttagttgaagattgtctaaaatatgttgtatagaagcaaatggattacttctgagatttgtttttctagctggaagactatacgataacatatgatcaggtcatatggttcattagtttaaaatgttttcctttttatcgggttgttatcagtatactttgtacagtatagcacataatatggacagagatttcataccagagttttgaagggcttacttcaagtgagtagaatgttcttggcttcagaatacctatttttcctgtgtgccttgagacaccttttcatgttcctgtag

SEQ ID NO: 93027 - DNA, 1050 bp, Homo sapiens
gacaaaaatcattaagagttacagtttgaagaataaagcctttctgtaccattttgtctctggaaagaagtaatctggggttccttttttttgtcaaaacacagaaatccatggttctagggtggtaaatatacagaaatagtatgtcacaattctctccctacttgcttataactgacgtgccaattgagcctgtcacttgggcttgtcggatgtggtcatggccccacactccttatcactgcttcctaggtagccactgctgatataaaggcgttggcatgggtagtgagacctatttgccattaatggttggaagataactcaaaagtcatcttattttggtcaaatctagtcctataaattagccatatgaaggagcgactgtccttttgctgagatacttttagagatgagacattccctttctagacaactctaaaccaagggaaattcttcctgtataaatatgagcttctatctttgtttatataatttccatcattaaaccacacttctgccttttcaggtcatctgagcaaatgtaatcactcatctacccacaaaatggctaaatgacttaattcaactccctttgttgatttgcctgttagtttgtttatctggtggtctatctattaaatgtttattgagtacctgcagtgccagatgctgtgctgggtgtttggaatgcaaaaaatgagtaagacaaagtctctgctctcaaagaatatttttagtatattaaagatttatatgtaaaggatatagttatttttcatgtgtaattttcttttcttatttggcaatatatgataaaacatttagcaggagtgatttttgttggccacatggaagaacttgttgatcggatgatgatctgttaatacagcctgttagttttgcagagatgtagaatagaatttctttggagctgtttaaagggaaggaaaaaatgcaagtgtcttagatgtatttgacatttgcccacctgaataaaatgtgcggggtagagttattcacattttttttaattctagaacttctttg

SEQ ID NO: 93028 - DNA, 1001 bp, Homo sapiens
tgcaccaaattttgctttaagtttcagagggtgtatcgtttcgagtgcattgctttactggccgcttactcttctgcctcctgcctgattatcacccctagcctcagggatttatgactgaaagctgagtaaatccacaggtgttaagaagatggaattccaagaagaattattggcatgggctgggtgtgggcagagaagacttagtgataatagcagtatgatatattcggaagagtaatatagacctagattaaattaccactcttgttcattataatcatgtgactttcagctcattatttacactctccaagcctatttattcatctaggaaattcaacttcagaatggtgttgcaaggattaaataagtcgtgtattttaattgcctctcgtggtaactggcacatactaaggtatattcattccaggaagtcattgttaattgaatccaagggctgttcagtctaaaagccttcattgctttataagtccaatagtgggggaaagaagcagagcaatcattgtcaagtttaccttgttctcagggaatcagagtactctcccagcttctgacttcttatggctacatgattcatttaagaagcagcagaaagagggagttaagggtttctagcctgtctttatcattattctttagcccatagcagggtctgggatgagttgatatctaccctgctcaatatacatttccttcctggataggtactcttataggaggctatcctaaaattatattattttctctaaattgtgtggagtggagaacacagcttcagcctgggatttgggctatgtgggaaaattttttttttttctgccagtattttaagtcctttagcagagttaggaagcaggaaaatattattcaaagtctaagaattcctttaatggataaagagaaatttactgttcttaaatgctacctgttaaacatttgtcttattcttcaatatttaatactaaaatagttttcag

SEQ ID NO: 93029 - DNA, 1040 bp, Homo sapiens
gaatgtgtagattagagtaagaagaaaagtggttacagagagaacctggagaaaaaccaacttaaggaccacatagaagaaataaatctctagtgaagaaaattaagatagaatgattagtcttaggaatataatgcaggacaaccaaactgactgcagtgtggtgcgacaggaagcaaatagcattttgaaacagttcacgggaatggggtttagtagcccagtagactgttgtacattctaagatggcagaggtcattatttttggataatatataatcttattgttccacagtcataataatgtaaaatgtgcctctttgtgaattaaaatgaataaaaatagggcccctttggggattaagtgtaaacatggcctgccagattgttttatttttatgattttatatctaagtttcttacccatcttaaaacaaaagacactgctttcattggaactgcaaactgccctagtataattaatgactttaaaactcagttttgtatttgagatttttttaaaaaccttttggtttatgtagctgggaatatttaaagaggtattgcttatcttctgcttgcaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatgtgagtatttcagctcatgttatccagtagtgagaacaactgagaatgatgtagatatgttaggaattgggtacaaaacaaagtgccgctcttttcccatagctcttttaatctcttttcagaggtgaagaagagcttgtgaggtaaatgctgaatcagaaatatatttctttaactttatttgttattttctatccctattcaatattatttgctatgacaattgaactaggcttgaatattttcagttttaaactttggtttttggatagccatgtggagccagtagaatttttatatgcccctgtccttatcctc

SEQ ID NO: 93030 - DNA, 2052 bp, Homo sapiens
gaagttaagtttaaaagtagaaggcaaagaattgaacatactgacatattgattctttgaaaagaaatttagaactcataacactacactggctgcatttcagtttcttgaaatctccaaactctttacagcaggattttctcacatggtattttctgaacctgcactagttgtttttttttttttccccccttactctttcagtagctactccagtctgtgcttcaagtgtcagtttaaatgcctgttcttcagagagtcttcttcctgacttgctcaatctaaattggaacccacaccagtaccctgtaggttttcttcatagctgtttttcagggtgttttgcttttgggttttttcttttttggagggaggaggtgttaatttggatgtatgagagatgatttgttcctgtagtggtctgaaaaagtccttgaaagttgatatcatgtatgttttgttcactgctgtgggtggccaccatccagctttccctggtgcagtcgacaacatttgttgagtgaatgtttagagaaaatgtgttggaagtaaatatcagtggtgcctttgagtggtgcatgtttggttttgtaagattaccacaatgagccataataactttcaaatcagaaaagttataaagtgtctctgtaactttgtctatactgtttgcccttactagagaggaaaaagcaaatgttgttttgcaactctggattcttgctcttgatactgttagaatattagttaccttgatatattacttgccttttcatatttctgagttgcacagatctagggggcactgtttatattgtattgtttatgaatgggaacttctggattagtgtgaagcagaggctcctcttttagtaccatttttaggcatagtttacctggaaccatgtttatgcttctctcctggatctacctacaatgtatacaccatcttgtgccctttagcttagaaagtctttctgtatttctctgtttttgtcacatttaaaaaaaaataagtcacctttaaaatatattgtattctttagcatagttttgaccaatgtcaacttaggagaaatttaagatttttttgaattcctaatattaatctctgacaactctggggctgggcatttggtgaatatcctctaaatactttttaaatttttactgaaaatcacatatttctgttttcagaaatttgaaaccatgtatctttttcttgtaattctccagactgcttcagaaatggtaataggtttagtcctttgaggttcttaaagtataattttcagagaattactaacttgactgagtagcttagtatatttatttttttacccatactttaaataaactttttctcacctagcaatgctttttataattttgtttgtattcttttactttttaagatgtcctttgttaatgttattttatttgtttctataataaatatataccaacttttttaacagataaaataattaggcacagggcttgtaccctgaaggacactgcacatgctatcattgcagctgaattagatccagaatttaataaactttgtgaggaaattaaggaagcaagaataaaaagaggtaagttgtagaaataaacttggtactgaagcctagtgtgctctgttcaggccaagagtacttgaacgctgtttctttaggattgctggtattatgaaagtaatgtatttaatgtatttatttaatttctgatactaatgtgttatgtaaattctcaaagatattttacaactttacctactgtgaaagttttagtgtgatagtgtgtattacagaaataaagtgtttcttattgaaatttgttttgtaggagtatatcttttttaagaattgatttctaaatggatttagatattagatatgaaaaggttttatttttcatcagtttactttctggtactttaaaaacatgtttaggtatactgtttttcccaccctagtgaaatttatatgcaattttgttattagaaacacagaattagcaattgtggtttgtcaattcagtttataa

SEQ ID NO: 93031 - DNA, 1037 bp, Homo sapiens
gtggtggtgggcgcctatagtcacagctactcaggaggctgaggcaggggaatagcatgaacccgggaggcggagcttgcagtgagctgagatcacgccactgcactccagcctgggagacagagcgagactctgtctcaaaaaaaaaaaaaaaaaaagaaaagaaaaaaaaaattataccaacagcatcagggtcactgttagccactatagcaatttttggtaagtaagagaaccttcttcagttggatgccatcctgtaacaggatggatagtaaagcatgggctggatgtcggccccatttcactcccttcccttgctggggtcctatgtgagggtacaacccgtacaactgtatatgtagtggttttgagcagtgtgtgagagtgcttgtgtgcctataccttcagcctggttttcaagacgcagagactgctgttattgtgtaatatgtaatgagaatatgggctttggattcagacctaggctttagtcccatttctcctatttcctagctctttaactttgatcaaattaagccttctgaattttagtttcctcatctgtaaaatggggatgataacaacattcttaaatgggatggttgtaagaattaaatgagcaagtgtattaggttgaaccttatgaaattgccattttcatatggttcatcctaaatatcttaagcctttagcagagtagctgggacatgataagagttccataaaggttagctgtttgtgtttgtattcttatgatcattatttaaattgtgctttaatttttttataagttggtttcttagtgggtacctgcatatttgctctagaatgaccctttatactttgtgcttattacattccctggaccatactttaaatgtaattctattttgaaacaaatctaagggctggtagtgaaaatgaatttaagtgcttagaaaaagccagttgagaagatcaatccatatttttcccttctcagtaattaattataaccacattgatattaatattttaaggaagaagtaatggtt

SEQ ID NO: 93032 - DNA, 1127 bp, Homo sapiens
aggaaaactcttttctttctaatcaaagaagatttgtcagattttcaaatgccatctgtaatagttttataaatgacggtaaggggatagaaaatgttggtcagataaatattttatttagggttgtatttctcttcttttctcctttatctttcttcttaggttcgttctgctcttaagctgagaacataggagtctctgggaaggatagagaggggaaaacaagataacctaaaacaaaagtttttatttaactaatgaatttaaaatgtctgaaaactttatcaaattccaaagcagactgcagagaaagcaaaactttagaaaataaatgttaaatttaaaattaagcatagagtggtaacatttatagtctttaataatatacattttatagtgctttttagtttataaaacagtttccacttatacacaggcatttatgtcaaataccagaagcaggaatccagctaatatcttctgaggtagtttgtttcagtataactctgctacctcccttatagggagattgactggtttttcagttcctaaaaggtgaaaaataaagcacacatacacttctacttaatattttttataagtaatcctaaacattaaaaaacatataaattacatatatgtgcgtgtgtgtgtgaatgtgtaaatttaaaaataatggtatcgatgccatctgaaacttcatagagcagaacttaaccatctccccagaaatctttcctggactaattttagacattactgctaagactgctgttatagcaaacctatttacttgatttgagatttgcattggggaaggcagtagatacataagttgctaacactttcttgttggtcagggatactcaatttattgggcaaatcatgacgtaatatctcctgtttagggttatctcacagaaaatcagcacagaaagcagcatgtttgtttgtttgtagatttctttatacttagggacaaatccagcagatctcgtactggttaggaaaactatacttaattttcttatataattgactctaaatgtttgtgatgactccaaaggagtggaaaatactttccatgaaatagttcactctagaaaactgaaaaagaaaatttttgt

SEQ ID NO: 93033 - DNA, 1020 bp, Homo sapiens
taaccaatcaataccagttaatactggcatttcccaaattatgtatacctcatcaaaagaggtagctaaaaacctgaaatttctttgtctttcatattttggaaatgcctgtggctgggatgctgtttgaagttaaaacatatcccgtgcaactaaattatttttctttctaaggattttctctgctcccagtggaaaatttctcactttatatgtgtattattttgtgtgcttgtgggagcatggtttgtgatgatgagaaaagaaattttccatttgggaatctaatactatcaactacatttttggtttttgttttatcctgggataatgtagtgtgtggatgaacacaatgtaatctttactggcctctttcttatagttcagactccatgtttgaacagctttggtgtttttagtttttattcatttctttttttaaaaaaatgaattatgggtgattcagggtttaatgttgtatcctaattgtgaaatctgtgcttttggacctgagcagatacctttgaaaccattacctcatctgttactaggaagaatgagctagcatttacattcctcccccctggcaagtctgaaaagaaatactttcccccctttttggaatgaagagactatctataattttatttgtacctttatccacaatacactgttttttccatttgatcctcttatcaaccttgtaggatcattattattattcttactttgcagttgaggaaacagacttgttggcaagtgacatagccaagacttgaaagttttttaaaattcaaagcccacattcattatcatagctactttatatctttccactgggataacaggacatgcctaattggctttttaaattaataaatatcagtttatattgctgggtcatccccccccccatagtgtttttaaataattttaaaactatcagccgattaaaaaattattttaaataaatgtgatatgtgtgtgtgccctttcttccactcccctatttggtatatt

SEQ ID NO: 93034 - DNA, 2649 bp, Homo sapiens
gaaataccctttcttggagtcagtttattttagccctttcttcttggaagtgaggacagtttgtcaggttctgtttatctttagatgacgtgtggaagtgtccattgtgttcacctgacttgagattgggaagtatagccttgttaaagctttgctaaacaggacttcttcttatgacttcaaccacatcctgtggtagatgtcacattatggggctcaaaaagtcatagaaaaaagtcttcagttctcctctgttttagtcacagtaagtacccaggagttgaactggcaggttgtgaacaccaggtgttgtgctcattactttttgggccatgatagatttgatgggctaatagctgcttagaacatttgccatttctagtttatttattgattgacttttcaaatacttatttaggaccccttacatttaacgttgtattctagccatttgaaaatctatcctgcctttgttttaagtgttagatttttcttgggtttggactcaataattttggactcaagaattgagcttaagaggtacctcaagaatttctcagatttcagttccttgacatagtaagggctgcattctaagtcattcaaaagagattttcttttcctaatcttaaagatgtgtaaaggataagatctacctgcttaatctttcagcctcttctaggaagtagcaatcctgtttggtaaaaatttttaagcctctttacccttgttccatcttttatgtttcttagagcccttcttgtaggatactcaatacatttcccatccctgccaagtccttatttttccatattctttttactttgtttgtttttcattggttatattatgtaacattttaataattttattgttctttagtggctcctttccaaattttattggtgttttaaaaatgaacccctgtcaaattgctgtagttatggttttttccctcccaaaaccttgggaaattgaatatgtaaattataccttatttatgtttattttgttgcttcctgttaatctaaatatttcattatgaaaatgatttatttcaatctttcatgcttctagatatattttaatctcatagatctgaattttctatgtttacgattgatataattctttttcagttgcttctgttgactttcacttttcatcttaggagctatttaaaaatcagtgaaaaattcttagaattttaattctgagctgtagtgtgatatcaggggaaatcttttaaaattagagaacgttgtaattaggaaagttaatactttaccttttaagaagattttttgtttttcttaggatagatagtgagtaccatggattttacatatgacacttaggactggttttccatctccttcatgactgtggaattctttttttagttcctttttttttttttccctcccttcctgcaggtgccattcactatccgtactctgttgtactcagaatacgagggcaggagacctgcctaaaatcagaattcttttggggataggaaggttcaaatattacttgcccattatactttttatgcatttaaggtaataccattttaagaagcagtttttaaacaaggttgacttaagaaaatcagtgtgtaatactttactgggagatatttgtgttgaactatttctcgtaagttatatataaataatatttcaaaatcaaattattttgttttttaaaggggtcctgttgtgagttattttataaagtgaagctattccctttttgtttctgtgcaaatttttacttgctggatttgcatgtttcacacatatagtcatgcgctgcataatgacgttttggtcaacgatggactgcatatacgatggtggcctcataaaagtataatactgtatttttactataccttttctatgttcagatacagaaatacgactgtgctacagttgcctacagtattcagtatagtcacatgctgtccaggtttgtagcctaggagcaataagctttaccatatagcctaggtatgtcataggctataccatctaggtttgtgcaggtatactcttatgatgttcacacaatgacaaaattgcctaactgcacatttcttagaatgtatccctgttgttaagcaacacatgactgtatttgtaattcttttctttaaagaacattttgagagaatgccaaaaaagggtcctggcccacgacgttggaatcttaacattttcttctgttttctctagctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatattgaagaggtcttgtttcagtagtgtgcaaacagtgaagttgaactggctaaaagaaaaaaatattgacatctttttttggaaggaaaaaaaagcaaaggcatggatgaatattacccctagcctataaaattttaatccatgtgataactaccgatgtcatcagcaaacatctggtgacttttggatgaaattagcgaccaatttatattggcctc

SEQ ID NO: 93035 - DNA, 1065 bp, Homo sapiens
cagtttccccatctgtaaaatgaggaaataatacttacctcattgttatgaaggtagaatgatatcatatttatggaatttttaagggttcatttcataggtttaatccagtaagtggttagaaatgacaaactgaatgaattattcaaattttaccacaaatgtgtggctaaatttgggcaggaatatgatgtctttgattctaatccatattttcacagtgtcatggttggtctatctttccatactggtgactttctccctttttttatttgcagtttcctgtttgatttgggctgggtaacaaaaatcacaaggttaactctttcagtacatacttattaggcattgctaaataccaggcactgggataggtatagaaaaataggtgaataagaagtggtctctgttctcagggagtttggtgtctagaaggtagaaggtagacattctagaaaaaccataaaaattaaatacagtgtttaatgccatagtagacaaatttggatgaggtaaagagcatttaaacagcatatcttggaaggtggacacctggggtcaaagtctgagtaggtaaacagaagaggtgagtaatcaccaagtggatggagctgaaggatatgagaataattggcttaatttttttggagtgtgtcatggagcataaactagactagaggtatagtttctttgcagtggaaccaggattccagagattacagtgaaatagacttggtagggaaagagcacagtaagggaagtcaatggatagggagtacaaagaaatacgaggataagagatggcaatgttaacattcttccagctgtactattatagattcgaagtaattacttttcccctcttaatgtaaaagcctttgagattgttgccatctgttacaaccagctatcctttttgctattatctgatgactcttactagatatgtagtatcattcattaatgacttgggtaactggacattcttccattcctgtttagcccatgcggttgaacccttcaacagcatagcctaggactaggttaactataaccccatgtgaa

SEQ ID NO: 93036 - DNA, 1268 bp, Homo sapiens
tattttacagtggtgttttgctttattatctttacatgctagataagtggagcaatttgataccttccactgttaatatatactgaataggaataattaaagggcaaaacatacttttttttttgatagggcaaaacatactttttttttttttggtggggcaagggtagattgaagctgtgtaaggcttgtgcatcatatcttgaacttaaattttgaggctgaaactaatgaccataataggcctgacatatttcatgtatttggagattactgggtagactttagaataatcaatttgagttgtttaatgttggtttttttccttaattagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggtaagaactgattaaatatttatctttccttattatattgttctaaaatagttgactctgtaaattggacaccttttaattattataaaattaatactgccagggtttatatcctgggtgtaactgcctattagctgtatgatgtaggtaagttatttaagttttagtttcttttttggtatagtggtattccacagtgttgttataaagattgagataatttatgcttagaacaaaacctgaattatatatatacagattcagcatctctaattcaaaaattcaaaacctgaaacttctttgagtgctgacatgaagccactagtggaaaatttgacacctcacgtgatgggttgcagtcaaaactttgtttcttgcacaaaattattaaaaacattgtataaaattaccttcaggttatgtgtataaggtttttataaaacttaaatgaattttgtttagacttggatcccatccccaagataatctcgttatatatatatgcacatattttaaaatctgaaaaggtttgaaatctgaaacacatctggtctcaggcattttggaaaagggatactcagctttctaagaaaattgtggctatatcactatcagttatatccttttcatccttatcatctgtggggtcatttgatgagatttgacctttcagccctttcattgatagcaccatgttaacttgaatgttattactaatacacgtatttttcaaatctgaagtctaact

SEQ ID NO: 93037 - DNA, 1051 bp, Homo sapiens
tggtggctgggactacaggtgcacaccaccacacctggctaaatttttttttttttttaattttttgtagagatggggttttgccatgttgcccaggcttgtctcagaacacttgggctcaaatgatccccccaccgcagtctcccaagtgctgggattacaggtgtgagccactgtgctgccctcatttattttttatgattcttttcttagatgaaattgtttcatgtaagaaaatataaattcttatacattttatacatttatattcctataaacttatatattataattcatattattttataatatattataaaataacaacataatttatatgacttataaatattttataattcatataatttttataaacatatgcatataaattatttcattgtatatgaaattctttcatatagtgattacaattaatcatttcctaggctgccttttatgtttgtctgtttctttgatatattctacattctattaattgttattctataatatgtttcagtataaagtaggacacatcttaacatagtgggttcagaacctgagctttgcagtcaaatgggcttgaatgacaatttgaactcttccacctggttatacaactttgtagttaacctccacgagccctggtttcttatctgtttaataaaatgaaactatgtgtttcacagaattgttaagaaaattgaacaagaaatctctatcaagtgcttgttactaaaacatgtttgaatgcattaaaattggtagcatttttttttttttttttgagactgagtctcactctgttgcagtggtgagatcttggctcactgcaacctctgcctcccaggttcaaatgattctcctgcctctatcttctgagtagctgggactacaggcacgtgccaccacgcccagctaattttttgtatttttagtagagacgggggtttcaccgtgttagccaggatggccttcatctcctgaccttgtgatccgccagcctcagtctcccaaagtgctgggattacaggcgtgagccactgtg

SEQ ID NO: 93038 - DNA, 1040 bp, Homo sapiens
ctaaaatgggcagaaatgaaatatttgccatgatctggaatactttaatttgtaataaactttagatgatcatttaggtctctaaggctgctaaagagatttcgatttagaaattgttcagtaattaaataactttttgattttctagaaacattatacttgcataatttggattttatgatttttcaatttacatttacccttttattatctgtgttaaagcaagttttgctgtgcactataataggtaaacacttttagtgcaaatgtaattttaaattaagaggccaaatagttttcaaatactaacagcatctttacttgcatttacataattagccccatagttgaaggaccataaagcttcagtcaggtagatctaatagcacttctattagaagaggccggattgtgtgtacttttaatattttgaacaaatttaagtctccaacttgaagttttcccatgtagattttggtgaaatgttgatttgattatttgcattgataaccctttcttgtttttcatttttaaaaatgagcctaaattactttcatctcctctttttttcttcatatgttctttaatagcaaactctttgtaagtttttttcttcttctccagatcctttcttttatgctcttggggaagtttttttataggctattccagcattttacagatttgttttattgatagttatgggaaagccaatttttttttttttttttttttttttgcttttcacctggctagcctgtgcgtctgtgtctctctgtctctctctctttctctctctctctctcccccctccctctcttcttccctccctccctccgtctccctctcttcttccctccctccctccctctcttcttccctccctccctctccctctcttcttccctccctccgtctctccctctccctctcttcttccctccctccttctctctctctgtgtgtgtgtgtgtgtgtaatgtgtgtgtgtgtgtgtgtgtgtgtaatgtgtgtgtgtgtgtgtttatgtgtgtttgaca

SEQ ID NO: 93039 - DNA, 1130 bp, Homo sapiens
tctaatcagagtataaagctcataaactttgaagggaaagtaatgtcttttgattatcttaatttctgcagttcctagcaccttgtctggaatgcagtctgcaccaaatagaaaattattcagagaattatactaacattaaaaatatatatagtaaaaattatgaatattgttcaatgaattcttctgtcataaatatatttttcagaaactttaattgtttagtgacagactcacataagataccacatggaatacctgatttcttaaatttggcagacagaggggaatgaatattttactgaatatctgtgagccaggcacgatgccatgatttgtgtattttttatttctgaatttcataactggaaatgtatttcatatatatgttatgtaccaaaacgtcccaaaaaacttacgtcacctttagaaaatcataaaaacctcatctttcctttggagagattatcatagctttttatctccatttgtgaattaccattttatagcattattatctatgttttcttatagctttttttgtgtgtaaatataaagtatgctttagttccagttggtagaactagttgccatgaaccagtggagaagagcaaccaaattttatttgattatcaataattggtttttagctatttagtcatatttattctggcttgttttgacctttaatatttttcttagataaatatttccttgtgtatgaaattatcactcaaaagatactcagttatttcccagattaaactatgacttgtactaaatatttagctttttttttgttttgagacggagtctggctctgtcaccaaggctggagtgcagtggcgcaatcttggctcactgcaagctccgcctcctgggttcacaccattcttctgcctcagcctcccgagtagctgggactacgaggcgcctgccaccacgcccggctaatttttttgtatttttagtagagacaagagtttcaccatgttagccaggatggtctcgattaaatgtttagcttttaaaagccacttgagatctctatctgctagcataatttagcatctcattttagaatgcatctgtatattttttattttgaaaggatatgatttctcttaatc

SEQ ID NO: 93040 - DNA, 1119 bp, Homo sapiens
tatttaagatacatagcttgttttgttttaatattgttagcttatgttttttttaattaaaaatattcaaaacatttttaatcttaatgtaagtattcagccctttattcaaagttttgtttggtgattttaaatggctagttttcattttgctggtaaaattgcacatagttattgatttagtattgattatgactttagctaaagatgtgtatatttacaaaacatagttggtgcatggaataatgaatgtacctttgctatccttctccttttgtgtattaggctactgtggagccgatatcaaggccctgtgcactgaagccgccctgattgcactgcggaggcgttatccccagatctatgctagcagtcataaactgcagctggatgtttcctcaatagtgcttagtgcccaagatttttaccatgcaatgcagaatatcgtgcctgcttcccaacgtgctgtgatgtcttcagggcatgcactatcccccatcataagaccactgctggaaagaagcttcaacaacatcctagcagtcttgcaaaaagtgtttcctcatgctgaaattagccagagtgacaaaaaagaaggtactctaaactacttttttatattgttaagatgaaacaaatacaggaataaataaatatagtttcctcataagattatttatgtgtcacttttgtaatatatctgtttattcagtactatatattccaggcctggcatattgcctggcatatggtagttgcctggtgaatgtttttaagacaaatgaatgaatgttcacttttgggacattctgatcatcttaatgtagggctattactatctttagaaagttgactgtaataataataataataggttaacctttaaagcccctaaatcatcacttactaatccttttttttttttttttttttttttgagatggagtttcgctcttgttgcccaggctggagtgtaatggcgcagtcttggcttactgcaacctccgcctcccgggtacagcgattctcctgcctcagcctcctgagtagctgggatttcaggcacctgccaccacgcccggctaatttttttgtatttttagtagagatagggtttca

SEQ ID NO: 93041 - DNA, 1115 bp, Homo sapiens
gttcagttcattgaaatttatgcctcatagagtatgatgaacagctgtgaagatagctgaccttttgttagaggttatggatttggtaacttttaccttgaaattcccaagttcttagaggtttttgcatgcatattgggtgtgatttttgcatagtgaaaaactcaacatacattgatatcaggaacatttgcataaatagtaggaaacttatgattaatgaaacactcaactctaatcatatttttctattccattttcaatgagagggctaaaacaatgaaagagtctcaatgaagtgacttatcttgtgggccttcattatgtgtgatgctgtacttaaaactttataaaattttgttatgaccttgtttctagtctaacctctttagtagctgtattttcagtctttttagaacaatttctagcttaatagcagtattcaggaatgctctttatttgataactaaatgtgttcacagagtattagaattgtaatggtagatttagtatggttatgaaagggatgtttataatttctttaatattaacttttaacgcctaaaaggctgtagtatattttcagtattactagaatgatcatattatttattttctaaacaaggacgctttgagagtgaaaagatgtgctattatgacaggacaagaggcctaaccagcacatgtggttaccctaagtataacccatttagccatggttatgatgcaattttaaagttttagaaggaagtatgttaaatcagtagttctcaattttgtgtgtatcagagtcacttctaaagctttcttgaaatgcacatatgatttcaagcccccagagattctgattcactgggtttattgtggggcttgggaatctgtttttttttgtttcagtttcagtgtttattcagatggataatcaaggtgagaaccacagatataaactggtaattcttacttataagcgaatgtaaaaaaatttccttctttataagtctgttggttataataattaatgtgaaaatctacttcattaaatggggtctattgatcatttctttgtctggaataaatcaataaataatacattgctgttatatatgtaattaaca

SEQ ID NO: 93042 - DNA, 1383 bp, Homo sapiens
ctacagttattttgttagcattaaagactgataagccgggtaccatggctcacgtccgtaatcccagcactttgcgaggccgaggcaggtggattgcctgaggtcaggagttcgagaccagcctgaccaatatagcgaaaccccatctctactaaaaatacaaaaattagctgggcgtggtggcgtgcgcctgtagtcccagctacttgggaggctgaggcaggagaattgcttgaacccgggaggcggagattgcagtgagccgagattgcaccactgccctccagcctgggcaacggaatgacactccatctcaaaaaaaaaaaaaaaaaaaaaaaaaaagaaagactgataaacgttattgtaagcagcagtgtttacaattcttttaattttgcctgaaaattattttacagctctatagtatcaaccctccttgctcttatggatggattagataataggggtgaaattgttgttattggtgctacaaacagacttgactctatagatcctgcactcaggagacctggtcgttttgacagagaattcctcttcaacctgcctgatcaaaaggtaagagtttttgttttcaatatgttaacatttatatgtaattctactataaggcatatgttctgagggtgatattttatgaattttcattgttcagattttctgcttaaggatatcttagctaatgctttaaaaacctatgtaattatggaacagtttttttctattaacaattataagaaagtttgtgatttttaggcagcaagaggaaagctcttgatagatcactgtagatgcttacttgtgctttagttctccagattgtagtaattgtcctgtatggcagtttctgtgtccctagttagccaaagtaactttattctcataaaataatgtttttatagagtattagtgggtttatgaataaggactcagtacctgaattttcatagaaattgctatatttaattaaaagcaacaaactttattcattatggtataaagtttttttaaaagaatgtactaataatacagggtaatgtttatcattgattctgtaaatgttatatgatatacaaatttttttttcccaattcaacttcaaacttttaatattattcttggtttgactagtataatctgactggcttttcattagaaactcaaatttgagaggaagagatacatgcaaaggaggtactgtatgtgaatatgtatagctttgtttttggacctctatgtgaaatgcctggtttacatacctagttgtgaaagtcttaagtgattcggactgtatggaagaccatagagaaacaaaggcaatggcttccctgtgtagagcagttcatacctcagtttgacatcagt

SEQ ID NO: 93043 - DNA, 1062 bp, Homo sapiens
ttgtgtcaaatagtttggacttttaatttccctacataataggagttgctaaaggattttgatccaagggttggccattcagattttttttttttaaagacaacttttggtataatttaagttagattgtaattctgtttctggccatgtctgagactttatcgtctgaagacttttcagttacaagacacttaaaaatgcagataaattccaacaaacacttgaaatgacaatctgtaattggaagataccaaggaaagattggaggttaaatatgaatttatatttgaggctacttatattccccaccccctttatatcttgaatgagaaacctaggtcactaattttcagttattcattttgaaaagaagaatcacacatccttccttcacacatacactgggtatctagcattttgattccgcttatagattttggaaacacagctagagcagtgtgtttgggaaggagaatgatttctttaacatgttgaacatattggagaagttattttaggcaggtgttagcaataagagtaaaggaatagaaatgagagcagttggaaaacactagaaagaacattgttactagaactacagtttctgttataattaggcatgaaacacttatattcagaaatgtttaagtcatactttttaaaaactactctaaaatatgcagaaaataattttgagttgaacataaagtggtagccattctaaagaaattgtccaaaggtgtaacgataatgtaaatctaatataatagaaactaaagcgtcatatacatttccagacatttaaaaaccccctagattgctatctattaaaaacaaactactgtattttttctttttaagaaaaacagctttattgagatacagttcacagtgatggcagcggcaggccatctggagtggccaccatcatcatgcctgctgtattggggaggtgtagccggggctgcacattccacggagcttttggaaactggggacaagtgggaatcccaccccttttgagtcggtgggatgggagctccctgggtgcagctgcagccg

SEQ ID NO: 93044 - DNA, 1114 bp, Homo sapiens
cgtctcagaaaaaaaaaaaaagaatattcagaagatacacatataggctgttagatttaaactgataaatgtctgttttctttaaggaggcactttttattcagattttgttctaatttatttttcacgtttttaaggatatggaaaatcttattaaagagtcatttgaatctatctatcattccttttgagtatttctacattatttattctaaagatgtgaaatttctgggtcattgggaaacacatttaaaatttctatatatcttgccaaattactctgtactttatttcttgtctgccaaagcttggtgatttaaggacttagcaaagtaaaacttttgtctatatcctggaaaaagctttatcaatgtctaataattatacttcaatacaaaattatatggaagggggggacattttttaaaattggttatcagcagtgatgataatataatttacacttcttgatttttttattcttctaggggctgtttgttttatggccctcctggcacaggtaaaaccttggttgccagagcattagctaatgaatgcagccaaggagacaaaaaagtggctttttttatgcgaaaaggagcagattgtttgagcaagtgggttggtgaatctgaaaggcaacttaggcttctttttgatcaggtaagagaaatcatctaattcaagagtcttttctgttctgttctgttcttttctttctttgtttttttgagacagggcctctctctgttacccaggctggagtgagtgcaatagcgtgatctcgtctcactactgtcttgacatccagggctctagcaattctcctgcatcagtccttgccccagtagcctgaactacaggtgtgcatcaccacgcctggctgatttttgtattttttatagaggtgggatttcaccacgttggccagctggtctcgaactcctgggctcaagcaatctgcctgctgagaatattttctttagaatatttaatacgtttaatctgcaaatacaaactgtttatgaggaagcatattttccatccaatatgttatattcaggattagtaatctgtgattgtatgccttagaggcatttaatggcagtttcac

SEQ ID NO: 93045 - DNA, 1539 bp, Homo sapiens
aggctgaggtgggaggatcacttgagcccaggaggttgaggctgtagtgagctgtgattgcaccactgcattccatcctgggcaacagagtgagatcttgtctcaatcaatcaatcagtagcttaattttattttaatcccatatattataatacatataggtttatttttattttatagttgtataacatgggataatcaggtatgttaagatgttttcctaaaatggaatagattgggctcttcgggcaaatagattaacgatcttgtttgctttatctagtgagtaacttaatttttggccattgacaagaatgtaagaaaagtagagtaaaagtatgaaatcctttgatattattttctgggttatgagaaaaaggagaaagatgaagacacatcaaagaatgtaaacttattttgacattaaaaatgtgaaacttttaatgcaactttacttgcacttttataaatttcagatgtttgcctatgaacttcagagcagaggacttagctagcggtattctccgagaacgagtgaaagtgggtgcaagcttggctgatgttgatccaatgaacattgataaatcagtaagttttgtaaatgtttttctagaagttttcttttttttaaaagtttttttcttgtttctaaagcagcacatagtagaactagaaaattcggatatgacagtgttaatgtttcgatgtatatgttttgaaacctaagaaccctagccacaagtggtgcttagtcagatattttcatttcagtgttactggaatatgtaacaggtaggaaatgaggctgagaaggttatgaggggcaaggcttcataaaccatgatgaacaatgggctgttgttgaaattgcctagtttcatgattttgtattttgggtagctcactctggctatgatatagttaatgaatttgggggaagcaaggctggcattagggagactggatgttgctgtagtctagtaatctggagtagtggtcatggtagaaactaggataactttgaagaagtaaatgggtttgaaagaattgaggattgaattcagaaatgacagaatttggtgaattaattgcttttggggaacaagagaaaggtacaacttgagagtattacccaggtttctagcttaggtgactaggtagataatggatggtctggatggagaatggcttgattctctgagtagggaacatgagaagaggaataaatgtttgaggcaggaagatgatttaattagttgtatttaactaatacatgtttaggtatctgaggtatactacaagtggaagcaccttgtaggtaatgggttatttaggtttggcattaaggagaaatacctggactagaaattcaaatacgggtcatcaatataaagagcggtgaggtcactttggaaaatagatgatcgatcacacctggggaagatacatagcacaaaaacaggcacaagactcggaggacatggtagattctttctcattgttagtagtatcttattttgggggatattttggaataag

SEQ ID NO: 93046 - DNA, 2480 bp, Homo sapiens
accatgcctggctaattttttgtatttttagtagagatggggtttcaccgtgttagccaggatggtctctatctcctgacctcgtgatccgcctgcctctgcctcccaaagtgctaggattacaggcgtgagccaccgctcccggcctagcatgtatttcctgaatgtcagtgttctacttgaatttctaaaagagtctttccagtaaaccttatattggctttaaactttttacaaattgttttattttatacaattacttatttttatacaaataaagataaaataattttatacaattattttgtacaagttattcttaataccatcttcaataaaaagattgaatttgtattttttcagtgtcatgtatctgataattattcatagaggcattatatattttttattgggaacttattaacaaaagccttatatttaaaaagttttattttaatgtatatattaaggtagaagatatcctggttttgcttttcttattgggcactgtattctgttgatggatgctggttatgaaagaggtatttaattgggatatggtggggcgcatcactgtaattgcagcactttgggaggctgagatgaatgaatcgcttgagcccaggagttcaagaacagcctgggcaacatggtgaaaccccatctccacaaaaaaatataaaagttagctgggcatggtagtgcatgcctgtagtctcagatactcgggaggctgaggtgggaggatcacttgagcccaggaggttgaggctgcagtgagccatgaacaggccactgcactccagcctgggtgacagagggacactctatctaaaaaaaacaaaaaagaaaaaaaagttgtgtgtagttacacatcagagatgatttgattacactttcacaaagagctcttttatgtatatggtgccaccattgtctaaatcctgattttattatgtgattgtagcactgctgaagctgtactacaggaaatggacaacattaacatccgacagaatcgtcgatcaggagaagtagaacgacttcgaatgtggacagatacagaatttgtgagtatattagctgtagcaatctttgtaaatatttttcattttaattgaggaatttaaagggagaatgcaacagttggatgtttttgaattagcatgagtgttccttcgtcttcatttccaacttagtttgggattttattgcttgcttgtttcttttcttcattctcctcttgctacaacctttccaagaagaccctcttcacttttgctggatgagtcaccttaaagtgcaactgtgattctgttattcttctgatttgaaccattaatggttttttgttgtgcactgaagattaaaaacaccttgatgttgatgatctggcttcaactttgttttctcacacaccattgcctaagtgtaaacaaatcattcttattcctataacttttactcttgttaatatttctagttagtgactgatgcagttctacctttgtttcaaggttcatttcagatactgcctctcttccctttaccccataacaaaaggagggtcttctctttgaattctggagtactttgtacctctctttatgacatttaacttattttactttcttttataattacctgtgattgtcttatttccctcctactaggctgtaatttgcttgagggagaaagtatgttgctggcattatgtgttttacatttttataagtttattgtaagtgttttcccttttatttcttacatttattgaatttaggaagctccattttcacgaatctatggcacgcaaataggtgctcaataaattttgttgagcaggtatgtcccattgggttgtttttttgtagtggagaataaatgtcatgttgctatttgacagatttctttctttaaaaggaaaacatggatatgtattcaagagtgaaaaggcgaagaaagtcactaagaagaaatagttatgggatacaaaatcatcatgaagtttctactgagggtgaagaagaaggtttgtaaagcactttttggaattctagaaagttcaggtgggagggaagaaaaataaaatatacaagtaatatatgtagaatgttgctgagtagttggtttttggattttgaggtctatattgtataatttgaaataatttaaattcagttggcaatctgagtttcatttccttcatttggaaaaatacttttaagtgcacattatacattatgtaatgtattttattagtagccattggtagtccttcagtgatctggtatgggatttactttgggctcatttgcttcttagatgaggccttttttgtacttaggcaccttctaactggatagttactttgctatccgtggcctctaaatctctgattatgtggatctcaaatttaggtatggtctgaggaataaagagtaaagtttagagagagacttctaataccagtggaaagg

SEQ ID NO: 93047 - DNA, 1661 bp, Homo sapiens
ttggatatttcaaaaatatcttagtttgcattgacaactcttttattatgcagcaatttagtttttacttttgaactttctgactgtactaagaagtatggtgactttttcctagtcctcatgttttgatggcctttttagtaactttccagtgatttacatttctcttcttccacccaaaagagagaattgtaaaatggctctttcgataaatcagctgtttgatttgtcagattaaatgtgtaataaaatactttgaagaaattattaaatgatattggtattcaagcacttttttcttactgtttattgtgttaataaatttatcattgtttgaattttatttcatcaaccaaaaccaataggtaatgcctgtgacccctgctactcatggtctcagttaattttatggtatatattaagcttaagccttttttttgggttttgatttgtagagttgatggcagagtaaacttagtgtataatctgttattaaagcttttcttgaagtaatgaaatggcttttaactagctagtatattttattaattgacatattaccaatcttacagtaaaaaaagttatctttacttttaaaaaagttttaaagattaaaataattccagcagtatttcatttcttgcttatataagcaaatgttgatgtgtttgcatattaaatattattgtgttctaggttaacttctcagcctggtgctacattaccaaatggacatagtggcttatgtgagtattctattataaaactggttagttttaaaattcttacaatgttagagaaagcagtaaagtggggaaaaatagagtgatttaatagtgtgctgagcatacagttggaaatggctgaatttcagtcatagtaaaaaaagtatgtaattgttaaactttgagaaatcagcatacctgaaatttaaattatttatgacagattgtaaaatttatagaaattttagattattgactattaaagccatttaaaaagttatattaaattttttgtagtcttttaaaagtaattttttgattttttttttcttttctgtctttctgtattctgtactttgaaatgtaaatatctctcttcttgtagcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaataggtatgaatgccaagtattaagcagtttcatttaattatttggtttttaagacagttacgttttaaaaaaataacataagcaacgacttagcaatcaatacagttctttaaaaacttaacttgaagctgggtgtggtgggtcagttcaacattttgaattgaagatgttttgagactgagtatgtgggattgagtctcttagctagtcagtgagctgactatccgttcaacgtctgcatctgtaaaactttactcttctcagataatatgtcatcctacttaatctttacaatagcctggagagggtggtcagtacaatcgctatttgacaagagaggaaattatattctacagtgataacatcaaatttgggcttaagttactattaaaacttaagt

SEQ ID NO: 93048 - DNA, 1382 bp, Homo sapiens
tacgcctgtaatcttagcaatttgggaggccaaggcgggtggatcacctgaggtcaggagttcaagatcagcctggccaacatggtgaaaccctgtctctactaaaatacaaaaattagctgggcatgatggcgggtgcctgtaatcccagctactcgggaggctgagatgagagaatcacttgaacccgggagatggtggttgcagtgagccaagatcgcaccactgcactccagcctgggtggctgagcaagactccacctcaaaaaaaaaaaaaaaaaatctcagtatattaaatcttttaatatactcatgtatttcatgtcgtgtctcctttttcagtctcccttttataaagatgatgatgacaataatctatgactataaggtcattggatcaattgaagaacaagtttttaaagattttttcttaaaacagatctttcattagtaataaaagccaagtaagcattgtcttctttagagcagacaaaaagcttattgtgcttttttccccaatgatgttaccattgttctgaaaagttttagatttcttttgtggaatgactttagggtctgcatcttattcttttgaacaattcaagtgatgtgaaattccaaccatttggctttgtatatagtcagaattcatttggtgccaagacttgtgaataaactgatcaagctgagttaatgctttgttgggtctaaagacaaagtatatttatgaagtaataaagttggtttttctgtgtggttttaagtggattttgagagtgattcttaagaattccaggaatgcattgtgtaatgacaacgttgtaagaatacctgtattacatccatttagttactttatagtcacactcatatacctggagaatcatgtgcattgtatacagtggtgctaaaaatgaaattttctccaagatagtatattaggtaaaggtattttttttgttgttttctagaggaaaggcgggggggctagatttttgttgttatttttttgacaatctgaagatgcgtagtagtatgagggttttttttgttttgttttttgttatttattatttattttttgtttttagacggagtctcgctctgtcacccaggctggagtgcagtggcgcgatctcggctcactgtaagctccacctcccaggttcacgccattctcctgcctcagcctcccgagtagctgggactgcaggtgcctgccaccacgcctggctgatttttttgtatttttagtagagatggggtttcaccgtgttagccaggatggtctcgatctcctgacctcgtaatctgcccgcctcggcctcccaaagtgttgggattacaggcatgagccaccgcgcccagcctgttttttgttt

SEQ ID NO: 93049 - DNA, 1313 bp, Homo sapiens
aggtgattctcccacttcagcctcccaagtagctgggactgcaggcatggaccagcacacctggctaatttttctatatttttgtagagacacggtcttgccattttgcccaggctgggctcgaactcctgagctcaaacaatctgcccacctcaacctctcagtgttgagattacaggcatgagccaccatgcccggccaaaaacatcctttaaagtctacatcaaataggttatttatttatttatttatttaaagagacaggtcttgctgtgttactcagactggtttcaaactcctggccacaaggatcctaccgcctgggtctcccaaaatgttgggattacaggtgtgagccactgtgcttggcctcaagtagttcttatccatcttttttaccactgccttccacgtcttatgtacatagtaggtcatcagtaaatgttagttaactgaaattatttcccttatgcctgaggtacttttcctactcatggattataatcactgtgacacagattgctaaatggctgtgggtagattgcataatcttttaaatatctttgtcatgaaactggtaacgccttctctcaaagggttaggttatcattagctagtaaaatgctttgagggaagatgaaaaagttaaggttgagggttatgatcatcctattaagggtgaattgttagcatcaggtttgtaggtagaagctttcccaaagcttgaagttaattaaatggtgctgaagtaattattttgtacctgtttacatcgtggttgcttactttacttaaatccctagatttctttggagggaaggagtctttggtaatcctctttattctgaggtctctgtcatagagccaaatcaagattgaaaccctcccgtgacaaaaaaagtaaatataccagtacattgtagcagttaggatgatgtgctttgtattatacttgaagtatgttatatgccagaggtcctcagacttttgtgtactaagaatcatttggaagcccttgttaaaaacgtttcacctccagagattccagtccagcaggttgtaatttttaatgagtaatgcaggtgatttttgattcaggtagtatgtaaacaacagtttgagaaatacttctgaatggaattgaaagccagtagaatatgcaaatggccaataaataaatgtgcaaaactcacttaaattgatattcaagtaactatatacttggattattttaaaaattcaaatattttactacttttttttttgtcttcagttcaatggtacatagtacttatttccagagtatgtttggg

SEQ ID NO: 93050 - DNA, 1394 bp, Homo sapiens
tctgtggcatttttcttttcttttctttttttgaaacagggtctcactgtgtcacccaagctggagtgcagtggtgtaatcatggctcactgcagcctggacctccctggctcaagcgatccacctacctcagcttcctgagttgctgggaccacaggcatgtgccactactcacggctaatttttaaactttttgtagagacaagtctcagagtctcctttgttggccaggctgttcttgaactcatgggcttaagtgatccttttacctcagcctcccaaagtgttgggattatagatatgagctatcatgcctgaccatgtggcatttttcagtacctacattgtctctttcttattttaaataatgtaatattttcagatttttagaaactaccttttagaaatttttatgtggaagaaaatgcattttaaattattatagacttttttaatctttctgtatctcctaaactaacaggtcgcttctatgtatttttttctctttctgtattctttcatgatgattgcttagaaatactaaactagtaagcccttgttcttggaatatttgagaaaaatttagaacattttatatgcttgccatttcaggactttgtagaatagtgttggccctaaataaataaatagcagtgcagagttttgttttttgcagtcatggtaaccactgcctctgtgcattccttttataaatgaaagaaaaagaaattgactgcacttctaagctttcttgtgaaaacaggaatacttgttaaagaaaaaaagtatacaaaaagcctgtcctataaggaaatcggaagagattgatttgtacccatacattttctgatctaacttgggggaaaatgttcctattctgttttttctttgtctctttgaggtgttttctctcatcatttacttactctttaaataatttgttttattctctcttacagttcccttttttctataagaagccaggttgtcttttcttaaagaaaaaaaaaaaaaaaaaggaaggaaaatcctttcctccaagtctaaactattctttcttttttaattctgacacttttgtaagactagctctgtagtcatcacctgtacttgctcaccacttgctccattattcacctagtgttttccaccccgcatttcacagacattgccctgtcagaagttacaatgatctcttacttacaaatcctcaggtttatcagctttcttctgttaaagtctttttggagcagtttaactcctcttgttttagtgagagactatatttgtctctgatttttatgacatctcttgtgcttatccccattaattaggcatttttttaaggttttgacttctgcccttctgtttttatactctgtacgttacctatg

SEQ ID NO: 93051 - DNA, 1002 bp, Homo sapiens
tctaactcatctgaagcaattagctcatcttcactcatcagtttgtggtcccatttttgaattcatggatatcatgctgtcctcaccccccgaggaataaggtgaggtaatttgtcaagcagctgttatagagatgttaaaaggctaggaatcaataatctaatgaggaaatgaacatttggtagcttttaaattgctaaaagaatgaaagatatgagagctctttgtagaagggtactaatgaaactttgtttcaaagatccttttaaaatgttttaaagcaccataaataacagggtactaaagatttactttgaaatatttgtttttcagtcttaagaagatttatgttcggctctaggagatgatgtagtcatctaattgctttctctgaaaggtttttttagagacgtaactactcttacatagtgattggacctttagaagaggataaattataattctgaatttattaagtttatggactatatatttatgaagcaggttgtatatttctggttagctcttctccagttttgtaggaatttagcactcctggttcaccctttctggagtacttaaagacaccctctatgtctgtggggtctgtaataagcatttgccagtgtctgtaaagtctcatttggtgcaaaatggggttgcccgtgttgttgctttcgcagacccttatttttgtagaaagaaatgtattcctgtttgtaacataatattcctgtttgtaattgaggagtttctcctttttctgcttttgtgccatgtttgtttgtttgtttttttttgagacggagtctcgctgtagcccaggctggagtgcagtggcgcgatctcggctcactgcaggctccgccccccggggttcacgccattctcctgcctcagcctcccgagtagctgggactacaggcgcccgccaccacgcccggctaatttttttgtatttttattagagacggggtttcacggtgttagccaggatggtgt

SEQ ID NO: 93052 - DNA, 1008 bp, Homo sapiens
gcctagagcgtcgctccccggccgccgagcgctgacgccgcgccgggggcggggcagctggaggcggcagggagaggagcgagcagccgggaagggctggccggcttcgcagcgccccgccgtggctgcggccggaagcggtctcgttggccctgcggcgctggagccttgacgcacggagctcgagagcgagaacgggagagaaaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccagggtaagagcgcggcgtcccgagtccggaggctcggaagtgccggccctgctgccggggctttgtctggccgggttgggggtaggaagcctacagtggagaccgctcgggcggctggagacagggtctgcgggcgcggtggagggtggcacccagagaagggccgcgacgctggcccctttgcttttcaagctggcccggctcttttgtgtgaagaacagcccttgagtccaggggagagggctttgggggtccctttcggcgtcattcgaacgatctgctgtccgtgtccttgtcctg

SEQ ID NO: 93053 - DNA, 1007 bp, Homo sapiens
gcggtctggggcggcggcgctccggctctgaagggctccagccaaacggagcccgcggccaaacggtgcctgcggtgcctgagctgagtgaggccgaggccgggaggccgtgcccggaggtgagcgtcccggggccgcgccgcgtccggcggggtgagggcggggcggggcggtcgcctgccggctggggccgaggggtcgcggcctgtggcttggccgccgcggatcgtcggtgtcggggggagtctcgctccggagggccgcgtgtttgcgactcgggaaggggcgccggcggcggagcccgagccagggtcccgcccagcccaggtgagcggcgaccccgagcccctgactcgcctgcggcttgacttgcgagctagctgaaggcacagctcctggttctctcgcagggcgttccgaaacttacagttatgcgcaacacaatgtttctattttcaaaggcgaacgctgcacgatcgcagtccagtgatacaaagtatgcctattagtgacttcacccgactcccaccactcactttctctgatgttttgaaggcctggtgttcgctgatttcacgtttccttaatttcttctttgtgccttttttttttccttttcgctgccagtaataaaagagtttattacttgtcagcaatgatgaatgttcgtgtggcatccagcgttgagttcctatgtacgtaatttgagataagtaaagataggaaactgctgatttgttttgatgcgaatgcagaaaataatgtggtagtatgaagtctggccggttgcagtttgtttttaggggggaaactttaaaagttcatgttgtgtcttctttctaaatatgctgaaagtcggatttatttaaaaggcaattaaattcagtgaatacagagtatctttttataacactaatgttagtgctaggcactggcggagtccaaaaatgtgtaaaaaatgtgtgcaggagggagtggttaagcacactaatgatatgaggctgact

SEQ ID NO: 93054 - DNA, 1024 bp, Homo sapiens
ctgggcaacaagagcggtactccatctcaaaaataaataaataaataaataataaatgtgatccacccaccttggcctcccaaagtgctgggattacaggcatgagccactgcgcctagccattttttgtagagtcagtctcactattttacccagactggtcttgaattccttggcttcagcaatcctcctaccttttcctcccaaagtgctggaattacaggtgtgaggcacatgcccagttcatttgttaagtcaaatggtatattatactttttttcataataagttttaagaagtctttcttttgtcagattatcagacttaaaatgtattttctatcattgctttattttgatgatgaaaatgacagctttgagtttgctcactttttctttagacacttttaagtaatactttaggactacatggtaacttacatattaagctttttacttactttctttttacttactttctttgtacttttacagtaaggcgaaagagaatgaaagacgtagataacctcaaaagtataaaagaagaatggtaagttaattcaaactgaattgctttgttaatgcctttgttaatatcgtcctgtatttttattacatttcacttgcagagatagtagagtacgttttaattatgtatgactacttcattgtcatctactatgttgaagtaatttttttaccatagctgcattaaacaaattttattgaagttactgaatgttttttattaattttaaaaagttaaattatctgtgttcatacattacttctgttatttgataaattaaataactatttacctcattagcctcttgtgatagatacactattttagtgtcatagtgggaatatggctttggagtcagataaacctaggcttgaatcccgtctctgccttctattatctctctggcctttgggcagcttaggtaaattctttgagcctcaatatctcatctataaaataaggatacaaatacctacctatctgaaaggttttatgt

SEQ ID NO: 93055 - DNA, 1006 bp, Homo sapiens
ttgttcctgatgcattatcccctttagttcaaaagtgttttctgttaccaaaaaaacgcatagtaatcccttttaaagtcattttgagccctttaaaaataacacatttttggccaggagcaatggctcacacccgtagtcccagcactttgggtggccaagacaggcacatcactggagcccaggagtttgaaaccagcctgggcaacacagtgaaatcccatctctacaaaaaattagctggacatggtggttggagcctgtagtcccagctacttgggggtctgaagtgggaagattggttgagccctggaggttgagactgtagtgagctgaaattgcgccactccactccagcctgcacgacagagagggaccttgtctcaagaaaacctcaaaaaacagaacaaaaacaccacacattttctactccagaccagtggtttttaacctagagagatttttgcccctagatgcatttggcaatgtgaagagatgtttttggttgttataacactggggattggggatggggcagggatgtgcatcctacttgttgtatctcatgggtaaaggccaaggatactgtttaacattctgcaacagtgatccccaacttttttggcaccagggactggttttgtggaagacagtttttccacggacctgtcaggagagaaggggagaaggggagatggttttgggatgattcaagcacattacatttatttgcactttatttctattattattacattgtagtgtataatgaaataattatacatctcaccataatgtagaatcagtgggaatcctaagcttgttttcctgcaactagatggtcccatttgggggcaatgggaaacagcgacagatcatgaggcattagagtctcataaggagcctgcaacctatatcccttggatgctcagttcacaggttcatgctcctatgggaatctaatgccaccactgatctgacaggagacagagctcaggtggtaatg

SEQ ID NO: 93056 - DNA, 1030 bp, Homo sapiens
tagaaaattgccactataggctgggcttggtggcttacgcctgtaatctcatagctttgggaggccaaggtgggtgaatcacttgaggccaggagttcaagaccagcctggctaacgtgctgaaactctttctctactaaaaaatacaaaaattagctgagcttggtgatgcacgcctgtaatctcagctactcaggaggttaaggcatgagaatcacttgaaccagggaggcggagctcgcagtgaaccaagatcgtgccactgcactctagcctgggtaacacagcaagactgtctcaaaaaaaaaaaaagaaaagaaaaagaaagcaaccataccttgacagcttctcaaaacttaaggaatttcctagtgagattagtgtcattttgataaatataaatttttttatataattaaatgtgtcagcagttggaagatctgcataatcaagaaaaccagtattttccaaatgagcaatatatgatgttatacagtgatgcatgagtaaaagagccaaagaatcacatatactaaaagactttaacgtaacaagtatatgaaaagatggttggtaagtttcagattccacattcagattctcaactaacttttgagatactactactacttattacattttgaagaagtgtcaaagaagattatcctgggaaggctattaaaatacttctttttctaactacataactgtatgaggtttggttattaaaaaaaacatttcaatcaaaataacatgtcaaagcagactgagagcggtaccaattatgagaccccagctgattttttgacgtgagacattttaaaaagtgtttgtgaaaaatcctttcactctgattcgctttttaaattaaaacttaatctattagttgtgaaaggcttatgttgaaaaaaggcttatgttaaaaagcagacttattactccttgaccctagcatctactttcttttttcgtttttttaagatggcgtttcactactgttgcccaggctggagtgcagtggtgcgatctc

SEQ ID NO: 93057 - DNA, 1015 bp, Homo sapiens
cccagccaagtattttaaattttaccactatgaaaaatatttttgactattttcttttatttatgtaaaaaaaaaaacccagctatgtttagatataattaacctaccataaaattcatccctttgaagtatatagttaagtatttttaatatgtctacagttttacaatcatcagcacaatctaatttcagaatatcattattgaaaaagccgaatatattgctgaaagaaaaaaaaatcagatactagaagtcactctccattttcccctgcagccctaacataaccatgaatctactttctgtctatctctatggatttctgtcactatgtatttacctgttctactcattttcacattttgggctattatgaataatgctactatgaacatttatatacaagtttttgtgtggtcatatgttttcatttctctcaggtataaatctaggagtggaattgttaactcttatattaactttatgaagaactgcccaaatgtattccaaagtgactgtaccatttaacatttctaccagctatgtatgaggcttccagtttttccacatcctaacacattagcttctgtttttttaaattatagccattttagtggttgtaaaggggtatgtcattctggttttgatttacatttctctaatgaccagtgatgttgagtgtcttttcatgtgcttattgtccattcgtacatcttctttggagaaattcctgttcaaatcctctgtccagtttttttatttgtttgtttgtttgtttttttgagacagagtcttgctctgtcggcgaggctggagtgcagtggcatgatctcggctcactgtaacctccgcctcccaggttcaagtgattcttctgcctcagcctcccaagtagctggaattacaggcatgtaccaccacatccggctaatttttgttttttagtagaggcagggttttaccatgttcgccaggctggtcttgaactcctgatctcacgtgattcacccgcctc

SEQ ID NO: 93058 - DNA, 1020 bp, Homo sapiens
ttggggggcagtggttcacgcctataatcccagcactttgggagtctgagggaggaagattgcttgagcccaggagttcaagaccagcctggacaagaccctgtctctacagaaaatttaaaaaatatatgctttcacaataaaaaataataaaaactgatgctgttcatgagcttatggtcttaaaaattatattcctgtgggtttttggtattcatattatttaactacattgttttgaatacatttagttatttcattgtatagaatattatatatttctgtatatttctacatattcattttttgtatgtacagaatgtttttcagagaaataaaatacattgggagctttatcattttctttctttgttttccaagggaattaccttcagaattacagggaatttttgataaagaagaggtggacgttaaagttgaagacaagaaaaatgaaatatgtttgtctacgaagcctgtgttccagcccttttcaggacagggtcacagactaggaaggtaaatatgcctattgtcttgttttgcatagatcaaggcttaactaatattctgtctatcagtattttacccatgtagaccacatgaatggagcttatcatttctcccattggaaatcagattttttttaatgttaatttttatgaggacacataagtcatagttacctaagtatatattaacaatgcctggccaggcatagtggctcatgcctgtaatcccagcactttgggaggccaaggtgggcggatcacctgagatcgggagttcgagaccagcctgaccaacatggagaaaccccgtctctactaaaaatacaaaaaattagccaggcgtggtggcatgtgtctgtaatcccagctcctcgggaggctgaggcaggagaatcgcttgaacctgggaggcagagattgcggtgagccgagatcgcgccattgctctccagtctgggcaacaagagtgaaactctgtctcaaaaaaaaagaaatgccagcaatacag

SEQ ID NO: 93059 - DNA, 1086 bp, Homo sapiens
atcaagattggtaaggtgcatacatattcatccacacatacaaatatatctggatgcatccttcagaatgatcaggaagtactttatttagtttctttttcattataacctaaggactaagctcaataaagaacttataatttcttctagaaatttaacctgggcagtaggtaaaggtaaagtccatagatctatgaaccttctttaaaattatccattctgtaaagcactactcaaataataccagtaataatatatgtagcttacaaattactcagatatgtataacttcatcagattcttagaaccatcatatattgtggacataaataatatatctttctgttattactgaagaaacacatataacttaaaaaatcttccttaaagttatacttgctataatatttttatagtaattatttaataataaagttttattgaatggaaaaaacgtctaactttgttgtctggatttccttagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcataggtgagtcttcaatttcagtatttgatattttttcaccaagttaaaatttcattttttctttttggttcagtcaacagtttattttttagagatagaatctttctttgttgcccaggccagagtgcagtggcacagtcatagctcactgcagtcttgaagtcctggattcaagcaatcctcccacctcagcctcctgagttgtagaactacagccacatgccaccatgcccagctaactttttttttttaatttttatttattgccagctaattttaaaaattgttttgtagaaagggagtctcactgtgttgcccacactggtctcaaactcctggactgaattcatcgtcctgccttagcctgccaaagtgctgggattacaggcatgagccatcgcatcctgccaagcattttatttatttatttatttttttgagtcgga

SEQ ID NO: 93060 - DNA, 1341 bp, Homo sapiens
atctgtgaaatgaggatgcattctataatccatggctacatgacgatcatgatacaattgtgacagcctctgtaaaacatagccataattcctttgtcttacctaagataattaacagtagtaattcatagtactaattatcttacctaagataattaacagtagtagtagtattgtcatcaaatttctgggagtcaaactttaaaagatagcccaaataatcagttatatcataaattcagttattctatatattaacatatccagagtctgggtgttgtggctcatgcctgtgatctcagcactttgggaggctgaggcaggaggatcagttgagcccaggagttattatgatggcaccactgcactgcatcctgggtgacaaagcaagacgctatctctaataataacatatccagatacttttaccagttgttgttactataaattaggtaattcaaattttcctaaaattatattaatagtttttgctgttttacagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactc

SEQ ID NO: 93061 - DNA, 1077 bp, Homo sapiens
aaaaaaaaaaaaaaaaagaggcaatgataaaatcaatgagcttatctttctgatatagaaaataacaggatgacagttaatacatgttcaggaatctaagaaaatgtttcatataggcctatcatgtagcatttttatttgcataattatagtcaacatatgattctccatgtaggggtctctcattgagaatgtttcctgtgtacctatagaaaagcctctttggtagattttccggtttataattatttaaccagaagatacatgggaggttcttttgtatgtacctgtagaatacatcccagtaagggtcctatggagaaagacctgttgtcatcaataaccttcattattctaactgtgaaacgttcattaatgcgaataatatcctcaaagattttctacaatgagaatcatccagtaaagctttttaactgagaatttaaaagttgtaaaattgttagttaaatgtgtataattatcaaaagaggttgactttggaaaacaaacaatttgctaagggaaggaaaacttgaaaataatcaccttagatggggcatacaatttgacctaagcaattgtttcaaaactgtcttcagtttcttgaaaataattgttagggctgatatatagaaatacatatctaggccaggcacggtgactcatgcctgcaatcccagcactttgggaggctgaggtggatggatcacgaggtcaagagatcgagaccatcctggtcaacatggggaaaccccgtctatactaaaaatacaaaaattagctgggtgtagtggtgtgcgcctgtagtcccagctactcaggaggctgaggcaggagaatcacctgagccccggaggcagaggttgcagtgagccgagatcgtgccactgcactccagcctgggcaacagagcgagactccgtctcaaaaaaaagaaaaaaagaaatacatatctaatgttacagattgtggtttattggttaattactatgcatttttttcagtttaaaaaataatcttattttatatacttctctcggtataatttttcatgacatttcagcatgttgataatat

SEQ ID NO: 93062 - DNA, 1051 bp, Homo sapiens
tctataatgaatataaattatctgtgcaaaaaatacattaaaacaaatgacaaagccaaatactggtctactgaataagccatttccatctgaaggtttagtgcaatgagcaattttttcataaaatggtttgtacttaggaaaagaacaaaggagtaaaccctactaaagagtcttcatgctagttcagctgataacacaaagaataaatgaaaaattaaacatatcattgagttagtattcaaaaatagcacatctttacatttctgagtattaaatgaaagtaatgttggttaaagcaaaagcacctaataaatgtttgttgattatcaaactgaatgactttgccaaataaaatgacaagtgtatttgcatataactattttataacaagggtaaatgatttcacagatccttttaatgaacagtatttcattaacagttcttcaactgtcagcaaaagattgctctcaaaatactttaaggcactgaaatagatgcacacatattatcaacatgctgaaatgtcatgaaaaattataccgagagaagtatataaaataagattattttttaaactgaaaaaaatgcatagtaattaaccaataaaccacaatctgtaacattagatatgtatttctttttttcttttttttgagacggagtctcgctctgttgcccaggctggagtgcagtggcacgatctcggctcactgcaacctctgcctccggggctcaggtgattctcctgcctcagcctcctgagtagctgggactacaggcgcacaccactacacccagctaatttttgtatttttagtatagacggggtttccccatgttgaccaggatggtctcgatctcttgacctcgtgatccatccacctcagcctcccaaagtgctgggattgcaggcatgagtcaccgtgcctggcctagatatgtatttctatatatcagccctaacaattattttcaagaaactgaagacagttttgaaacaattgcttaggtcaaattgtatgccccatctaaggtgattattttcaag

SEQ ID NO: 93063 - DNA, 1025 bp, Homo sapiens
cacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaa

SEQ ID NO: 93064 - DNA, 1057 bp, Homo sapiens
tgaaaccccgtctctactaaaaataaaaaaaaaattagctgggcctggtggcaggcacctgtaatcccagctactctggaggctgaggcagaagaatcgcttgaacccaggaggcagaggttgaagtgcgccgagattgtgccattgcacttcagcctgagcaacaagagtgagactccgtctcaaaaaaaaaaagaagaaaaataataactctacaatattttctgatatccattccatactcagatttccccagttctaaaaatcttcattaggtagaagattttatttcttcaagatccaaagtatatacattgcatttgcctgatagctcagtagtctcttaatttataatactccccctgtccttttgtctctccacattattaacctgggaaggggctaagccgttgtcttaccaaatgtcctacattctagatttgtctagatttctcatggtgtaactttccttcttaatcatttcaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttggg

SEQ ID NO: 93065 - DNA, 1720 bp, Homo sapiens
caacgtagagccagtcagggtggcaagagcacctgtagtccccacaactcacgaggctgttctgtgtagtagctgtgttcttagtattcctgatgtgacagtcagcttgacctatggatattttagttaagataaaaacgaagaacaaaattacctaattcaagaaattacaggcttatccggtatatctatccatgtttatttcctctgatggtttcaggttgatttcaaaatacttaactaaaaacgtatttcaatttactgtttttaaaagacagttaccagtttaaaagacagttctgtaagtcaactatcaatgctcaggtaaatgtatatcttaattaagtttaacttacctctccagggggaacacacctgaaactagaggaacagcttatgtggtctatgaggacatctttgatgccaagaatgcatgtgatcacctatcgggattcaatgtttgtaacagataccttgtggttttgtactataatgccaacagggtaagtatagcaaagttctcattgtgtagtgatctcatttgagaattagtgtagaactggccgggcgcggtggctcatgcctgtaatcccagcattttgggaggccgaggtgggcggatcacgaggtcaggagatcgagaccatcctggctaacacggtgaaaccccgtctgtactaaaaatacaaaaaattagccgggcgtggtggcgggcgcctgtagtcccagctactcgggaggctgaggcaggagaatggcgtgaaccccagggggtggagcctgcagtgagccaagatcacgccactgcactccagcctgggcaacagagagactccgtctcaagagaattagtgtagaactgtactgtgatgatatatgtctactatgactttcttttttggctaatgctattgatgaaattcatttggctgtagattggtaatttaattttggtgcttaccacatttccaggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacacctcagtcttttctcttgaactttcccttcctgtttgataccaggaaaaaacagttgaagcttatcaagaattgtaggtgctcctagggattctgagtttcttgagaacaggatctctttacattcttaatgcctccagggcccggtgcagtgcttagccatcaaaggaacttgctgtttattgcatgtccattaataatgaaatcttcataacaactcagtgaagataggtatttgcattttgcaggtgaggaaaccaaagttcatgatgttggttgaatgaataaaatgctaacatacaaagctggtgtgataacaaccagttattaaccaagcctttacatttgaataatgcttgctttatagttaacaaaacacctgtgtcaatatgggtacccttgtctttagaacagaggtctattatagaaatggtcatttagatgatagtacattgttagaaacttagatttgcctctttaa

SEQ ID NO: 93066 - DNA, 1002 bp, Homo sapiens
cccggccagatagttgactttttaaaagatgtgtgatataggtgtatctttatgccaatgggagcaatccagcagagtgtgcgaaacatgatatggaagaaagataggttgagtttagaagtgaaggttttgagtagatgaaggttggcgtagtaatagagggaaagtagttggatatagatgaaaagtatttcaattggtcatgtctattttctccaagaaacaagaatcagggtcatctcctgggatgggcagggaagagggtacagcccaactcaggtgttagcaggagtgatggtggtaaggtttgcaaaggcctacacccaccaccatgcctggctaattttttaaaatttttgtagagatgggggtctcactatgttgtccaggctggtctcaaactcctgggctcaagtgatcctcccactttgcctcccaaagtgctgggattatagggaccagccactgcacccagcctctgttgctttttcaaagatctgcccattttcagaaacatcaaattatacctcttattcttggctttttattattacgtatcattaagaattttttaaaatgcccctaattataggggcatttaaattataattttttagaatgcccctaattataataacaatacgtatttctcattttagattcgacttccacctgaagtaaatcggatattgtatataagaaatttgccatacaaaatcacagctgaagaaatgtatgatatatttgggaaatatggacctattcgtcaaatcagagtgtgagtcttactgagtcatttaaagaaaatgatagcataatctgtaatttcagaattatagctgacgatgaggccaccctgtgctgtgtgcagtgcgacaacccttaccaagagccttgagactagcagattgagatcagagagatgagatctttttgaaggggggagaaaacctactgagaccctaatgatccagctcaatgagagccaagaagaggatttga

SEQ ID NO: 93067 - DNA, 1060 bp, Homo sapiens
ttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacgtgagtatcgggtgttctgcggagggtgggagaacttcgggtttgactttcttagcggcgtggatcggagcattcttgctcctcctccgtccccagagcggagaactccagaattcctatcctgtcagcgaagacactatccggccccatcctcagagatatgctccttgagccacatttctgtccccaccccttttgagagttcctcagtctctaccctagtgtcagtgatagtgttacccctatagcctctttgcttgacccgcacctaaggacctggcgttaggattatctccttgacttaaagtcgatatctcagaagagtcctcaactaacttaatggttcaccaacaactaggacctgggattcccctcagatcatggtgcttttcggatccttcattaacacattaattaaaacaatattttttgagcacctactatgtattctgcttgccatgtgggacataattcatcaattatatttattgaatagctactatgtgccagacactagtcttacgtattgggaatacagcagtgaataaaacaagtccttctgcttacattctagtgtttgagagtacagtgttacggaaacttttaaaaaaaaaaaactcaaaaaagagattagtcaacagtaaaacgcttagaggtgtaagatgaagttaggccgagtgaggtggctcatgcctgtaatccccgcacttttggaggctgaggtgggaggattgcttgagcccaggaattcaaggctgccttgagccatgattgtgccactgcgcagcacttcagcccaggagacagagcaagaccctgactcaaaaaaaaaaaaaa

SEQ ID NO: 93068 - DNA, 1034 bp, Homo sapiens
tttcactctgttacccaggctagagtgcagtgtcccagtcatggtgtactgcatccttgaagtcctgggctcaagtgattctctagcttcaccctcccaggtagctggaaatataggcaggcgccaccttgccttgcttttgatttgttctttagtctttctccccagggagagcaggcatgttgccccaaatacctgtgttttccttgtttgcagcagagtgtatgtcacatagtagaagttaaagccaaagaaacgattgaattaatgaatgtctctgtgggttattcttaggagtaatttaaacttatgaagtttaagttttggaaaattttagaacaagaaagctttaggataatatatttgtcttttctaccactgtttactaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaaggtactaagagatcatttgatgcttttttcagttgatttagacctaatgtcatctttgttcatttataatcattcagtcagtctgtccctgtcccctctacatatgtatcatctataccctgttacataatagcataaagtattcttaaacccaggacatttggaaaggagagaaaaggaagattagatttaattgtctacattagaaccatttttctgtgttttccccatgtggttattattattattattcgagatggagtttcactcttgtcacccagactggagtgcaatggcacgatcttggctcactgcaaacctccacctcacggcttcaagcaattctcctgccttagcctcccaagtagctggaattacaggcatgtgccaccacactggctaattttgtatttttagtagagacagggtttctccatgttggtcaggctggtct

SEQ ID NO: 93069 - DNA, 1460 bp, Homo sapiens
cttccttcactatacctgattgcttgaataaattaaatttaaaatgtagccttgtctttctttttgcatttgtcactgatgctgctttcaagcataagaatgatactatgtgtttgactctcaagtcctgatatgctcaaaattaactgtgcacctcttgttcttgtgtatcgttttatttccttgctatagggaaatgcatttatagaacattatgatccaaaagagtatgatcccttttatatgagcaagaaggaccccaattttctgaaggtagggtagatttcttttttttaactttggtattatgtgtttggttgttttgagcagccctaatatatgagcagtccttaagcgattccctaaaagtgcagtaacattttaagcatagtttcccatcgcctgatcttagaaaggaacaaaaagccaaaggccaaagtaaattaaatctccataaaagtggaaaatactggataatgattgggtaataggtaacgtttaaaaattccatagacttttaaatttgttacaaaagtaacacattttcatgatagataaatgagaaaattgattttcaaattaagaaaataaaaaaccaaaattctattacccagaattaattcattatgttaactcattaacatttttctgtatatctatctagacttctttctatatgtgtgtatgtattcacatttttattttataagaatggagttacatttggttttataatgagcttcccctccctcaatagtttattatttgcttctttctcaaaatataagtatataattttcttcattgcatgatattctgttactaatagcagaattaattaaccttgcactgaaggattaaccaagtcttagggtttttttcacatttatttcacctttgctgctactgtgtgaggtaagtcacagatgagacaagtaagattcaggtcacttgtcaaagtcacccagctgtaaatagcagagcacagatgtggtgttttgttttgtttcgttttttcagagggagtctcactctgtcacccaggctggagtgcagtggcgcgatctctgctcattgcaacctctgcctcccgggttcaagagattctcccacctcagcctcctgagtagctgtgattacaggcgtgtgccatcatgctcggctaatttttgtatttttagtagagatgaggtttcaccatgttggccaggctggtctcaaactcctgacctcaagcgatttgtcctccttggcctcccaaagtgctgggattacaggcttgagccactgtgcctggccttatcttgtataaaatgttgttttgaaatatgtacacattgtggaatgactaaaccaattaacatacattgcatcacaaacaccagttttttctaagtaagaaacctaaaatcttctctctctgcaattttcaagaatacaataccttgttattaactata

SEQ ID NO: 93070 - DNA, 1117 bp, Homo sapiens
tccagattcccacaaatttctaattcaaggcactttataactccaaacgagtggctgaaactgcctacaagatacatagaaagtgaattttgtagaaggagaaggtaatggttaatatactagaaattatagaaccttttggactttgaaaattcttcagactgatataacatttttcatagttatgattttttaaaattatcatttttctttttttttgagacagagtctcactctgaaaatttcatttttcaatgaaaaatccataattcttatctttgtttctctgtatgtgatgtttcttttttcttgggtactttcaagattttctgtttctctttggttttcattagctagattatgatctgtttatatttgtttttttctgtctatcttaatgttctctgaggttctcatatgtgtggttttatgtcttttattattttggggaaatcctaggccattatcacttcaaatatttcttatttcctgttctgtctactttttttcttcctcctgagactccaattatatgtatattagatcacttgatgatgtctcacagtgccatagctcttactctgttctgattttccactctttttttccttatttgtttttcagttggatgatttctgacttgtttttaagttcactgcccttccttagctgtgtcctgtgcccatcaaaggaactcttcatctttgatatcatgattttcaaatttctagcattaccatttgaatttttagatagtttttatttattctgaaattcttcatctgttcatgcatgttgtccaccttttccactagattctttaccatattaataatttaaaactccctatctggtagttctaatgttagggtcatttatgaatctagttctcttgattgctttatctcttgacaatggcttgttttgccttgccttttttttttttttttgcatgtcttgtaattttttattgaatgccagatatttgatgtagaagaatggtgtacatggagtatttatgtctagaaatggatatgcctcttcttctgtcaagcattagtgtggaggattagccttatctagttggaattgagttgggtttgggtaatgttattgc

SEQ ID NO: 93071 - DNA, 1027 bp, Homo sapiens
ggcgtggtggtgggcaactataatcccagctatctggaaggctgaggcaggagaattgtttgaacccgggaggcagaagttgtagtgagccaagattgtgccactgcactccagcttgggcgacagagcaagactctgtctcaaaaacaaacaaacaaaaaaaccaaacagcaacaacaaaacaagtagctaatacagaaataacaaacacagaaatggaaaaaaaattgttaacaacttgtactaaagctaaaaggttaggagatttaaaattgaattggagtagtataaatggagtttgggactggtttgggtgggtagtagctgttacaatgttgtacctagagtgaaagatgttgttgtaaacagagaatggtacatactatcaaatactatgtatataatgtggggaatcatctcagctaactagttttagaattaagagatttctctacataattatgtatcttgtgactatctggttaaaagtcgtgctgcccctcagatattgctggagggaatgtaaaatggtgcagcaactttggaaggcagcttggcagtttctcaagatgttaaacattaaattattatgtgacccagaaattccgctcctaggtttctactcaggagtaatgaaaacatatccacataaaggctaggatatggatgttcatagcagcattattcacaacagccaaaaaagtggaaacaacccaaatgtctatcagctgatgaatggataaacaagatgtggtatatccatacaatggaatattacttggcaattaaaaggaaaaaaatactgatacatgctgcaacatagacaaacttcaaaaccattgtactcagtgaaggaagccaataacaaaaagctacatatagtatgtttttttatacaaaatgttcagaaaaggcaaatctgtaaagacagaaggtagatagtagttgcttagggctggggatgggagtggagagtgacttaatgagcatggagccttggggttaatgaaaatgttctaaaataaga

SEQ ID NO: 93072 - DNA, 1006 bp, Homo sapiens
gctctggggcagggagaagactgtctcgggagggggcaggctccctttcttgaaatggctggtgattccacaggactgactcagggactcggtaagctgtttatgttttattctgtcctctacatatatttcataatacaaaggtgatgataataataataaaactataaactactaaaagacaaaagtgtgactagttacaagagcttcagtaggaaataaagtaagttgcaagttaaacaaatatttgtttgttctgctcatctgtacctgtatttgtaagttttactcctggctcttgcagaggctttatgccactcttttggaatcacacagtgtgaagtgaaagtgaagtagggcgagctggcatgcagcctggccttctctatttcttcaagttcttttatggaatgtcgttttcctacaggaagataaaaaatcgaaatcaacactcttcaagaactccagttgctcttgaaggagtgagaaatcactggacaattagcagtctcaaaaaaatgaggcccagtgatcacaaagcacctgtctcacactgaagaccagttctcctctcttcatccacctcttgctgtctttgaaacagaggatcaacaaatggtgggactgtaacctacaagagaaatgagactctttgagtaccagagtgcagtctgtattaagcttttaaaatgtgtcccacataaagatgggaacaatagaccctgaggactacaagagtgggaagggcaggagggggcgagggttgaaaaacgacctattcgggactctgcttactaccagggtgacagattcaattgcaccccaacctcagcaccccaacctcgtaccccaatatacccgtgtaacaaacctgtatgtgtacccccgaatctaaaagttgaaatttaaataaataaaatctgacctaaacattcaagtatgcccttactgtataccaaagcagctgagaagaaaggccccagaatgtgccaatctacacctcaga

SEQ ID NO: 93073 - DNA, 1075 bp, Homo sapiens
cagcatctgcatatgttgctgtgcatcgtccgtgcgttcagtccttcccacatttgtcaattactttgtgccaggctctgtgctaggcttaactgagcctggactttggtatctgatgtttaaatgttgaccctgccatttagcagctctgagtggatcacactccagtcctttctaagcctcagtgtttctcatcagtaaaatggggagctacattatcaggtaattatgcagtttaaataatataatttacataagtctagcacatgcctaacacaaagtaagtatccagtaaatgttagctgctattaagtgctgcacaaataccatgtattattttattaatattactatttgctaggcaattgaggggttaatataaggatgatcgaaacagtccatgctctaccctggctcctgtctggcagaggagacagacattacacacgatttcagacccagcaggctgtgggctgctcataagcgagggatactggatgcagaggagggaagggatctgggaggtagatgtgggatcagacctgcatcttgaaggatgagtaggatgctgacgggcagagaaagcaggcagggcagaaagagcaagcaggggcttcctagcaggcaacacagcctggggaaaggcacagggcagccagatgctgggctgttgggcccagggcagtggcagatggggacagggagccggtagtgttatggttggtttgaaagacagggtctgcatccttggagaagagattaatgagacttgtcttcctcttttgtagcccgctcccaaaagacttcaggcattgggcgcctgatggtgcatgtcattgaagctacagaattaaaagcctgcaaaccaaatggtaaatactgccttgattcattcagcagacataactgccctgccccagtttttgctgatgactttttgagacagagtctcagtgtataacctaggctggagtgcagtggcacgatcttggctcactgcaacctctgcctctggggtacaagtgattctcaaggcttagcctcctgagtagctgggattacaggtgtgcaccac

SEQ ID NO: 93074 - DNA, 1004 bp, Homo sapiens
aggagtgacatgatctggtgtgttttaacagtactgctctgccttgccagattaaagaggggaagggatcagaagccaggagatccattggaaagctacttcagtaatccaagcacaagatgatgataacttggatcagaacagccatgggggacgtgtgagaagtggtctggatgtattgtgaagagggatcccacaggtggattgaatgtgaagtgtgagaagtatcaggtggcgtgagcagctggagagatgatattgccatccactgaggtggaaaattatagaggagcaggttgggagatgattaggggtttggcttttgatgttactttgatgtgccttttagacatctgaatggggatactgagtatacagcagaacgtgtgaagaagttcagggaagatgttcaggctggagtgtaaatttgggagcctatcagtacataaataagccatgagaatgaactgggtcaccaaggctctgagtatgtcgaggaaagttccaaggactgaatcttagggcactgcgacattagaagtctggagagttgaggaggaacgagcaaaggagccgtggaagggcagaccagtgaggtgggaggatatgaggagaggagaggtggtgacctggaagacgagtgaaaaaggatctcatgaggatcgagtcatcagcaatcacagatgttagcgataggtcaagtaaaataacggaggaggctacctggggagattaggaagttctttttctttaaagtgaaatatctgaaaataatgttaaatgtataattttccagctacattcagtaaacatttttctacagtaatattgattccttggtgtttgttgaaattggttctgtgggttctttgtgttgttgttgagacagtgtcttactctgtcacccaggctagagtgcagtggcacaatcttggctcactacaacctctgcctcctgggttcaagtgattctcgcacctcagcctcctgagtagttgggatta

SEQ ID NO: 93075 - DNA, 1059 bp, Homo sapiens
taaagttaatcatgttggtggtcgtataagcccttgggtggaaagaaagatatggatctaaatccagtccatctgtcaacatctagcacaaacaacctctttccaaaaagcctttcctcatctccggaaacttattcaactaacatgtatgaagtgtttacataaggctaagcaggtgctggggatacaaaactgagtgtcaagtggccattgtcttaggtggtacatagttctttgaggggattaggcccatatgcagataattataaaacagcatattcagcacagtgatagatatttgccaggcacttaaggactacagagaaggaataccaaattcagccatagattggtgaacgagagacttgctggaggaagcaactgccaggtccataagataagtagcaataagccagatttggtgggtaggatggtggagtgtatgataaagacaagaaatggcatggtggggaagtgtaattataagcatttcagtatcgtcagaatggaaatacagagccaggaactataaaagttgaggcttgagaggcaggccaagggctaagtcagaaattctctagctcagctgtatgttggaatcacttgggaaacttgaaaaatctatagtttccagggtcctaatttaaatggattgaagttcggcctgatcgtggggatctttcaaagcctcccatatgattctgatatgcacccaaggtggagcaaaaaatgatgaaacggagttctgagggaaaattggcaggaactggagatagatggaatatgagtgtcggtggaaaagtcagttatttccagatttgtgtcttgagggacaggatgggataatggtgccaccaactgcagtgaagaattagagttgggggaagaagaggagtttggagcacctatgggatgtccacatagagttgtcaagcaggtggtcagataagatagacaacatcagatgtacaccacctggtggaatgacatacatattggtagttgttgaaccagtgaaagtagatgagattacttgggaagaagatcagacctcctaga

SEQ ID NO: 93076 - DNA, 1110 bp, Homo sapiens
ataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactatattagttgtattgtgtatttcttttgaaacattctttaaaacttacttttaattgtttttatttagtcatgattaaatgtctttggaatgtctctttttccttaatgtagtctcatgagaacaggccagcaaattgttttatatcatagggggcaaaataaatgtataagtggtcaagatgaagataatttgattggagataatcatatgtatctcaaaagtgaaataaagtttgattttaatacattgttgctcacaaaagtaaggaaaacataatctagggtaatagacttgtgtttttataagttttactgcaacttttttct

SEQ ID NO: 93077 - DNA, 1020 bp, Homo sapiens
cccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatttgtttaaaggccaagaactggaaacagccatgccctgttttctgtgtatttgggatgggaataacaacattttgggggagctttttaaatctcagagaagaggaaagtggcctgctctggcaggtatgtgcagtgtttcatttgttccagtcccaagaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattctt

SEQ ID NO: 93078 - DNA, 1998 bp, Homo sapiens
ctattacactcatgttgcagtttattgcaatgaaaggatacagattaaagtcagccaagggaagagacacatggggcagagtgcagtagagttccaaaaacagagcttccagttgtcctctcctggcagagtcatgaacagtattaactcctcctggcaatgatgtgtgacaatacacacagagtattgccagtcagcaaagccttggtgtgcagttttgactggggttcctcacatagatacagttgattgcccgtttttctgaactcagtctccatcccctaccaaggtagagctgatactgcatgacccaaagcacatcacattgttagatttggcatgacccagtacccacaggtaaactaagacactctgaccagtcaggatagtccaaggatttagagattactttccaggagctgagggcaaaaaccagacctctctttaggcaaaattaaattatttactacacatttatggtttttctaatttttaagttatgtctcaatgattgtttttaatctcatctttcaattatgtatttcttttgctaatttttaggccagaggaaaaaagcgacagaaaggatggtttcctgccagtcatgttaaacttttgggtccaagtagtgaaagagccacacctgcctttcatcctggtatggaagtgggttaatttgtatttcattttagaggagtttgttaaaactcagcaacttcttagattagctcaatctttggaaaacattaaaaatgtgttctttccttatgtctgcttaaaagggacatgccactgagaatttcctttctgaaaagttcagtgtaggaacagccagcttattcactgatacttgaaccacttcgactctttgaaatctttcaatgtgaaattgttacaccatcatacttaaagtgaagtacttcacttggattgttaactgcagttgggaaattcttgtttttgtaagaccaggaataggggaaggagggtgagaaagagcagttcaagggaaattttagcctaattttaatatttaatattaaaataatttaaatcctagggagattacaaatgattgacccttgcaggaataattaatttgtttaatgtgttattttgttattcttgtgatagtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgtgagtaatattaaattatttttctctcacctagtgtgaaacttcaatatacagcactgcatttattccttttctggattagatcttaaactcagcactcacagcaaatgtagattagtgtttaaagtgagaagaaacaaaaggaaactttttacaaggtcagaagttatacagctttattttaaatacttgctagctccagactttcgtattagacttaatctgagagtatataatttttcctatgagttctttggtatgactgccatctatactgcagcttctttttactatcatcctctttttcagtgtcccatgttcttttttggtttaataaaaagtagctagtggctgggcgcaatggcccacacccataatcccagcactttgggaggccaaggcacgcaggatcccttaagcccaggaattggagactagcctgggcaacatggcgaaaccccatctcgacaaaaaatagcaaaattagctgggtgtggtggcacgtgcttgtagtttcagctacttgggaggctgaggtgggagatctcttgaacccgggaggttaagagtgcagtaagtcatgatcacacacactgcactccagcatgggcaacaaggtgaaaccctgtctcaagagaaaaaaaaaaaaaagtagccagcaattaccctatt

SEQ ID NO: 93079 - DNA, 1151 bp, Homo sapiens
taacctttatacttttacatttggattgttggaaataataaaacaacacggtatcttttccttgtagagttttgggagtgctagcaagtctggagcatcaaataaaaaacctggtacgtatagtagtgatcttaaaaaattactaacgtgtttgctctgtcgcaatcttgaattcatagtttcttctttgtcttttcagagattgctcaggtaacttcagcatatgttgcttctggttctgaacaacttagccttgcaccaggacagttaatattaattctaaagaaaaatacaagtgggtggtggcaaggagagttacaggtaatattctttaaatagcatctataaattttattataaaagtactgcatgctccataaaaaagataaaattaataaaaatttttagatcacccataatcattccacttagaggtaatcaatatcaatattttactgcattatatttcctttagtctcttgtgtgtacatttttagcacagttgagttgatgttataagtaacaatttaaggaataattttctccaaagacataattgttttccaataatgcattcctttataattcacagatcatgttcttaaagaaacagcatcatctttccctgggatagtcccaggcttgcagtatagcctctaggagaaagacataatctagatggtgtgctgagaaaatactactaattgggctgtccgctagtggtcttaggtttttgaaacagcagtgcaattaaagacaatacagacatagatgaaccttttttttttccctaaaacgttaatagatggttattgcatatgttttgatacaggaaaagggttcttctctcacttctattatttccttactagttaaaactaaaaagcattttagggattaaaagatgacaagagatataatagctatatttttatatgagtgatatataattgtagtatggaggataaacatagcttcattcttgcaaatcaggagtcttaggattcctgaagaaaaatgggggttcaaatttaataccttcttgaataaccccctgaaattccaccttctgatttactttgaagatggaccgaactaagtgggaaacatgactctttacaaattttacttctgacctcctgattaatgat

SEQ ID NO: 93080 - DNA, 1025 bp, Homo sapiens
acctcccaagtaactgggattacaggaatgcaccaccacaccgggctaatttttgtattttagtagagacaaggttttgccatgttggccaggctggtctcaaactcctgacctcagttgatctgcccgcctcggtctcccaaagtgctgggattacaggtgtttgccaccacacctggccgaattttggatttagaagaatataataacagtaacaacaaccatatatagctggcatttgtatgcatgcactgtgctaggccctttatagacaattcctttatagaaattgtcttattttatgtccataacatttacagagaagaaaacttaagcaaaaacagattgtttcagtgttttagagggcatttcttctaactatgcattcagttactagtgttttctaacagataaggcatataacttgaaaacctgcagtaatggagaatttagcattaaacaagacagtccattcagttgtgaccagtagttgtaataaggttccccttctgtttatttaaaaactgcctcacagtgtaatttactcacaggtcctagggaggcctggtgcatcccacaggtgtctagttaaacaggacagtcttctagatttttgaaaacagattcctgggttaaaatggaaattaatgttatagctgttctgagataataaaaacaaagttttattatttttatttttttaatgtagtgcattctaaacaaataataaaatgtatatattgcctttattttttcctacactaaactaagccctatatgtgcttaccacttaacaatttgtgggtgtcttttaagtttctttagaaaggcgaaatatctcacatttgaaaaactatttgtaaatcatattgaaattttaaaaatatatttaaaaatgtagaagtttataattaggctgttcttaatcctgcaggatgttgtgtataagtcttcccagttctgtgtactaagactatatttaatttgagaaagccctaaaaaatgcactactaaaacctgctgtg

SEQ ID NO: 93081 - DNA, 1079 bp, Homo sapiens
cacctcccaaagtgctggaattacaggtgtgagccacctcacctggccacttctttgtaccataaatcagttagaaaagttacttttcattttctttcaagcatttctcccctgtttactataaattgtcaatatttaagtaactctttactgagggcctcctctttgccaaattggggcattcccatttctgagtctccaagattccctgaatataacttctcttattgcttatagcactctgcattatagttactgatttttttaaaccaatgtcccttattagatcataagctcaatgaggctgggatgcatgtctttttttttatttgttcatttttcagtttcttcatgcctgttctaatcctcatgcatagtagctgctcaatcatattagctgagtgaatgaagagaggcgtgaatgaatgaacaattgaatgaattttcaaatgaaaaaagctaaaaactagataggtctctgacctttatttcctactctgtagggagtcaagttgtcgaatataataatacaaggaaataagtactataatatagctatgggtaactgtctcttgtgttttatatggaagttggtagaaaagcagtctgatttgatgaaaagatgctggtcttttgcaatcaagaggcttgagttttggctctgctatttttgccaggctgtaaggaataacctacttaatcttcagttttctaattgactgaatgaaaaggttaagccaaataatctttaaagaccctttcactgctgagtttctgtgtttctggaaggtagtgctgtttctaaaaatttgcttttcagcctgacatggaattttggattgattgattgattgattttgagatggagtctcgctctttcggccaggctggagcgcagtggcgcaatcatggctcactgcaacctccacctcctgggtttaagcaattctcctgcctcagcctcccaagtagctgggattacaggcatccaccaccatgcccggctaatttttgtttttttttgtttttgagatggaatttcgcttttgttgcccaggctggagtgcaatggcccgatc

SEQ ID NO: 93082 - DNA, 1037 bp, Homo sapiens
aggagaaggaggggatggaggagaaaagttcagttttaaagttgacttggaagttcccatgggacatccacttgaagatatcttgcaagtagttgaaagtataggcatgttgcttcgggaagaagtcagcactgagatcatagctcttggattcattattgcacagaggactgatcaaactataggagtaagtgggcttattcaggaagggtatagaatgaggaaagaaagccagtgatgaaacttgaggctgtccttagtgtttaaggaacaaggaccaagaagcagagggagaaacactgtgaggatggaggatgtcacactgtaggatgaaaatgtctgggagaagcaatgaaattgataaatcacctgacatgtttaccagttggaaaatagtattcagagaagatcttattgttctgttagagagttcaaaaaaactgtgtaacaggaacagaaaaaagtaagccaaaaacaaaaaaagtaatgattataggagaataaaaagtttacaaaaaaggaaatttaatcagcagcatgctgcatgactcagatgtgaaatatttaaacataatcataatattataaacattaaataaatttaaataaagattaagctataacagtattggtagagtaagaggctacagtgaaagagaggtcaatcttcatttcccatagccaaaagccagtaatgtctaaaattgaaaaaattcaagaaaaagcagtataaatatgttattcagaaatataaatggtgatatagaagaaaccaggaagaatggcaggtcaggagtgaaaatcagggcataaggagccatgagataggggaggattgttttccctcattagccatatataatgaatgctatttgtctttgtaaaatattttcatgtaacttggataaaattaaaattaaaaagacaacttgccagtcactggaaatagtagctgttaatttgtagaaaatgccttagctgtttagttagatgggcttaattctgaaaatgagaatactatacaatagttttcatct

SEQ ID NO: 93083 - DNA, 1161 bp, Homo sapiens
gctctataattcaccaaaacactagctgtctcacctaaagagaagacaattgtcattatttgcaacttacatgtatacatctttgctatgactcaataaagagctctaaaacctaaaagaaaaaatcaagcaccaaatactacaatgaaaatccacttgatacagacttgctaggatttcagtatcttgactagtcatctaataaaaaagcaaacaaggatgctcatcttaagtaaggtaggaggcagcaaaacaaagagatgacttgcgggatgaagcacacacatgggtagaaaggaaagtgcaggagtgggggccaggctgagctgtacaaagtggaaggagaccaagcaaagagaggcttggtttgatctgtggaggtctgaatataacagggaagtaaaggacaaaaaggggggtctcaaaagataagaatagcaagttaacagggatggctgaagaaaaatctatacatctatcagaatggttctaaaaggaaaacagtggaagagtacacaaatatactgaatttgataagaataaaattgtttactttgttcatctttagaatgttttaacttataaaatttcaacaaactgtatcattaataatgattcaaagggttcatgtatctaaaagagatacaatactactaaaagtattgtggaaatggactgaggtgtatcaaaattttactgttgtttcattaaaataaatagcttagttatagtggttgaataaaatatttaaaactattttacttcaattatgaaaaccatgtctgagtcttttcacaatcagtagtaactatcttcttttctcctgctgtgctaagatttctactgctgtgttaagatttcagtctgttttaataagcctactgctttttatccaagtttaatttataaaaaggttttttctgactctacaattagtatctttctaattttcttccctttttttgtctcttatcaggtcatttttttcttgttgcatttgttctactgtctcaaagtatccttatccttacgttttttctcctcagctttcaaagtatccttatccttacgttgtttctcctcagctttccgttcctcttcttgaattttttcttgtgttttttcttcctggagtcgcttttgtttttcttcttcctcctt

SEQ ID NO: 93084 - DNA, 1021 bp, Homo sapiens
aaaaaaaaaaaaaaaaagtaggttgtttttctagaagcatttcctatttccacagcaacaatgactaaacccctgaaacaaagattagataggacagtgggaataacagctggaagacagttcttgtcaaatatctggagagaaaggaaggaaacttagatgtaatttttagatttatttgctgaatggttccatttcaacctttttctttttttcttgagtttggaggttggttagcaggagggaatttttgggtgtgggaaattgtcagtcatacaccccagtgcatccactaatcaatccaaagcttccaaagcttttcttgattgattgattgatttgttttcctttcacctctgatctcagcagtttctccccacccctgtactaatacttcattgctagttcttcaccttgacaggaaccagatcttagtatgtttttatttagtgtaaaaaatttctaggacattatacaaactctttttcttttatgtaaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtaaggataaggatactttgagacagtagaacaaatgcaacaagaaaaaaatgacctgataagagacaaaaaaagggaagaaaattagaaagatactaattgtagagtcagaaaaaacctttttataaattaaacttggataaaaagcagtaggcttattaaaacagactgaaatcttaacacagcagtagaaatcttagcacagcaggagaaaagaagatagttactactgattgtgaaaagactcagacatggttttcataattgaagtaaaatagttttaaatattttattcaaccactataactaagctatttattttaatgaaacaacagtaaaattttg

SEQ ID NO: 93085 - DNA, 1020 bp, Homo sapiens
tacatatgtcaaaaacatgactgaacaaaatttctcttcagatgttataacaagcaaattattcccccatatttttaatggattgctttttttaattgaaaatgatgtaccaaatcaaagcatcggcttgttaaagattctgtgttccgtagaaatgaactgatggaaaagtagattattttaatgtgtttatctcaggagctatatggtttaaatacttaaggttttttttatcatctagatattttttaaaactttaaatattttaaatttagttcaacttgctataggatttttatcttttaatgcaaatgccacattaatacatatgacaagcatatttaaatcattcacgtattgacttattttctttttctccttaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggtaatatagctgatatatttattgtgctatattgccattagaattgtaattttgttgctcatatctttagtttatgaaaatttaaggaaaataaagggattatcctaatcagattctggatctcataagttcagtccttttagggatcaagtttgcagtaactgattttattttctactagtgaaaaataacagactttggagtcaaacctgtattagaattcttgctcttccacttactacctgggtgaccttggttaagttatttttatctttctgaacctcagttactccatctgaaaatagagacaataatgcatatctcataggtaaatgtattaaataaaataatacagctggaactgggcgtggtgacacacgcctgtagtcccaagctatttgggaggctgaggcaggatgatgagttgagcccaggagttcaaggccagcctgggcaacatagcaagaccttgtctcttaagttaaaaaataaaataatgt

SEQ ID NO: 93086 - DNA, 1068 bp, Homo sapiens
aatcttcctgggtagaggaggacatgatataactcagcctaggccagaagaagaggggtggagatgcagaaagtgctattggttttttgagatggaaagttgagagggctgcagtctgatggcctaatgaggcaaggtttatagctggtagtgaggagaatggatggaagattaggaagtttcaggagagaaataggcatgaaatagacatctcagtgcagatatgcaagcttagtagaggaaaacctaagtgtgctgagcaatgttgaatgtctttttgaagttggaggtgatgtatttaaattgaaaacagtatgcctaattgtgtgattttgcctcaccaatgttcagctgtttaggtataagcacagagaaagctgatgaaataggttcatggttcatacaggtttgaggttttaatagacatgcacaaagagagagggacagaagagttacagatcttgacaaaagcactatgatcaagatgagctctgaaacatgaactagacatgaaggatgtgaagagaggaaggggtgttaataaagaaagagaatgatgggagtcaacagaatggtctcagtgaggttgaaaacctattgatggctgggcgtggtgtctcacgcctataatccctgcactttgggaggctgaggcgggttgatcacctgaggtcagtagtttgagaccagcctggccaacatgatgaaaccccgtctctactaaaaatacaaaaaattagctgggtgtggtggcacgcgcctttaatcccagctactcgggaggctgaggcaggagaattgcttgaatctgggaggtggaggttgcagtgaggcaaggttacaccactgcactccaaccagggcaacaagagcaaaactctgtctcagaaaaaacaaacaaacaaaccctattgatatagatgtaccaggtataagaaaagttcgaagggtaagaacttacgtttgaagaatgggatatttggtcaatggtagttctgtttctgattagtaagactcagggtgtaataatgggagtgatggattaagtagagttaaaaaggtcattga

SEQ ID NO: 93087 - DNA, 1019 bp, Homo sapiens
ctaagaataaatggaaagctactttaactatagtttctattaattgagtattaactgtggaccagagtgtacaatggctttatatccatcacctcatttaatgtagcatgatgctcattgtatagatgaaaagcctgaggattcgattggtgaagcatctttcctaaagtagaatttcacttcaggtcctagtccttttgaatgcagaaccaaggcttacaaccatttcctctgatgctctttccagcatataatctgggaagtggaaataacaactgaatgttttctcttgtactggtctgcattgtgtatacatccttcgtattggtctagttacatcaatctgaccaaacagtaaatgacatgctggtaatgacatacgaacttctgcaaaatgtaaactgtctgatgtttgtttttcagattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggtatttatttttgatactatttatttttaggtaactgccttcttaccttcattattttgatttaatagaataaatagctaaagctattatatgtattacattttcataatttattttataatttcaactatacaagaatttcaagattgtttttaatgttctagttatatgacatagtgtcatataactaaacatatactttatcacagtttccaatttttgatgactatgtgctgtttgtcttggcatctatacatttccagaacaattgcctttgtcagtattacagaactgatctcagccagcgttatcctaggcaattttcaaaaatgagaaatatggaaaatttgaaatagtttaggtgttagtggctcttttaacacagtttttattttgtttccttgtgaagtgtaatttaattaacctttgttaaataatgcaataatcagtgaaatc

SEQ ID NO: 93088 - DNA, 1058 bp, Homo sapiens
gtagaaatagaagttcagagaaggtaatgccgagcatcacatgcaaacatttattcctcttcatcattctttgagagtgtctctgatattaatattgttaattaatattgtctaatgctgaattcagaaaaaaattcaatgtgttatgtttctgctttcccatactaacatatgggctcttgcactctgagaatgatgtgtttcccactaataactcgagttaacagacacaactctgaaacacattccacttggttttaggcatttgtttcaggatgaatatgaatgataactgagattttaaaatttaactaaaaatattattctccttgtagaaacattttctattagcattttatgttactatatatttatatgatcttcctatagaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggtaagtccttcactgctaaattgttcttaaacatgtacaattaatagttcttctgggctgggcacggtggctcacggctgtaatgctagcactttgggaggctgaggcgggtggatcccctgaggtcaggagttcgagaccagcccagtcagcagggcaaaaccccgtctctactaaaaatacaaaaaaattagctgggtatggtggcgcatgcctgtaatcccagcaactcgggaggctgaggcaggagaatcgcttgattccgggaggcagaggttgcagtgaacccagatcgcaccactgtactccagcatggatgatagagcgagattccatctcaaaacaaaacaaaacgaaacagttcttctaatagagttttgttttgggggtcaataaccttgagtctttgataggcttgtgatctaaatacacgcaatcctgtatacaatatcaggaagtccatagacctactaaaactctgctagacgtctggttaagttttgcttaatatatatacgtaagtggac

SEQ ID NO: 93089 - DNA, 1095 bp, Homo sapiens
atacttacattcaatagtgagttacgtaaatgtacgtatttacatttcactaaaataagtgtacccagcagttttaccatcattatccttcttttaaaaataaaaaattggccgggcccaggtggctcacgcctgtaatctcagcactttgggaggctgaggcgggcggatcacgaggtcaggagatcgagaccatcctggctaacacggtgaaaccccgtctctactaaaaatacaaaaaattagccaggcgtggtggcgggcgcctgtagtcccagctactcgggagactgaggcaggagaatggcgtgaacccgggaggcggagcttgcagtgagctgagatcgcgccactgcactccaggttgagcgacagagctagactccatctcaaataaataaataaataaataaataaataaaagtaaaataaaaattgaacttttaaggcaatattttactccaaatagactttattaagttgtgaattttaacattttctttaggactctggctgacgttgatggtgatggacagctaaaagcagaagagtttattcttgcaatgcaccttactgacatggccaaagctggacagccattaccactgactttacctcctgagcttgttcctccatctttcaggtgagtgtgcctggaggtggagaactatggttttgataacttggcagatgtgatttagaagagagttaaatatttgcactgccattgattttagtattcaacaagttatacttgaaaagggtacatattagaagtaggtgtgggccaggcgtggcagcttacgcctgtaatcataacactgggagccaaggtgggaggatcacatgaggccgggagttcaggaccagcgtggacaacatagtgagaccccgtatctacaaaaataaaaataattagccaggtgtggtggtgtgcgcctgtagtcctaggtactctggaagctggggcaggaggatcactggagcatagaagttcaaggctacagtaagttgtgattatgccacagcactctagcctgggcagcagagcaagaccctgcctcaaaaaaaaaaaaaaaaagaagtggatgtgtt

SEQ ID NO: 93090 - DNA, 1050 bp, Homo sapiens
aggctggcaacagagcgagactctgtctcctccccagaaaaagagaaaaggcagtcaccattatagtatgtaacagcgatcctcaacctttttggtaccagggactggtttcatagaagacagttttttcacagacttgaagcaatggttttaggatgaaactgttacatctcagatcatcaggcattagattctcaaagggagcatccaacctaggtccctcacatgtgccattcacaatagggtttgcactcttatgagaatctaatgccactgctcactggacaggagctggagctcaggtagtagtgctcactcacctgccactcaccgagccccgctgtccagcccggttcctaacaggtcggtggcccgggggttcaggacccctggtatataagattcttaatgccttggtcttataaaatttaattaaatatattttatttagtaacataaaaattttaaataaatttttttatagctcaacttcctcgactgcttcactctcagggaactcacccaagactgggacctcagagtgggcagttcctcagcctacaagattaaaatatcggcaaaaatttaatactcttgacaaaagtatgagtggatatctctcaggtaagcagcatacagtgctgaagagcatgaaaaagggtcttttatgtggacttccactgaagaactgtcatttgaatttgtattgtgtagctcatctgacattttaacatccaaaaaatttagcaggcatttgataaatacaaatacctgaagttgtataaggattcaaagatggattcaacttgattgctttcttcaaagttcttactgtcaagtcgggcaccagatatacccccaactttttggcaaaagacctgtcccttaagatcagacctcatcctctaagctttgcagtgaatggagagccacgggtcacaagagagagtgtgtggaacttagcctcagctcacttttcctgagaatcctcctctgcattgggctttttctctgtttatataacctcaagtgagcattgctcacccttta

SEQ ID NO: 93091 - DNA, 1045 bp, Homo sapiens
gattgtgtcactgcaccctagcctggatgacagaatgagactctctttagaaaaaaaaaaaaaaaaaaggtatttcttcagttttttggaaaataaattttattgagcaaattattgaaaataattcaggtttagttctctaggacaaatttctaatttcattagaattttctaaggaaagatatatacattatcattgagaaaaatttccttataatttggcagaatctcaaaatcctctttctgttattttgtagtttcatttatttcataatctataaaccccaaattagtcctcgcttcccctgctccttctttaaagaaactattctctataatatctgtttttttaaaaacgtttacaataagtaacaacccctgtcccatctttccacttggaatattctcatgcctggtagagtacgaggcacatagcaagtattcagtaaatatttggacagatgaataaattaaatttagaagtattataatcttgaatttttttctacctaaactggtggaattcagcccaaaggtctctagattctgttttgacaggcagtgttttattagttattatctctggtcagtatttcttaaagtgtaggttttatctttttgttattatatattttacatgttagatattttaaatttagtgatgatgtacacgtgaatgccatatcatcatttttactttgtcaatccccaaaataacgttagttttcccaccaccacaccacatagcaatctacctacctcatgctccttttagggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggtaagtatgtattaatttaaatacctgtatttgctacttaaactttatccctaggcatatttgagtattagaaaaggatttgttagcacaaaatgacagtccccag

SEQ ID NO: 93092 - DNA, 1059 bp, Homo sapiens
agggcagtgattgtagtagtaacatgctctactcaagtttgaggatttttatgccccatacaaaggaatttgcattaaacagttgaattgtaaacttcagccaacatgttaatcagttttataagcaaaatgaacataaagcagtacagtcccggtccttctttattctgcttcttccattccataaacatttatatatctactttgcagttcattgcattatatataaaatataacattgagaacaaatggactattcaataacaaaagaatgattatgtgaataatcatctaaaatgttggaaaatgcatttagaagtgctatataggcatacagatagtaattttttttaaacttctgaagaattaattgcatatgtagactgtggtaccttcctacttagaagattgacgataacttagacatatctaatttaagttcaattcagggtttaagatgttactgagagcagcattcatgtatagtacaaaactttgctcctctagtaatcctgacatagattgttaaattgttttgatgcccattgctattgggacttgtctgtaagtatgcctgtgtgtgaatgtgtatgtgtgtgtgtatgtgtgtgtgtgtatgtatatacgtgtgtgtgtaaaaaccgagatgagactacttactgaatgagatctagcctatagtagatgttctgtaaatgtgaaaatttttttcttcactgactataagaacttgtttgaaagagccagcaagtgagatgagaataagcaacagaaatgtttatgaaaatcccatattttcaatatcagtgatgagttaggggaagcggatagaattttaatgtatttctaacacgattattacatattgtaaaagtttgttagctttttagggaaatattagacatcaacccctaaacttagatttttctgcctcttcgataaggcttacagataaatatagactaagattgggagatttttacttgaagttcaaagtaacaaacttttgccttttcaaagggttctgttagttgatatatttaaataagaaagccagga

SEQ ID NO: 93093 - DNA, 2466 bp, Homo sapiens
taatatttaaatgatttgggtaaatagatgagatacggcatgatcttttaatatagtagtgttttcctgcaatattatgatccatggttttaattactaagtgcattgctataaatttgctaggccttcacttcctaactggtcctactctcaaaattcatggaacgggcaggacacagtggcctgtaatcccagcactttgggtggctgagggaagcaaatcacttgagctcaggagttcaagactagcctggccaacatggtaaaacctcgtctctactaaaacaaacaaacaaacaaacaaaaattagccgggcatggtgatgtgcgcctgtagacccagctactcaggaggctgaggctggagaatcgcttgaacccgggaggtgaggttgcagtgagccaagactgcgccactgcactccagcctgggcgacagagcgagactccgtctcaagaaaacaaaacaaacaaaaaaaaaaacagacccacaaaaagattcatggaacaatttttgaatttattgacagctgaataatgaattcagggttcaaaatgatactgcactctccttttctggttgtttgcaaaatagcagccatttgttgaacaccctatgtggcaggcagtttactggattatgtttaacactttaaaaaatacttctgcaaagtattttttatagatgagtaatctgagtctcaaaaaaggttaaataacttttccatggtcacagctgggagaatagcagagctgggtttgaacccagagctgtgaatttccaaagtcccttctcttagagtgcttgcccagcacatttagttatgttatatatgtattttaataattttgtgtgttttaataattacttttagactattttataaaccccttgagctcatttaaacagctgcgctacatttattttgaatatttttcttgtttgggagtttttaaaaaatgatactatgggctgggtgcagtggctaacgcctgtaatctcagcactttgggaggctgacgtgggcaggtcacttgaggccaggaatttgagaccattctggtcaacatggcaaaaccctgtccctactaaaaacacaaaaattagccaggtgtggtggagcattcctgtagtcccagctactcaggtggccaaggtatgagaattgcttgaacccaggaggcagaggttgcagtgagctgagattgcaccactgcactccagcctgggtgacagagtgagactctatttaaaaaaaaaaaaaagtatggatttccatgttattcttatatacttaatttatacagttgatttatttttttctcttccaaattaatttctacaagaatgttggttcatgccaagggtttctttattcagtatctactattaaatatgtgactgtttttctgtattaaggcagcacgattacccaacaaaatctcttacccttcctcaaatgtaaattctgcctgttcagcagcagcagaagctctgcattgttttctgttggaagtgtgagctgaaggggacagacattcctactgcttagcgggtgcactaaactgtgatttgcccttgttgtattatcaacggcacaatatttttatgttgcagatggctgagagctagcaaggaaaactcaggaccatgatggctcagtttcccacagctatgaatggtaagcagctttgtgcttgtggcaagatgaggttatggattttttttttttttggtagaggtttaaaatattcatgtagataattttccttaagtgtataaatacaaaacttgaagtattcttggaaaatattttggaacactgcatatgtcttctgtaagaatattatgttgtaaatcccatgactatattctggaacgtgtgtttgccattgagcagttaggaataaccaaaaggtatattgtgtttgatgcataaaactggatgacaaatagcagagtgctataaggtgactattaaaggtattttgataacataacatgattgtaaaccgatgaagccaataaagattaatttagtaatatttatgtaagattatgttttccctttagataagattatgtatgcctgcatacataattgtttaatatcaaacattttaaaagaaagtgctggccgggtgtggtggctcatgcctgtaattacagcactttgtgaggctgaggagggagatcacttgaggtcaggagttcgagaccagcctggtcaacatggtgaaacccaatctctactaaaaatacaaaaactagccgagtgtggtcatgggcacctgtaatcccagctgcttgggaggttgaggcaggagaatcacttgaactacccgggaggtggtggttgcagtgtaccgagatagggccactacactccagcctgggaaagagtgagactccatttaaaaaaaaaagaaaaagaaaaagaaaaagaaaatgcttaggtaatttga

SEQ ID NO: 93094 - DNA, 2552 bp, Homo sapiens
cacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaatgcttgcatcttttaatagccaacattctcttagatctgcagttgggctcaacgcactcaagccttagcacaatcttctttgtagttttagcctttttctggaaaatcagcttagtttgcccaccataaccactctgcttcctgtataacaccactttccctgggcatacagagaattcttgcccttcttgtactgtgtcactttgcagggttggtgcttgccacacttcttacagaaagtcctgcgggttttaggaatgttcaccatgtttgcatgagcgctattggcacggaaagtaattgtaattctttctgtaactgtgcttcttaacaaacaaaaactttaaccttggctgggccaaggggtttggggtttggccaagatggtgaaaccccatctctactaaaaatacaaaaatcaggctgggcacagtggctgatgcctgtaatcgcaacactttgggaagccgaggcgggcggatcacgtgaggtcaggagttcaaaaccagcctggccaacatggcgaaacctcctctctactaataatacaaaaattagctgggcgcggtgctgggcacctgtaatcccagctacttgggaggctgaggcaggaaaattgcttgaacctgggaggcggaggttgcagtgagctgagatcgcacaattgcactccagcctgggtgacagagggagactccatctcaaaaaaaagaaaaaaaaaaattagccaggtgtggtggcgtgcgcttgtagtccccgctacttaagaggctgaggcaggagaatcacttgaacccaggaagtggaggttgcagtgagccgagattgtgccactgcactccagtctgagtgacagaatgagactctgtctcaaaaaacaaaacaaaaaaacccctaaaccttaattaagcgacttttcacttataatggctgtgactttttctgagtcttactgaccgtttgtaaaagcaggatttcctgcttttgttctagcatttctacttttttctgtcttagtgtgagtatattttctacattgtctaaagtacgtttggcaattactccaaatggcaactgaattatattaaattgaagcagtgttctttgccttatgcctactatttacccaatatattttcttggtttctacaaagggaacaatgccagttctgcattaatttttaatgagcaggaaaatcatatgaacattctaaaaaccatacataactaacagtattcaaaatacatgatgactgcaaatttgccaaaattgcctgtcactacatttcatcccctgtgaagagtagaaaggggtgtttgttggatgctgacttcagttgcacttgcctgaaacaggcgccagtcatgtacctggggagatgctggttacccttttcttcctttcagagagttataccaagagataagaaacaattagcactccctaatttatgtatgtgattgatgctgtccagtgtgttgggagtcatctctggcttgtttttcttctcctggacaaatgtgctaacagtaagttctcctgctgtttgtaggaacctgtgacgcattatctccatttaagagaggaagaggcagataaagcccatgggaagttcatgggcttaagaattagacaggcttgggattgcattctggcttcatgacatactgaatttgggcaagtaatttaacctcttcagtttcttctgtgaaatgagtacagtatcatctgccttgtggggatattgtgagaggagtatccatattatcaaaggtgcctagcagtatctggcacctggtagataagtctacaagcttgtcagtgtctgaagctccttctgcagaacctgaaacattggattctcaatgaatactcagcatgacacagtacatctactgtgatcaacagaagtgtattgaattaatggtaaacagtaaatgttaatttattaattgctttttgaaaaatgtaaaacaaagtttttggtatctgttgcattttcaaaatttcaattataattgttaagtactactctgcaaatagactagtagaattgttaagcattaggtaattattccacagtggggcagagagaatagaaatgtaatagatatgaaatgatatgttttaaaagcttattggttccaacaaaatatactcccatatttagatgttaccacagttaatcagatgttacatacaatataaatgttacatataatatggtacctatgtgcatgggtggctaaattccacataccagatgataaagattctgtaatactagtaccttcagctttacccaagggatttgcccttattgccagtaatattattaatatttagttcattctcaggttttatttcagaattatgcctgtgattactgagcatctactatttg

SEQ ID NO: 93095 - DNA, 1739 bp, Homo sapiens
ttgttgttagcctttcacttttttttttttttttgagatggggtctcactctgttactcaggctggagtacagtggcacgatcttgactcactgcaacccccatcttacagactcaagcagtcctccctcctcagcctcctgagtacttgggaccacaggcacatgccacctcgcctggctgattttttttatttttggtagagaggggtttcactgtgttgcccaggctggtcttgaactcctgagctcaaggtgatccacttgcctcggcctcccaagtgctaggattacaggcatgagccactgtgccaggccagcccttcactatttcatgtgagtaagtaatcttctatttttccagaccacactagttactctgcttttgcagagtaacctctgcctagaatgttttccttcacattcattcattttaacaaatgttttgatgtgtagggcctaagctgatttgaatgcaagctgaaatgcacatatctggttgagtcatgggaactgatttgcatgtgtctttctcttttatggcttgaagaggagagaaatttgtgcttagacacttgagggcctacgagatcaaggagtctgtccttagctctgccctttggactgttgtctgagcctaaagaagagagacaaagaaagcttgcattgggaggctgaggtgggaggatcacttgagcttaggagtttgagaccagcctgggcaacatagggagactgcacctctataagaaattttaaaaattagccgggcttggcagcgtgctcttgtggtcccagccgcttgaaaagctgaggtgggagaatcacgtgagcctgggaggtcgaggctgcagtgcaccgtgattatgccactgcactccagccttggcaacattgactgtctcaaaaagattatatatctctaaaagaaaaaaaaatggtagaagaaaatctgtaccttctcaatcgctctttcttctgcttctaaacttatgtatgcctttgttcattcttactccccttcctgaacttcattcttagagacagaaatatctgtcccaggttctaacttcgtgttctagagctgtctactacttctttttctggccctaacttccattaggtaacttctctcccatctcctttttgtaaattaaatctttatttcttttttttgtctaaaaatagttttgttctgtcacctaaaaactaaagccttataataactctgcctccctttcttaaatcttaccttttttcctatgtattttttgagaggaaatcttgctctgtcgcccaggctggagggcagtggtgcgatcttggctccctgcaacctccacctcccaggttcaagctattctcccgcctcacaggcactcaccaccatgcccggcgcatttttgtatttttaatagagacagggtttcaccatgttgaccgtgagaccggtctcctgacttcatgtcatctgcctgcctcagcctcccaaagtgcttggattataggtgtgaggcaccacacccaggctcttccccttattttaaacatttattgcctaatctacttcaatttggcttctatagccatcactgtgctagaactacactcactccagattgccaacactaatagctgagtcttaacttctgtgacaataccattttctccttgaaactcttaactctgtatcccgatttctcgtgtttctgaacctctgtttctgactattcttgtctct

SEQ ID NO: 93096 - DNA, 1809 bp, Homo sapiens
atgatttgtgagggctggtgcttacatttcagtgattaagaaatcaagtgtctgcttaaaacattactgccgtgaagcgtagattatatgatacagttgagggatggatctcaagggttaaatttgtttgaggtttgtctcctcttctggaattggttggaggctagtctcaaaaaaaaagcaaacaaaacaacaacaataacaacgaaagttggccagaggggcctcctatgatgttgtaggaagggggtcggatttcttcatgttgagaataatgtgaaaagaaagtatttgcttaggtctcttggatcttcaactagaaatagttttgggttaaaggtagcagtggggtttgattcagcttaacaaataggcattccttgaactatttgccataaattagataaaatggaagtgtttctgttttatctcctgtactttgtggaaaggtctaatttggttttgtgaacgaatgtccgaaatgttttatatttcttcttcagactctatgctttgggaacagtgggtcacagagagggtctgagttgggaatatatggtttagagagaaaatagaggactgctgcttataagaacaggtgtttagtttgatttttgtagatattttctactggttatttaacaacattgaagtttgctttataaggtgcaaaacgtgaattttacgtagcttacacttgatctcttccttatttctctcagaaaacctgtaggattgtgcctattaaattgctttttgtgtggtttaaaccaagagagtattttagatctgcagtggttttattggaaaaaaaaaaaaagtgcttgatggagctaatggtgattgtttcacttaaactaggattatatagacaatgcttcttcctgcctctttctgcgaacatttgtttttgtttctccctcaattccagggtttcatttctagaaatctgggctgcaaacagaagcagcagtttgtataatcccaagaacttgcttatgccaggaagctgtaagggtagcatgaagcgggtgtgatgtaaagacactgctactacttaagacatttaactgttgagggagtctaaggtcaaactttaatttttgttgaatttcctgttttctgcttatgtgttaatcttttggtgggcagaagattgggttgctatggtgctaactggtgtatattgtgaaagtgctggcaacatttcatgcttttactctatagggaagggtggtaaacaagcctaaataatttaaagatgttgttctcagaatggaatgttctgtgcatgtcttcttgatcctgctaatccagtgagcggtcttcactaggactaaatgttgagtaagtgatgagggtggtatagaggtgctgaaaggtggagtggtggagagagggtattgggcattttcttgaaattcttttccccaattctgtatagggaatctgtatactagactgtgatttataattgtttttcaaggatgttttagttctccctgcttggttgtcatcaatttcatatacctcctcttagatactacctctgttccgtactttagtttgtcttttttgctgcgtctcccaaggactccacattgtttgaatgttatgttgcatatcttatggagttggctggccttaagccatgtggcttaacatagttttcattatagggcaggtgtgggaggtcaatacaacgcacaacacggagtaaaatctaagtcatggagcataggagatccccgggacgctcatgattgttttggcattggtttttgccttttaaatatgattataacagaa

SEQ ID NO: 93097 - DNA, 1009 bp, Homo sapiens
gaaatacttcgcaaactgtaaagtgctacgcaatgaagaaagtattatgataatcatagatatcttgcgtctttgcttttacatgttccattttcttcatttaaattggatttcctttatgttctcgtgaccttcaaaaacagcatcaaagctggtatgttttcaagaaagcttgatttttatcactcccttagcattaggtactctgttctgtataataaacttctctttctctctctttcttttgagagagattctctttttagtgtgtgttgattggttttcctaaacagattggaaaacgcttgagatgccaggaactacaacatttagagttaaagagccttaaatgatcatttaggacagccttcttaatattacagctgagcagactaagtccatgcagatgtagttgggaatagggtttctttatgagagttactttttgtatttaaagttacaatattacaaagatattttaaataataagaattcctgtaagcttttgagtaatgtgtaagctaggaggaaaggagcatttttattttttgaccaaaatatgactctcaaatattgtaaaaaggtattaattaggaattaattaagaccgttttctcaaaaactacaaaagtacctgtagaaaaacgtctgcttttcttgtaaggccctcattcatagtcagcaaatatttattgagtgttgtctctgagccaggtactgtgctagctctacatattacattttataaatgaggaaacaaggctcagggaagttaagtggctggcgtaagattgcacagcttataggtgttagggatgacatttgagttcaagcctactgagtggaaatcatattcatacctttcaattggcttctcttcaagcatgttcgtcacacttggccacattatacttttttttttttctttctggactttctttctcttgaatacctgtgttgtggagactcctgcagtcttgttcctttctgatgacccgggagccatata

SEQ ID NO: 93098 - DNA, 1087 bp, Homo sapiens
tttgtaagaaacaaaaagttatttgttctgcaatgtctaatatctccctctccattctaaatggtacaggtagtctgtaattgaatttctaagtagctactcaatcattcggtcaagacgtagttatatgagtacgtactttgttcaaggtgctgtgctgtaaaaagatagtggttattgggaaattaaccgataaaatatagatcctgttcttaagcagattatgacctgagagaggtgataagacaaacatacaaatacctataatagtaattgaatgtgatgagtgctgtgagacaggtcctgaaacagtgctttgaacattcagggagagggaatgattattgtattttcatttgagaaaaatcagggcaagttttatggaggacttggtggtagacaaaagcattgagggcaggggatgatttctttaagaatagagacaaggagaacagtatgttcaggaagattaaatagcaaagatgaaaagacggagtaatgcaggggaaagtgcaaggagtgtggcatcagctgaagtgggagagggaagcatatcgtctaggtgtagtaagaaaacattggtggattttaatggagggaggtggtggggagcagtatgtagtaagtatgtagatatggatgaaaatgagaaatgtcaattttccaaatttacgtggatcttttcttggcaggttttataccccaaatttcatattttttgtttttgaaatgattccatatgtaaggcttacccacattgggaacttattcactcatttttatgtatatttaaacacagattatatggttttttttttgaatagaagttggtacaaaatctttttcactgccttatacttttttcgaattaacttttttgttttttacttttgattatgaattatgccttaacctacatgtgatatgagatatgcatattgcatgatacttgcccaagagttagccagttgatccaacataatttattaacatattcattttaataattccctactattttgaagtctacattttgatgtttctatactcccttttttctgattctgcatttctttattccaaaaat

SEQ ID NO: 93099 - DNA, 1285 bp, Homo sapiens
acctcccaggttcaagtgattctcctgcctcagattccctagtagctgggattacaggcatgtgccaccatgcctggctaattttgtatttttagtggagacggggtttctccatgttggtcaagctggtcttgaactcccaacctcgggtgatccgcccgccttggcctcccaaagtgctgggattacaggcgtgagccaccgcgcctggccagtagtttcttaacattaaattatccgcaaaatggaagaaatactagaggtctgtgaagatgtttcttctctttcagtctgttgtggtggtttgtagtttacaggggcttgggtaactggatttttaggtttattattttaaatagtagactcaacactattttgtattgcagtagagatcacttatgcagatctttttaataccatttcatagagattaagtggtcaccttgaggcagaggagttaagaatgatctaacttaaagatgacttactcagtattttttcacaaaaagacaaatgtcccaagtttgttggtcctttttgtgaaacgtggctataagtgctatgttacctagcaaataaacacacttaatctgcccctttgagataatagggtaagttcttaacagtgattcaaaaagtaactacctttcagaacaacaacaaaaaatttaatgctgtagggaaaggatattgaaaatggatatttagaatttttcctgttatggaatttaattgttgaaaattatatgtgttaactttaagagctttttttatatgtatacttgaacttggaaacagaattttctaacctgtataaaaatcttttaaaagagctgtttagtgattttgagcccatctgctgaaaacacaaaaaggcaataccatctgattagtttataagaacaactgattgccatcagaaggtatggaaatgcactagctgaattttagcaaaaacctttgcataaatggtgaatgggattggaaattgaatatcatgttttattcagtgcacccagtaatggagttcttttggttttattcatatttgtgaggtaacattttttcagctatgataaccattaaaaccaaataaaatagttatatctcataaaaatgaaccgaatatagaactagaccttcaagttgttatattacaaagtatgaaagcaagatataaaaataacaaaccatgttcatttacattgctgtcaccaaaagtagtgagtggtattaatataataacaatattaggaaaagcacaaagtttttgtgtcatcaataa

SEQ ID NO: 93100 - DNA, 1055 bp, Homo sapiens
agaatgaggccaacatacagagtaaagcagagctggcggagacagatagacagactcactcacacacacactcactctcacatgcttgaatgagtgagcattgggagccattggagcctttggatctagttgcactctgtattagatccacccaatatttcccagttaaatgaactcatcagttgcccaatttgcttgtgctggtttgcaagtgttcctgttgtttgtaactgaaagagtccttgctaatccagacccctgttggcatcatcatcatcatcatcattagaatctatgtagtaaatttttttccaggtctcggtaccaggaaaagctgtgtttcctttgaccagctggtttgcttgtattatgtagtcatcatgacttttgaaactgatagttatttctctctttggctaaagatttagttagctgggggtacatgtctcagttggatgctctatagctgctttattcaggtgatttaatggctgagctgaatgctgggaaactcttgctttgaggacttttggggtcaaaatcattgtgatgacattgaaggctatagaactttgggactcaattgactgtccattggtgcagattcagaatcattttcagaggaaaattttggctcgttactttcttggctcacttccgtggagaggtgggttggcagcctacttagacatctttagtggttaggttccttaattatcataagagaatactcacctgattgcatttgattatgaaatatatatagtacctataattggcagtatggcatagcttcactctagcaagtatgtatccacatactctgctgcctgatttttattaaaaaaacctagaaacagcattttttgagaattgcttaaataaaacactttcaatccattgctttagaaagaatcagtttttacttggaccaggccagaataccagagagtatgttgattgcattgttttagactgggatagaattgcttttacagaattgttctttggtgtaatgcaataaacatttattaagagctattaaaacaaacagc

SEQ ID NO: 93101 - DNA, 1057 bp, Homo sapiens
tctggttatcttttgtgatgttagcagttgttggtatcactattggcttttgcttcttaaaatcctaaagtgatcaccatgttgtctagaagaaaatggggaggcattgtctggaaatgatagagtctgctttgtacaaataggactcctggtgtgaccacttgagaatgaagcaatattgtgtggaatcaagaagatctaggtatcagtcttggctcctctgtgtaggagctgtttgatcttgcgtaatcaacaaaatcagcaacaatgacagcagcagctacattcacttagtgcttgttttgtaccagattatgtgctaagtgctttatatacattgtgtaatctaatctttataacaatcctgtaagccagacattatcatatttatttttgcagttcagaaatattaaagtgtccaaggccacattgctaagaaatagtgaaacagggagttcaagcccttgcttgactccagtcttgtgctcataatcactttgttcttctatatctgtaaaagtgggtatacaaatagctgccttatctactttgggggtcaattagatgttgtttgtgaaaatgccttgaaaaataagatagatattaaagtgagaagtacgctgggatgaccattcatgaggaaaggtggatggtggaggctttgcctataactaagtgacagtgaaaagtttggatggaaagaaccctgtggtcattttctgactttcatttctattactattgctgttgaaatgtggaagtgttttcttctcttgttaaaattgagagtgatagagattttacaggtggtaaatgttgcatgtcagaggttgcttgagagtccctgggtgaacaatgatgtcttggttttactccatttgccatatatgtaggcttagtacagatgggtttaacagagagaaagagtatagtcacagttcagattcttttttctaaaaggacaaatatttgttaaaagtaggagaaattataattgaatgtataatattttatctctttagctgggtagtgggtatataatgtatattaaaattat

SEQ ID NO: 93102 - DNA, 1010 bp, Homo sapiens
atatatatacagaatggaatactattcagccataaagaagaatgaaatcctgtcatttggagcaatgtggatgaacctggaggactgtatattaagttaaataagtcagacacagaaagacaaatatagcacattttcactcatattgtgggagctaaaaaaatttgagcacgtataagtagagagataattgtggttaataaaggcaggaaggataatcgggaggcaggtattgggagaggttggataacagatacaaaattataggttagataagaataagttctggtgttctgtagcaatgtagggtgactatcattaacaagaatttagtttgtatctttaaatatctagaagagaggattttgaatgttcctaacacaaagatgatgaatgtttaaggtgattgatatgccattaccctgatttgattattaaacattctatatatgtattgaaatatcaccgtaccccataaatatagttactaaatgtcaattttttaaaaagctattatttttcaaatgataaaaaagaagtattttgtagaatgttaattatctatattccattttattaaaatatatacaattttgtttttgtttgcttcaagagaaatgtcccagtgtagtttatatattaattatgcatatcttaatgaattcagaatagtactttaaatatattaagtttatttactgctccccccacccattttccaaagtagactgcattaatttcatgtgattgatccaagtagatccaattgattgacttactgttttcctaatttcaggttccagttacagctatatcagagaatgagttaatctcctcagaaatcactaaatactactctgaggggcttagaaattaacagggtaagttgaatatcatcttaaatactatctggatttttatagtgaattcctaatttgggcctatagtgtgtcaggcaacagttgggcactgggaagaaaattccttctcttattttccatgcctgtagt

SEQ ID NO: 93103 - DNA, 1037 bp, Homo sapiens
taagaaaagtgtttttctcttcaaattgctatcccctcctaatttttttttttttttttttttttttgatactgttttgaaccagtaaccatggtttcttgtagaggctccttgggagctttaacaacatcagtcagtttcacagctggaagcagagtgatctagataaaagcataataaaaaagcttactgaggtttttttcccccctgttataacaattctttcattagggagcactttgcataaagtgaaatgttctctgttcccactgaagtagacattttaatttaaattaacagtaacgtagtacctggttcctttttagagtctagaaaagggaggtaatactaccattcacctgtccttcacctgaacctaccctgtctctgtccccttctttttttgtttctattttcttaccatctttctgggccaatggtgagtgatagtaatactgacatttggggttcaagatggatgaagtcgtgaagttgtagctttgaattaatgagggaaaaaggagttaagtagcaataaaaacttgatacagtggtaccaggagtttatttgtcaggatcaagaagagtcaaggactggctcttgtcagagggccagagtaagtaatttgttagaagtcagcgttggcagcaagcactgtcttgacggatggcactattgagaagggaaaggaaacctatatttattaaactctttacagaaaagcttgccaaccctcattgagatagactggatcagtctaccctggactggatatgagaatggttatattgtggggaaagcacactcttaggttatactgcttgtggatattagtatagctgtggcataaaaggagcatgatgggaatttggatgagagtagtgggtcttctgggcctttctttatcgaaagtctaaaccctgcctgtgaaaggaaactccaaatgtaaacattgaatgtttatttttttttacacatttctttgtccttcctacatgtatacctatgtccatactctcacatggttttactgtaa

SEQ ID NO: 93104 - DNA, 1409 bp, Homo sapiens
tagtacccaattgtattcttggttattttctttgttactccataattgcagtaaagaaaaaaaatgggttattaaagggctattctcagttttaactgacaatacaataaatattggtaactcatattaattaaacctctttgggtccttgataatttttaaaagtataaagggatccttaaaccaaaagaatttaagaactgatgatctatgggaaagaaggggctattaatcaagtaaatttttctattttctgttcttgattcataaggcaaatagttctgtcataatcagagaaaataagcttttatttttagaaagtagacagattacatttctgtatttaataagaacaaaaagttttcaatgtatgcatattcaattttcaatagattctctgcccctgttctccctgcctaccaaccctgcttcccccaccagctttggtccttgcttctggtgagaagagtcaagggagttttcttaactctggtccatttacttgttcaaatgctactgagtgttttgttgatgaatggcagatacaattcctttcttagggaagttgctgctaaatgatgaaacaatatatacatatgcaagatattactctacgtatcaatatagaatattttgaacagaatattttccaggaagtaaaaataacagttcttataagtggattttgagctgactcttggggtggatgcatgaattgacagagagaggagaggaggaggagaaagagtatgtgtagagaagggtttgacaaacttttactgtaaaggaccagatagtaaatgctgtaggcattgccaaccatacgggagctactggactcagctggtgtagtgtgaaagcagccatagacagtaagtcataaacaaatgagtgtgagtgtattccaacaaaactttgtttatggacagtgaaattgagttttatataattttcttgtctcacggtaagaaacaaatgagtgtgactattccaacaaaacttttttatggacattgaaattgaatttcatgtaattttgttgtgtcatgaaatattatgcttcctgtgttttttttcaaccatttaaatatgtaaaaactggccagatgtggtggtatacacctgtaatccctgctactcaggaggctgaggcacgagaattgcttgaacccaggaggtgggagtagcagtgagccgagattgcacactgtactccagcctgggtgacacagcgagactctgcctcaaaaaaaaaaaaaaaaaaaaagttgaaggaaaggtgagaatgtgttcatggccacatgaactggggatttaaaaattttgttgatcttttcaaggaactaacttttgctttgttaattttttctactgttttatttctttcactgatttctgcatttagatta

SEQ ID NO: 93105 - DNA, 2325 bp, Homo sapiens
cattgatttctgaataattgtgggattaagattttatatgtggtcttagctcagatattcccctaatatataaactcttcttaatcactattctaaagtatctctcctagtcactctctacttcattattctgttttcttttctcctattagaatgtaagctaaaggagagttcaactctgtatccctagcacttggtacaatgcctatcacatattaggcttttaaatatttgagaattgaatgactgcctgttagaaagagaaaatatgtatactgaggtatactgagtaaaagaaataaaaagcaaatgttttataatttgattttaaaattccttactaatgtttaatacctgtttttttgttttttgctgttttttttttttttttttttttaagttaaggctaggtctctgtttgtcattcctcaccccctacccccactactgtgcatgtcaccatatggaaagtgatggttacatgtgatataaattagcacactttgttatataattaaactttgcatcccccaaaaatggaattacttattaaaatctctaagtacagatgctggtcactactctactttaaaaggtaatatgtaatttagaaatatgataaaaataaatctaaatacttggaaacaaatagttttactgttaactttagtagctgttctttgctatccttaaggggtacgaagaactggtaagactgtcgttgtcagttagcagtgtggtagagtagatagaacctgcacatagaaaaaattagtaatgcaaacagttatctgataaaatctatgccagttttaactatcacctaaagagatttaatatttactttttcttgggccttagtagaatgccatcttctaacacatataaaacctatattggaaattaaaatcctatctgagtatcctgccataatgttttggagatttagaacaacttggttttgatggtcctcagtagaagctttttgattaagtagagttgttctttaggaaagaactaaacacttgcagtttaggtgttaggtttaatttttaggtttttgagtgtggattttctctgacatcttgttttctcttgccttgtggcaaatacagagagaaattgtattgcagaatgatgatacaaaaatgctcttcctccaagtaatagaggctaatctagcagttttactaattgtgttttagtttttcttcctccctctgttctcaccttcaaatctgtgcctaattccttatattaataatctgggaggccgggcgcggtggctcacgcctgtaatcccagcactttgggaggctgaggcgggtggaggacctgaggtcaggagtttgagaccagcttggccaacatgttgaaaccccgtctctactaaaaatacaaaaattagctgggtgtggtggcggacgcctgtaactccagctacttgggacgctgaggcaggagaattgcttgaacctgggaggcagaggttgcagtgagccaagattgtgccattgcactccagtctgggtgacaaaagcgaaactccatctcagaaaaaaaaaaaaaaaatctgttatgtaccccacctcgtgccattattctgaagctcatgggtttgtatagaaaaatgtgtaatgttctttgaccagtttaatgatcagagcttattctctttgagcttttaactatattaggattgttgaattagagcaggttcattaattgcatatattaattttttttaatgttgtgtatctactctgctccagattaaaaatacctacacggagcttacagttgagtgagagagatacacaataaacacataatcacacaacaaatatgtaaataaaatagtggaaaatatgctgtgaagaaaacgtagaaaatgctatgaaagtacagtggaggctgatttagattactgggttaagagaagtagaattttagctgaagtttgaacaatgaataggaattggatagatgaagaaggtatgagggattattcacagcagataacatattgtagggaaggccttagagtaaggaagaaagattggggaataggagaaacttttaggaaagaccagtgtggttaaagcatagtatgctttggggagagtggctatgctgtgagttttggattttatcataagtgagataaaaccctgtggaaggggtgtgtaagcaggattagaatagtggatttgtgtgtgtgcaggggaatagataaggtggggcttggtgattgaataaataaagtgtgatagtgtaaaaatttaaagggtggtgatatctaggttttgggtagcagcagttgaa

SEQ ID NO: 93106 - DNA, 1758 bp, Homo sapiens
gagtgcaagaaaagatgcttggtgtcattagtgattagggaaatagaaatcaaaaccatgagataccatttcacaccctcaaggatggctgtaattttttaaagacaggaaataactctttatttggtgaggttgtggaaaactggaacccttgtacattactggtgggaattttaaatggtgtagttactgtggaaaactggctttgataattcctcaaaaagttaaagagttactgtataacctaacagttccactcctagttaaatactcaagagaattaaaaacatggccacataaaaacttgtacataaatgttcacagcagcattactgataatattcaaaaagtgaaaactacctaaatatccatccactggtgaatggataaacaaaatatggcatctccaaacaatagaatattattcaattattaaaaaggcagtgaaaatcctgaagtccctatccttccttaccacatgagaaagattttggttgtcattgaaatgaacagctaaaatgaaaacttgtttcaaagacccttacgtgtcttaggactccagtttgagaaacatttttttggaaattacctagttcagatctctatttatcatgtttttcctgtgtgatgcccttcatacaactattaacttggggatatttagctctcagagtatccttctcactatatataaatgcttcttcgtgctaactgcctgctaagcatttttaaatatattattagaaatgtttattaactaattggcagggactttttaaaattatgcagttctcagctaaatccaagaaatgaatgacagatttcttatgtagaaatttaaattcaactgaattataaggcacagttctatttctttagccttcacctgtttggtttagtctggtacatttgaacagagataaatgtagtttctagttcctaaaactactctctagagattgcataagattgggtataatttagcaactctttttaaatcaacagggtacttttacttagaaaccttacctctttttaaatagtgatatgcaaattggtttcctgaaaccagcatttattttcttaatgattcttatttaagtaccctgactgcgaaatacaaagccatttcacataaatacaactgtaatagtttttcctcatgagaagttttacattgccttgtttattgtgttttgtaaacaggaagcagttaataccagaatcatactatcagcaaattatgggtgactgtctcatagctcttcagctcttggctcttatttcagtaggccagcctgtctggctgctgttgtttgttgtttgctctccctagccccagaatctcagatatagcagttgtgaatctccagctagtagtctaagggtagtacatatgggaatcttgctttagatccagaggtatttattactcaaaattattcaatctgtgagattgtattattcagatcatgtaactgcagcatggcttgggtttgtagtactgtgaaatatcacgggttgtttttttacaaaataatagatctttactttttcaaaattagaatattccctaatttctagaccaagaaggcagtttgctgtttttttcccattgaaagacaataaggattttaagaaatttcatgtttctcaattataagaaataatttcaaagattttaaaaatatttcagaaaatatttaaccatacaaattaaatatctttgttttagaaatcttaaatgttgtattagta

SEQ ID NO: 93107 - DNA, 1862 bp, Homo sapiens
ctaattggttgtaacaatttcacaaaggattattaattttattttacagatgtagaaaagaaagtatagaaacactatctgatgacctctgtacttttatgtagatcttcatgtttttatgatggctgtaattatctattcattgatatagcacaatttttagaaattttctaacagaggggagcttccctacctttatttggttggaaaggtcataagggtagatttcttactgttgtccttcctgtttaggtgtgaagtttttcaacatgagtggcctcggggacagttcatccgaccctgctaacccagactcacataagaggaaaggatcgccatgtgacacactggcatcaaggtaggaacactcctcttagtctatttttggcagagctgctttattactttcactgccacttcagagcttttgtttaatctactccaagttcagtggctttctttgagtctttcatactcaccatgttgtcttccttcccccagggtctttgcacatgtttctccctcaatccagcttgcttcctcttgatttcctttagttaacacctactcatccttcagatgccagcttagtcattacatacttaaagagagccttctcttccttccataactgttagatcaagttcctccattcatgtatctgtctcagatgtttttatagccatgatccataattgcagatttttactagtgtgattatttcatgaatttctggcttccccgctagactctaagctgccacttggtaaaggaccttgtttgttcttgctcatcattgtatccttagttcctaaaacagtgtgtggcttatatatagtaagaacacagtaaagatttgtcaaatgaatatataaatctattatacacctttaattgctatcttagaacattatggcattaatggagctaagaaatatcaggattttaaaaaatgattgtgtagttaaatatttggtttgttataaggaatatgaccaccttgaacaggctaaaaggaacctaatgctaaggagaccctcacaaatgccagatagagaagaaacctcaaatgccagataaatttaaatatgcatagttatattcagtcctattaacttttgattagtattgcattacatgaatataccacatttgaaaaatatgtttttctgcagatacataccctagctgctcatttaatattaggttaaaagagcagctagcttcctacctgagagcagcttcctagaatgagtggagattttattccactcatcttctaggatttagaggaaagtttttcaaactccacactattgacatttcgtgtcagataattttttgttgtgggggagctgtcctgtattttgtaggatgtttagcagtatccctgcttctacacaccaaatgtcagtagcatcttagttgtgacaaccaaaaatgtctccaaacattgccaaatgtcccctggggccaggggaaacaaaatcacctctagttgataatcactgatctagagagtaaagctacagaagactcttctgtccttggattacatgctgctttctctcatgggaggaaaaaaaggaggattttaacaggagaatgccagggctccaggctcgagaaagaaaagtgactatttatcttactcagctcagagagctgtcagagagagacaataacctgagtactcataatcacaagtaagtgtccagatgctgggaggaaggttgagatcaagatgcaatctagaagtgtgtcaaaaattaatgctcttgttttatctgtgtataaaatcagtccttaaaggaaaagctaagaataaatatcttttacatttaattttttgtttggggaaa

SEQ ID NO: 93108 - DNA, 1055 bp, Homo sapiens
agagacagggtttcactgtgttagccaggatggtctcgatctctgacctcatgatctgcccgcctcagcctcccaaagtgctgggattacaggcgtgagccgccacgcgtggcacaaatccatttttttatcatagggtctatttactttagttggagagttttcctaataattagacaacttaatccatttattcagtacatgagaagagagctctaaaaatgaatggatatgctaatttttacattcatttttctttttttcctccctttccttccactctttagcctatatatgctccaaaagtggaggggaggaccttggacagaaatcctatataactaaaccagacatgcatataaaaatgttattcatagctcttcattttccacattgttcccccaacagaatagaaacttcatttccttttgaaaatagtcatatatgtttgttgtaactggggacttgaaatgattctttctattaaaatcactactgatatttgaatcaagtatcaaggtatcttatgtattttattttgaaattttaaagtataaatgactttagagataaggtagtagattcttttattttaaaaaatgagacaatgagcatcaaagattaacccaaaccttagaacttgctaatagcagaacccaggacttcttactccagtataggtttgtttccatgatttcctctaacacttaataaaggatgagatggaaaaaaggaaggagggtcattggagagtttaaggtaggaaaacgtttgggaacagtaaaaaagcagccttggccaggcgtggtggctcacacctgtaatctcagcattttgggaggccgagatgggtggatcatgaggtcaggagtacgagaccagcctggccaacatggtgaaaccctgtctgtactaaaaataaaaaattagcccagcgtggtggcacacacctataatcccagctactcaggagactgaggcaggagaatcactttaatccaggaggcgcaggttgtggtgagccgagatcacaccattgcactccagcatgggtg

SEQ ID NO: 93109 - DNA, 1037 bp, Homo sapiens
ccaagttaaaaccccacttaccaatgtacctgtggttttgaatcattttttcattgtcaaagtataactggaaaccaactgaaaaactcattaactgctgtaaaattctgagcaaaatggctagtaagttttaatttttaatttttgcctttgattatagtatttgaggggaagatcatacgtattttcttggaaatgttacagttttctaattggtagacatttagatttgctagggagataagtattctattgcctcaggataatgttagatctgaagaggtcagtctgtcttttaatctgagtatctaattaagcagatggcttaaagtacatcttttgtatcttcagagtttgtgctttttcaccatattcgcaagcacataatcaatttttcttcctcagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaaggtaaagccaaacggtctttttaaagtgtttatttcttctgtgactttaaggaaaagagaggaaattaattataaactgcctttttcagatagtatttttggttactataatatgtatcatagtggctattccatttgctatatattcttaatacttaaaaaacaataattactaacatctagaatcattcctttaatatgccccccagattctcagttttaagctggcattcccactaaaatgtcaaataattcaaaccaacttgctgtctagaaataagagatgtaactaactgctgccagttggaaatgtaccagatgcagcagactgttgaacagctctgatttttagaaagtttcaagtttagagtgtagggaacattggagaatagagttggcatttttcaggctatacaaggtaatttataaggagaaaacttaagaacagatgga

SEQ ID NO: 93110 - DNA, 1054 bp, Homo sapiens
caacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccaggtgggtaactgcttgcttcacagaatggtcattcttagtaattttttttttcatttattctattccatctgtagaccagatatgaattcatactatgttttatcctatccattgggcatatattaagaggttagtatcaataactgatcacaggatgccctcagaagttttctttagaacttcagaaggctacagttttaatgcagaattataaaaaaggaaatttttctttctctataaaatcagtgttcacatctttagacattttttaaaataccttccctgcccctctctcccagccctacctattgaatctaactctctaggaataaaacctaggaaccaaacctaagtctgggaacccctgatgtaaatgaagtgggagagaaatgtaaggagatggacaaggttacttagtctggcttgtttttt

SEQ ID NO: 93111 - DNA, 1029 bp, Homo sapiens
attttagatttttagctattctgaggtgtgtgttctaatttgcatttccctgataaatattcattggtcatttggatatcttcttttgtaaattgcctagtctagtctcgtgaccattttttaatgtgtttttattttgcttattgacttttaagagttctttatgtatgagtcctttattggacatatatttgcagacatctttttagtgctaaggcttaccttttctttctcttactggcactttttgatgaggtgaagttcttcactttaatatagttcaatttgtcaatcttttcctttatggttaatgctttttgcacatgtgtaacaaaagacatgttcacaaatgtttttaacagctttattcgtatcagccaaaaactggaagcaacccaaaaatccatcacaatagaatggataattatgttgtgacatattcatacagtgggacactattcagcaataaaaatgaatgaactgctgctaaatgtaacagtgcccaaacttcagaaatataattaaatacatatatgtaattctacttatatactctagaaacaaaaatttcagttgaactagataatgaaacccaaaaagtaatcatagtatagcaatattgtgaaataaaggccagttttcttctctacataacctaagacagatgtaggaactccctatttattcttttttattttattttattttatttatttatttatttatttttgagatgggagtctcgctctgtagcccaggctggagtgcagtggcacgatctcggctcactgcaacctccgcctcccaggttcaagtgatcctcctgcctcagccccactagtagctggagttataggcacgtgccacgatgcctggctaatttttgtatttttagtagagacggggttgccatgttggccaggctggtctcgaacttctgacctcaggtgatccacccgcctcagcctcccaaagtgctgggattacaggtgtgagccatggcacccggcctccctatctattctaaaa

SEQ ID NO: 93112 - DNA, 1008 bp, Homo sapiens
acatttcatattgatgttttaatgcctattagcagttttgagaagccttgtattaaagaatgtagtttagatttcttttacccaacatttcccaaactttcctgattatggaatttcttttctcaagtaatacatgttataccacagaatgagttttccatgaagttgcttaggagacaactgtgttaaaatatgttattgttctaacccaagttagcattttcctagttgagagacactttgatagtttaatacattaaatttatgaagataaggctgtcagatttttttgcccatcacattttgatgttgaaaaaaccagtggtaagaattccattgtatgaccttgaaactaaaggaaactaatcagcccactttcaaaattagtctggattttcaacgttagttctatcccttttctgatggtatcatatgtgggacttcagttatttcagtccaactggaacttttaactgtcatgacccaattactgatagtttgccaggatttcagacagctgcgaagaataatcttgaatccatctgtgacatttttggaggcagtattttagctgaccagagtattagaggaagagtcagaagcctagattcaaatctcacattctccagtcattaacagtcttacctcaaggaagtacattttttgaaccttattctctttatctgcaatataagaattagattaaatgattttgaaagtttcttctaatagaagcagtgaggctctagactggaatgtcagtcacaattgaggaaacagtaagatgcaaggctgaaaagagataaaatgaaagtctgcatattgattgatttggaggtctttatctccttccccatccaatatgggagactggaagaattttctcaggggacattgaatgggcggaaagatgtctggatgtgagtatataagtacaaaagccattctgctatctcatcatccaacaatgaaggctcccagaagagacaagcctggcactcagccctc

SEQ ID NO: 93113 - DNA, 1005 bp, Homo sapiens
ctctatcccccatgacacttatctttttctcttatacttttcttttccttgccattttgcactgtattctgagagaatctctgagctcaactttccagatcaaaactaaatcttcagctatgtccatcctgcccttcagtccatctattgagatcatttcatcatagctataattttaagatttctaaacattctttttcttaggagtctattactttttatggatgcaatagactttttaatctgtatgatgatatttattgtaatttggggttcactcattttctatactaactcttttttcttcaacattactttcttcattaaagttgctttctttctcctgttgacttttcttgaatgtttggtaaattttgactgtctctccatatatattgaaaaagatctagaattttaaaatactggtagctagtgtatttctttagctaaagtgagaagcccttttcccctggcagtgaatgtagattctgattatagaagccctacttctcagttgttgtgaggaataggccttggaggtggggaaaccccttgtggcagccctagcaccccctttgggagattccctgggcagaactcccattttgagtcatatgctcacaattgtaatcccatggacaggtgccagagtcagctgcactcagagcaatggcctggcagcagctgttcagccatccataattatccagcaattgcccatggcctgttcctttatttgctcaaatgaccactgagcctggagttgttctggtgttctgggaaaattcctctctttggaaaatctctttctcctgttgcaagtgttttagtttagttgaagtttcacaatcagtttgtttccatttgtgttttgtctttcagaaattcttcgttgttttagtcttctgccatgaaaatttcttctgcctttccttcggctgtagatttgtgttccccttttttctttcttgagttatttcagtggtgtttttgaagagaaaataa

SEQ ID NO: 93114 - DNA, 1066 bp, Homo sapiens
ttttttttttttttttttttgtacttttagtagaaatggggtttcatcatgttggccacgctggtctcgaactcctaacctcaagtgatccacccgccttggtctcccaaagtgctgggattagaggcgtgagccaccacgcccggcccacagcagacatttttaactgtttgctcttgtggtccttaatgattatctccatatctgttgcttatacaatcttaaatatttatgccactacgcctactcatttcctgtcatgagagagaagatttaactcactcacaactcccaggcccctattctccttcattctcctaatatagtaacatcactgggcatcaatctctccaacctcaatcaatataaataaactttattttcttttccaataatcataaacagtatctcttgatgctctactttgtaaattaagctgtttctcttaatttaataattgtatgatgttccccttaaatagtttgtatctcaaaaaataaaaattaaattgttctttaagttataggtctctaagtgctttattaggagcctaattgaatgaattgatttaattgaatgaaaggtctttaattgaatgaaaaggtcccttatccctttcctaggagaggaaggatggctcttcaagtctttcatgaaagttctgggagtggacttgacacttttattgtagcaactgggctgccttgcagagagatttggtatatacctttaaaaagtatcaactgctggcagggtgcggtggctcacgcctgtaatcccagcactttgggaggccgaggtgggcaaatcacaaggtcaacagatcgagaccatcctggccaatatggtgaaaccctgtctttactaaaaatataaaaattacctgggagtggtggcacacacctgtaatcccagctactcgggagtctgaggcaggagaattgcttgaacctgggaggcggcggttgcagtgggctgagatagcactactgcacactagccacactagcctggtgacaggtgagacttcgtctcaaaaaaaaaaaaagtatcaactgctaaacaa

SEQ ID NO: 93115 - DNA, 1060 bp, Homo sapiens
aatgtatttttacctggcctcattgcctcctctcctgtttttttacttgctgttccctctgcctcaagttaactctgccctcctccttgccaccttgcattctcatccttcaagatgaatgcaagctgagctcactcatgcttcttggtccctgtcttcatccctagactgaatgagttgctccctctgtgctgccgtagatgtgtccgtctatgcagacaaagcacctgtgcattttactgttgtgcgttggcttctgccactcaatagggaacggaactcctagaaggacaggaatttgctcacctttgtaacctccaaactttatacagtatcttgaatgtactgagtttttaagtaaatctttataaaattaacttggtttatctaaatttatgttcctggtctttcaagtttaagaagtatatcagttttggtatttaagagtctttttgacttttaaaactataaagttggtatctttctttttgaagtgactcagaacttcaaaaagttttaacttattccacaatgccttagatttgtcattttaacatttatattataatgagcttttccccaaaattggtttgttttctgatctaatgggagtgagaaaatgactgaagttagaattaagagttgagctatttgatgacaagagatttaatcactgttcatagctctttggattcttataaaactttcgtaggctttctagtttatgtataatatattgaaatatatttatgatatataagtatatataatttgtgttttacaaagtatataaacataaaatagtattaatattattgttactgttatcttccggaatagtttattcatatgaaattattgaagaagaaatgttttaagctatacattgttttcaagaaaatctcatttccaagaatacttcttttgttaccagatactgttaaggcatgcctggcatgcctatgacctggaaccctaatcctggtctagactgatcttccaaaccagtattcacagaaaattgttctgagagatagatattaatggttagatgttagaa

SEQ ID NO: 93116 - DNA, 1019 bp, Homo sapiens
tttttttttttctccaaatcctggctgctgaacttttcacacatcactttgagttttataaggattttaatttggttgtgtcttagttataatgacagggaagctgtctgatctgacaacataataagtaaggcagttaaagttgaaaacacaagactatattcttctaaagttcattgaaaggtgagagaaaatcttcatgttagagaactgtgtaggtctcagtgaggaccatgtataaattaggtagaaatggaaccatatctgtaatacaagaggaatttagtctcctaatgtattctaatcccaacttcctaaactcactctggattttgtggcccatcattataatcactaccttacaggtactctgactcccttgcctatctctccctctgttgcacttatgcctggcaaaattctccctaatgaaatccaactaaactcttactttatacctccacctaagtattgaaatatggcttggggaaaaaaaaaaacagtcatgctgacatgtctcaataacctatttctctgctcccctttacagttaaattccttaaaagattatactctatccacttcccctactcctactccttgttgaactaatcaggctttcattcccatcattccacagaaagtgtccctgtcaagatagttaaatgtccttttcagtgccaaaagcaatgctcatcagtagcatttgacatatttgagcatttattctttcttgaagctcttcatttggtttctagaacaactctctgtcttgagaaaagtgactctcctcctatcacttagtctccttgaggatctttctcatctccatgacctccatttgagggccccagaggtgattctaggacctcttcgccatacccactccctcctttggttgcatcacccatcttactattgtcaatgcctactgctatgcttgactcccaaatttaaacctccagtgcagatggctttcctgaacaccatactctatattcagctgcctaaccaatatc

SEQ ID NO: 93117 - DNA, 1044 bp, Homo sapiens
ccaaatcatttgggaaagaaaacagttaccaccaactctttaaacactcacacttgctcatttggttcatgtgcaaaagcttattagtcatcataagccttgtgtattagcgtatatcacctggagacagtgaccactcactgtctctgtcacacaacacaagataccatgaggaacactgaaaaacaacccctgctgccaaataacgaagagtctagttggtgagggggcaggtcagagagaattaaaacatgaaacagtcagagaaccattaagtagaatgatgtaatagagttcagaggtagtgtaacatgattctttttcattatctctctggtggcaagagaaagaaatggttaaacaaacctgtgggtcctggaactgggtagtgcttctgtgtaaggctggttgatgggagaatcccattgcttattagcattttaaaggataagaagtcctgttgtttaaccttttgtttctcagacttatttgaccagggactcccctgcttgttaatacctgtaatatctgtggaacccactctgggccagagtattcatccttctctttttcccatcatttagtgactaccaaatacctagtgctaccctgagaaaactgtgatagctgctacaaagcaggcaggaaagcagagtgaggaagagggcctgtgaatgttggactttaggtgtcagtggacccagacgtctttctaggacctaggacagtgattgcagctgcagaagagcttggtctccttcccttaatgggagatgctaaaatggaactattggcaggagcagtttgaaagaacttaaactaatatacagtcccaaatattaatttgaaaggaaattaagctctaaatttttttcaataagtatgacatcattgcagtccttgaagtttccacatgcattaacttacatagccttgctcctccgcagtggtgacttatgtatcaattgacaaatgagtactgtcttaggcagaaatgttctcattagaaaataggcatagaggctgggtgcaatggctgatgcc

SEQ ID NO: 93118 - DNA, 1125 bp, Homo sapiens
agcttcagacttgagggccactgcagatctattccagagctctctctgatattctgctctgaggattctagctgcatccccttaactcagggagcctgccaggcgctgcctggattccctttgtccatgatacagccggaaatacactccaggcagtaggctgggcggttgccacagtagggactgctgaactgttagggatcactgtccttcgttgcctttgtctaatgtcttcagtgcctttttttcacatattttgtcaatttttttagctgattgaggcaggaggataagtctgatccctgttactaaatcttgaccaaagtgtgagtctaccactaattaacatatgtatgtgtgaattaactttttattaaagtatcatatataagaatatagagaaaagtgtacaactcaatagattttcacaaagtgaacacacctgagtaccactcagatcaagaaacagaatgtcatcagtaccccagaggttctccttgtgtcccttacacactcactaccccacaaggggaatgactatcctgacttgtaacaacacagttaattgctaagcttttcatttttgctgtgctcctattacttttctgtcagtgagattgtttttcattggagaatttggttttcagtttaaacaactagcttgtaatttgatcttgtatttatctttaatagataaatgatcccgcactgagacacacaggcctctactgcaaccagctctcatccactgaccttctcaaaacagaagcagatggaacccaggtcagtaaggaaattctaagcccagagctgtcaaatgtactctagatgcacagaggtcattgtgtagcatcattaagagcctgaccttgggagtcagacctgggtgtgagtcctggctctgctcttcttagctgtgtcgtcctgggcatgttatggagctttcctgagctgctgtataaccacagaactaacatgacacctgcttataggattgttgagaggattcaatgagatcagttcagatggcttaactcagtgcttagataggataaagtgatcacaaatggtggccactaattgttattttgtaaataagcacagtgctaaaaactcatctgtaat

SEQ ID NO: 93119 - DNA, 2079 bp, Homo sapiens
tactcatagtagtgaagggaaaattcacactgttctcaaggctaatagacgtactgttaattttagctcatgtgtttaaatggattgtctatcaggggaaaaaagtcaaatatgaaattgttctaatgataatttgctgtaattctaaagccaatatgtgaaagagctgtgtaataatatatttaaatactaaaaaatcttttggacattaaccttagatgctgatgtcctcttattgagttgtggttttgttttgctaatactggttgaaagccctttaatttttcagtgacatcataaagattttttatcctactgaaatcatccatagaatggttttaaaccagttttctaaatatcatgtattttttaaaacctaccactggatacccagactctgaaactgggcttctcccaatcttggcaacattagcaatgatactcactttcagtattgatggcaaccctataggaggcgtgaccattccaattttgattttatttttaaagtgtgaactttccagaaccctgagcaaaatgagtgcagcgattttctttttgtaggacaagaagacagaagagttcttctctgtggtgactacagactagaggaatgctctagtgagtttccacttcaagtagtacccactcataagccgggggggcagacccttctgtctaaacacatcttttatttgtgttccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaa

SEQ ID NO: 93120 - DNA, 1045 bp, Homo sapiens
gtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaagatcctcaaagtcatcctgatttgagccagaccattgaaatttgagaaggtcaaactgaagtcatgatagcaggccttgaggggttctaactgtgacattatctgatgattaaagacttctaggcctgctgtttcttgactcagaagatctg

SEQ ID NO: 93121 - DNA, 1103 bp, Homo sapiens
gagtgcctcacctcgaggaccactttgcgcatgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgagctagaagggagaaggtaggggaaagacccattgtcggaccggaccgtggccagggtggcgggctgaacggccttcttaaaactccttccgtggccgggaagcccgctggaccagagtagccgtggcctcgggagcgcgccggggccgcgggatgggcgcgggggtgggcatggactctgctggctcggacgatgggagagggcgggcggctcaggaaaggggatcctagccgtgacatttgtgtcatccgcggcccaggggttgtgcctgagtggtgtgtgccctgccgtctgggtttgaatgggactagatgtgatgtgactgttgccatttttcttttattagcaaggacattggagtccctatcaccggttgcctagacaacttcatgggaaggcccttgggaatctgagatggagcaggcgaaccctttacgtccagatggcgagtccaaaggaggtattcagagggtcgccgcctccttcctgctgctgcccaaagatgacccgcaggctgagagagccctttcctcctggaactgacgtgggacctggcctgtttgggagcagaatagtgaaaggaactaacattgaagacaaagggacaggcagccaagattattcgaggaggaaaaatggcttcgtttctaggctcccaccccttttgaaacggataagttgcatccatcatatgctcagtgtttatattctg

SEQ ID NO: 93122 - DNA, 1013 bp, Homo sapiens
aaaataatgggaacagaagtgagtttcaagtgggttgaggtatgagtcacaggcaagaaaatggagaaagtgagtacaagttgagcactgaagatccaaaatctgaaatactccaaaatctgaagctttttgagcactgacatgatggtcaaaggaaatgcttatttccagttttggattttcagatatgggatgttcagccagtaagtgtaatgcaaatactcccaattccgaaatctgaaacacctctagtcccaaaacgttcggatactcaacttgcatggacaactcttttaagtagttttcctggaaaggaaaggggagaaaagggagatagtagctgaaggggatttgtgggcaagaataggcctgtgagtgtatgaaattgtgtgtgtgtgtatgtgtgtgtatatatatatatatatatgagtgtgtgtttgaagacagttgagacttgagcgtgtgtggaagggaaatgaacacagcagagaaaagggtaactgatcatttagggtttctgagaaagcaaggggataggcctcaatgagtaaaataggataattctgcatatagtgcgtgtctgtttctatttgatctcacacaaattttttttttttgagacggagtctgtcacctaggctggagtgcagtggcacgatcttggctcactgcaagctccgcctcctgggttcacgccattcttctgcctcagcctcctgagtagctgggactacaggtgcccgccaccacacccggctaattttttgtgtttttggtagagacggggtttcactgtgttagccaggatggtcttgatgtcccgacctcgtgatccacccgcctcggcctcccaaagtgctgggattacaggcgtgagccaccgtacccggcccgatctcacatacttttttttaatggttttattagccataaaaaccataagaggtttctagtcttaattggataggtgaatgagataagtttttggattccgtcccaaggcaaggagagaa

SEQ ID NO: 93123 - DNA, 1040 bp, Homo sapiens
gacctcaggtgatccacccgccttggccccccagagtgctaagattacaagtgtgagccaccgccctcggctgtgagagggcttctctccggcctgtggtaaagctagagaatcatcctttacacactagagatgtggatttgcgataaactgcagacctagataagacactgctgcctaatcagcgtgtgatagttcatatcctctctcgggctgtctttgaggaggatcctgttttacatcactctccaacctaggaggttgatgatctttgatttcaattgttagctcccctggttttataaattgacagatatctaacaattcagctggccacaaagttctggtaaaaaaaaaaaaagagtcacctgttcttccctgagatgcttcctgttgccacagtgagaaatcctcagcttcttgtaaaattctccttttactctccttaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgagtagaagggtggtatcagcagttcctttagagtataatgaacaaacgtgatttgggaattggtgaattggccattttttataatgtgttttacttgtgatcttactggattgattgcagtccttgatccctcaaatgatcaaacctgtagagtttggccaggcacggtggctcatgcctgtaatcccagcactttgaaaggcgaggcaggcctatcgcctgtggtcaggcgtttgagaccagcctggccaacatggtgaaaccccatctctaccagaaatacaaaaattagccaggcatggaggcaggcgcctataatcccagctactcaggaggctgaggcacgaattgcacctgggaggcggaggttgcagtgagctgagatcgagccactgcactccagcctgggaaacagagt

SEQ ID NO: 93124 - DNA, 1068 bp, Homo sapiens
gttctttttttttaattaaagtgtaatatatatgaagtgcactatgacagagattaaagtatagagcattaccaacacccagaagcctccagtttgcctcttcctagtcttctcttaagtcttctcttaaggtacccactattctgatttctgtcaccatacataggttttacctgattttgaactttatataaatgttaaaaagctaatttatagcttaaaaagtacaaactcttatgtctggcttcttttgctgaatgttctgactgtgagattcacctacactctgcttatagtgctcattttttttattgctgaatagcaattctattttatgagtatactacatttatttacccattctactgtgatgacatttgggttattggggttatttcactttgggacaattatgaatgctgctgctgttaacattttgggtgtttctgtcctttgatataaaaatatacacttatatattgggtatatgcctagtagaattgttggttcataggatatgcatgttaggtttagtaaattctggcagtttttgaaagtgattgtaccagttttacattcccagcaatagtgttaaattccattgtcctgcatttttaccaatacttgctattgtcagttttaaaaatttgtcattctggtgggagtgtaataatatgtcattttggattgaatttgcatttgcttcataaccagtgatggtgaatccctgtattgaacatttgaaaatcttctgttgcaaagtgtgctttattcaaggcctttgtgaaatttttattaggttgtccatctattaaattgtagaaatctttacatattttgagtgagttcttttttgggtatctgtattagagtcttccttagactgtggcttgtattttcactctctaatggtgtcttgtgatgaaaatctttgttttaatgaagtttgatttagtaattaaactttattcttattgcccttgtttcttgtttaataaatctttgtctaacttaagatcatgctgatcttttccaggtattttattttttttattttttttgtttttg

SEQ ID NO: 93125 - DNA, 1483 bp, Homo sapiens
tggagatcaatgagcaagaagcattggaagagaaattggaaaatgtgaaagccattctgcaggcatatcattttacaggttttgtttgtttttttaacctaatttagtctgggtctgcctctagtgagttagtttgctagatgtgttatcagtcctggaattatttcataatttatagtattttacaccctctgccctcatcactcacacacacacacacacacagacacacacacagctgacgtgctatttgtaggcctatcttcacctacaagattgactggcccctttgtacagcagctcagttggtggctggcttattccactcatcttaacagttcgtcatgtgccagaccttgtactagaactgtctttactgctggcttgttttctgccactagtgaaatagtttgaactttccaagtctccgtttcaccgtaaatagggatttattctcccatctatgccacaagatagttgtgggaagaactggggactctgacaaattacttcacactcagaaataaagaatagctataaattaaatttttggccttgcttatgcctgtaatcccatcactttgggaggctgaggcaggattacttgagtccaggagttcgagaccagcctgggcaacatagcaagacctcatctctactaaaaatttaaaaatgagccaggtgaggtggcatgcgcttgtggtcccagctgtttgggaggctgagatgggaggatcatttaagcccaggaagttgaggttgcagtgagctgagatcgtgccaccgcactccagcctgggtgacagagtgaaaccctatctcaaaaaaaaaaaaaaaaaaatttctcaatagtttgacatttaggttgttttttcatttttaccattcttccatggttttaacaactcagtctcaaagtgagccggagccaaggggaagaatgagcctatgatactcattgaacaaacatttgtgtacaaagtgtacatattctaggcactgtggaagctactggaggcacagatgagtaagacatcaccttggcctgctgtctattgaggtgtcttcttgtttgcctcaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcaggtatctctctgggatgttatatgcctcatccgtgggcccaagatcaacttaaaagggggatgttttttgtattttcagtgtttcctaactgtgagttagaagtttgaccgttacctttccgatgcttgtttcttatttatat

SEQ ID NO: 93126 - DNA, 1027 bp, Homo sapiens
gtttatttgagtgaaacagggaaaataggtagaatccatgaagtagacctcttgagacactttctctgtttatatactgtacattactcagaccggtaagatagaacattcttgtttctaccagtcttttccttcctctttgtaaatggtaaacatgattgtccccattttcccttctcctttgcccacccacctcagcagtgttctcgcagcctatgatttgttttcactgggggccctgcttcaggaaagacacctaatgataaggctgagtcatgggtcagttatggtggatggagccagaagactcatttcactgtgaagacaaatggacatgacacgtcagcacacacttactcctccctacggagcagtctctaaatggaaatccttccagactggctgagagagagattttttggtgaacctgtttcagttaaatgtgacatgggcaataatgaaaaattgggtgaaatgtttttaggaggcagaaattttgaagctgccccagatttcacaccatcggtctttgatttctctgcgcagttagattccagtccccagtctctagattgcattggtccagtaaggggcagccttagtccagaccaaaaaaaaaagctgtatgggtccagtgggtccagaatatcagtgatccaggttccgattcccccagctgcactgagtgagattgaatgtcagtgatccaggctccgattcccccagctgcactgaatgagattgaatatcagtgatccaggctccgattcccccagctgcactgaatgagattgatggaatctttctttttaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagaggtaagtaaccagtactgaagacagtaccaggtgggtagtact

SEQ ID NO: 93127 - DNA, 1036 bp, Homo sapiens
agggctctcacagaaatgtagcactccactcaaactgcaatagcttgattctgttgagaaacactgatctaaataaatggaaaaataacccacattcactaatgaagataataaggaagacccaatatttttttttttttaaaaggaaagtatttttagcttttatgaaagctttaagtaatttttcctcattttcctgtttgaaacttttgaaaaggaagttcttcagtgtttgtttggttaggcgcagtgtattctaggccactgctttataaatatggtgtgagaaagcagtaggataaaataatcagagttcagtgtgtctcatattttgtttcctaaaagtttagtagagctgtgaatgtactaggaagtcccctctgaaaaagcacagttagttagttagaaatctgcccattaactcagggggactcaggcgccccccgggtcttccctctcctgcaggctctccggttagtgtcctgatttgccgtaaccacgggcctctgacctgctggcacctctggttccttggcgtgtgggtcactcacagatatgaaaacctgtgtctggctgaccaggttctcctgtagccctcccttgcccaggcacagataggagtcatgactggcccaaggccacgttcagacttaaccctgcaatggccacgaagtaacctccgtgtgggagagctccaggaacagtgcaggggattaaagccagcttggagtaccctttagaagaaagtttaagaataaaagagacagggccaggcagcaggcgttccggggtacagtgagctatgatgagaccttcaagctcttgccttccaggcctgtggtggggaccagtggcatgagtcagcaaagtaccagcactcctcagataagtgatattaacagaatttccacaatcactttcaagttgaataaagcttttaataaaacagtcttgttctttatcaatacctgtaaattctcttaaagcagtagcaaaggcgactgtagcaagagctcaaaaggcaaggcaatatcgg

SEQ ID NO: 93128 - DNA, 1013 bp, Homo sapiens
cctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctac

SEQ ID NO: 93129 - DNA, 1103 bp, Homo sapiens
aaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctg

SEQ ID NO: 93130 - DNA, 1087 bp, Homo sapiens
actggacgcggtggtgcacacctgtcgtcccagctactcgggaaactgagacaggagactcacttgaacccgggaggtggaggttgcagtgagctgagattgtgccactcaactccagcctgggtgacacagcaagactccatctctcaaaaaaaaaaaaaaaaagtagcgatgagctatttttaaattattcagagttggaataatctacagccgggcatggtgacatgtgtctgtggtcccagatacctggtgttcaaggccgcagtgtgcttcgatcatacctaattgtgcttgtttactgccactgcactccagcctgggaaacacagcaagacccactcttaaaaaaaaaaaaaaaaatgctggaataatctgactgatgtgtgagtccaaaaagctgagtgcacatgtcatgcatggaagatagatgcatttctccaacacatcatccagtcagtcggacatgctttgagcacgttgtccgcacctctttttaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctgtgagtgcccatcccaccctgcactctggccatgaagccggcccattccacatcacatcctacaataggctgcagaggccagagaaactggcttcattttcccagataagccccttccgcaatacatggacttctgcagccacctggaactgctgggctggggaaggggaggtgaggtgggagcccgggaaatcacccacagggtcacaggataaggataaggactggccaagcaacatctcgagacctctctgtcctgggactgtctcctcaaattcagagccggtcagcattgactgggtgacctgtataccagggagaatgcttttacacacgcgcggagcccccctaggagactgccgattttatgtcagtgttgaggttgtggaaacaggcccagaaagttaggaagttctcccaggatcatgtggcagataagc

SEQ ID NO: 93131 - DNA, 1055 bp, Homo sapiens
tttccacaacctcaacactgacataaaatcggcagtctcctaggggggctccgcgcgtgtgtaaaagcattctccctggtatacaggtcacccagtcaatgctgaccggctctgaatttgaggagacagtcccaggacagagaggtctcgagatgttgcttggccagtccttatccttatcctgtgaccctgtgggtgatttcccgggctcccacctcacctccccttccccagcccagcagttccaggtggctgcagaagtccatgtattgcggaaggggcttatctgggaaaatgaagccagtttctctggcctctgcagcctattgtaggatgtgatgtggaatgggccggcttcatggccagagtgcagggtgggatgggcactcacagagtcaaaatctgagatgatttcattgaggaaacgcagacactcaataccaccattgttgatgctctcctctgtgtagaagtcagcaaagttgggcagggaggcaaacatgactccaatctcatcatacgtctggctatacagctcctaaaaagaggtgcggacaacgtgctcaaagcatgtccgactgactggatgatgtgttggagaaatgcatctatcttccatgcatgacatgtgcactcagctttttggactcacacatcagtcagattattccagcatttttttttttttttttaagagtgggtcttgctgtgtttcccaggctggagtgcagtggcagtaaacaagcacaattaggtatgatcgaagcacactgcggccttgaacaccaggtatctgggaccacagacacatgtcaccatgcccggctgtagattattccaactctgaataatttaaaaatagctcatcgctactttttttttttttttttgagagatggagtcttgctgtgtcacccaggctggagttgagtggcacaatctcagctcactgcaacctccacctcccgggttcaagtgagtctcctgtctcagtttcccgagtagctgggacgacaggtgtgcaccaccgcgtccagttaatttttgtatttttt

SEQ ID NO: 93132 - DNA, 1075 bp, Homo sapiens
tcttccttccagcctttccaaggggagttcctccattcacgttcctgtttttcttctttttttgagactgagtctcactcttttgcccaggctggagtgcagtggtgcgatctcggctcactgcaacctctgcctcctgggttcaagttgattctcctgcctcagcctcccgagtagctgggattacaggtgcccgccaccatgcccggctaatttttgtatttttagtagagacagggtttcaccatgttggtcaggctggtctcgaactcctgacctcaggtgatccgcctgcctcggcctcccaaagtgctgggattacaggcatgaaccgccacgcctggccattcctgtttttcatccttctatccagtggccagcttagagcacatgcctcgccttgtctgtgtctgtaggtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggtgaggggtgtggtctcagcccggaaccatgaggccatttgtctccatctgttctttctttcaggcagcccccgctgggcccaggccttctcagggacaggggactggggcctaggtagggctgaacctaaacagcaaacacaaataagcaaaagaggaatttctccggcctcttataaagtgcactgctgtaggcatcgtgatgtgggccgtacagctctgaggccatgtgtcagaagacaagactttggctagagcccacctttctgttgcctgtgaacttctccaaacagagtggttcccagctctacggtaccctcgtcttcacagctggggctgttagaggaactagagaagctgttttaaaatttattcaaagtagtggccgggcacagtggctcatgcctgtaatcccggcactttgggaggccgaggcgggtggatcatctgaggtcaggagtttgagaccagcctgggcaacaaatagtgaaaccctgtct

SEQ ID NO: 93133 - DNA, 1049 bp, Homo sapiens
caggcggcactcacgtggcgggagaagtagtagaagctgagcatcatgaggaacaccatcaccgtcatagagtacttggaaggcaccaggggcagcctgctgggcagagcgtgtgcaactgaaagggctgtcatctgcctcctggagggggcctgattccctccaactagatggtgctgcttcctgccaccccagccctagagctcaccccggctccttaggccctttcacatcaagtcgggctcccccgggcagtaaaattttcttaactcactgggctcctctccaacagccaggcaacccctggcccctcctggctgcacctggtattcacatcagggctgctccccaggtatttaagaaacactgcattgcctgactgatcacagaggtagctacaaccatgcaggaatttggagaagcaagagacatcagtgatgggatttcatagccatgggactggggtacaatctcaccatggctttttaccttgttcatacatatttttatgtggagctgtggttagtttccattaccgtatggtatttcactgcatgaatataccagttatgtatccatttcctgttgatgtcatttgggttgttttcatttgttttgggggagggggtatgtctattacgaacagtgccactttggacattctcatacatatatcctgggacatgagtatgtgcatgaatttctctaagatgtgtgtatatatatatatacacatatacacacgtctgcgtgggtgtgtatgtaggagtggaattgctgggacacaggtttattttcaaccttactaaatagatcaaaatattttctaacacggttgtactaactcatactcccaccaggagtgtaagagttactattgtacttgatattgtcagagttatctggaccggtacgtgtgtgatggtatctcactagggtgtaactggcatttccttgattacttgagtgccatttattagtggccatttagagttcttcttttgctaagggctatgcaggttttacccctcttctattaggtcatcttt

SEQ ID NO: 93134 - DNA, 1007 bp, Homo sapiens
agtgtggcctttaccccaggggtggtagtccaggaactctaacattctctccctgccctgtcagacacgttcaggcagggggctgttcacggctattttcttcacctctgtgtctgcagcaccttgaacgtgcctggcacatacttgatgctcagtgaaatattaactgcacgaatgaataaaagagtaattggcagagagaaactgaggcccctcgggaagtggggatagggaggaaagtcgcttggtgccctcgtcctgctggcctgtgatgcctgactctgggctggccctggcctgccttaccccccacccaacaccaagctgtggggaccttgccaggccccctcttgtggaggggaagaggcccacaatgaatttctcctgcaggagcaggggcagctggctgcctcgtgaaggccacaccctgaccctcctttctgtgtgtacctggcaggtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggtgagtgccattccaagggggcaggtttgaggactggggaggggaccgtcccctccatcccccagggctgtgaccctgatgagggacagggggcctcagagaaggcctccctacaaccccggaacagcattcctcctgtctcgccctggtcctggccctggctaaggccgttctgacctgccttggggtgaggcctctttgggcctgatattggatgtggcttttccttcctggaccctgcagtagcctgtcctcctgtcccctttaccgacttagggggctgcctcccctttacccactaagggggctgccccagctctccttatgtcagagcccaggtctccccaaagggagagtaatgagcagtcatcagctagcgggctcgcaggca

SEQ ID NO: 93135 - DNA, 1063 bp, Homo sapiens
tggttttgtgtcgctggcgcctcgtgtagtgcctggtctgctgtcagtctttgatcaggtcaaagcagaattttgtgagcgatggctctgtgcagccgtggcgggtggctgaggtgaccccgcagggctcctgccgggagggctcacggtgcagcagcccacgcaggactgctgcgcttcttgtggcacgaggatgctgagcacagagccacgttgggatgcttcactgcgtttctggctcccctcagttgctctgaaggggccattgccaccctcagccttgtcagggccagaagctgcctgtcccagacccctggctgctcccgaggcagatctgtgaggtctctctggagggcagcatggttccctgctcacgtttcttgccaggatcggggcatttcttcccagaagtatctgaacttgcctctagcagggcctacctttgcctctgaccctctcctgcccctcacaggagaacctcatgctttccatcctgcccaagcacgtggctgacgagatgctgaaagacatgaagaaagacgagagccagaaggaccagcagcagttcaacaccatgtacatgtaccgtcacgagaacgtcaggtacgccggcccggggcgcgggctctgatggcagagcaggctgtggagggctgcatctttgtgggacccgctaggtgctgtgggcttcaagaggttttccagggactagaagcaaggcctcccacagcattcatcagcctggcggaggaagctgccagcagatgttgaagctacagtgtgctctaggctgcttggtccaaccccatcatagaacagatatcacctggagcggggaagggactcctgtgaggtcacccagctgttgagggccagcactggggctagagccctgacctgtgattctaggaagaaggatgagttcagcctgggcaggagtgggcagtgtggggtggtccccaggcaccacagggagggaggcctgcaggggaagtctgctaggacaagtgcaaggtcagagccctgactttacctggaagggtcagggtctcactgtctgggg

SEQ ID NO: 93136 - DNA, 1054 bp, Homo sapiens
cctcacttccaaggggaaaagcaaggccagaagaagacctggcccacagaagcccagccgggaaggaggctggagggaaggagaggtggccagctcccaggttggccagagagttaggctggctccagtcccggagcctcccccaagtcacagaggcctccccttcccaacctgcactcacagttcccttctggccccaataaggctggccattcaggtgttgactgggtggcctgaggacatatggtactgaccactcagacaggggtgggttgtcctgccccaacagacttgccccacaaacggggtaggcgactggggctgctcagacccaagaggtcaacaggtcattacaagctggaaccagacgccagcagagcttgggaatctacacccggtgacttgctgaccagcactgagactcgcctgacctcctgattcgtcacgcaacgggcccttgttgagtgccacagaggctgcaggaacattctgccgggtgtggtggtggttgatcctcagggcaagtgttgatcagctctgatgaaacacaacacagttcagggaatatggcataaccaagagaacccagaaaattcatgtgagaaccagcttcccttgttgtctgttagaccatcttgtttaaaaataaaaaattgacttccctgcctttttcacctaccccagaatacagtctactctgaggccaatcttttatcccctgagggccagaaattgagaaattcttccgcttctcttcccatctcatttctcaactccaaactcggttccgagaaaccacacctagcaggcgaggcgtcggggatccagggctgggagggtggccacagcctcgggggaagggcatggagctggcgccagggaagctggaggagccagaccaggaaagaggccttgcttgaaaaggcttactgaggccagtggtcttggaggaggaggaaggattagcacttggtccagccatgttggggcccaggcatggccaaagattggagtagcagcagccaggcctggccgccaggcagggttgggatgt

SEQ ID NO: 93137 - DNA, 1046 bp, Homo sapiens
gggaggtttatcttcccacctggccctttgcaaggtccgggtggaggtgaggcgtgtttgctaaacatgatgtagcgcaaggaggctcaggtgggctcgatggaggaggcggggttcagctagatttcgagggggaggcggaaggcggccaggtggggaggggcattctaagtgcgtgcttcccacattgggggtgcagggttgtgtttgctttggcgcatgtgaagccacaggatgaccgtggagttggcatttcctttcatcctgtgtcctccatgtattcattccttcacccagcagacagcgtgctgggtgctactgagtgctgggaacacagtggggactgggacagatgtcgtccctgccctagtggcacttacactgaaacaggtggagacatctgtttggcaaatatttttaaacacttaaaaatacaaatacaaacatggattttattgaacagaatgcagaatccacatatattagcaagtaaaatgagaagcttcctccccaggcactttcgtggggaagtttaagagctctcaaaataggggctacagcatgtgccgaggtcaggaggccagttggtgacatgctgaggacgtcagcttggctaaagcagatggtttacctcaggcagctgtgggggcggggtttagattcaagttcatggtaaagcccagagtatataggaccctgaatgccagaatgaagattttgaactcttggacaattggcagctattgaggtgttttgagcagaaggtggtacttgcaaaaatattattttggaagattaatgtgttccagggtggattggcaggaccagggagatgagtctgtccccagccctgtgggaagtaagggtgtgagccaggtggtggcagcaagagtgaggaaaaaggagacccagaggcttttacctggaaagaccagctgggatgaaggacctgctggaggcacagaaaggagctcagtgagagagagcaggctggcgctggttcaggcgttcagccaatgttactgaggacctgcgccgtgttgggt

SEQ ID NO: 93138 - DNA, 1029 bp, Homo sapiens
gctaatttttgtatttttgtagagatggggtttcgccatgttggccaggctggtctccaactcctgaactcaagtgatctgcccacctcggcctcccaaagtgctgggattacagacgtgagctactgcgcccagtcttgtctattcttaatttattgattttatttatgtgtcacttgcattttatttacttgctgtcgtttcagcaggcccatcccctctctcctttcccctccttgccattttctgtctgatgactcttccttcttctgagcaggttttcagtcctttcttctaggaaattcctctttgtggttcctaaggaattcactttgattagaaatgaaactgtttctttccttttccccttcctctcctccacaacactttccttcttgtagacaggaaagtaaatgacttgtttcagaagaaatctacccctctcttgagctccattcaaaaccccaacataagcgactggacttgaactttcgcaagatttccatgtctggggtttgttgttcacatgtcacttcaggactgatctccaggaagtgtagtttggtgtcggctgagtcagatctggtagtggaagactgcgacagctgcctatccagctctcggtgggctcctggactgcccttgggggcagtttctcacccaaggggaccaggccctgaggaatttattcccatgagcctgattcctttcatttttatttttatttttttgagatggagttttgctcttgagtgcagtggtgcgatcctggctcactgtaacctccgcctcctgggtttaagtgattctcctgcctcagccttccgagtagctgggattacaggtgcgtgccaccacgcctggctaatttttgtatttttagtagaggtggggtttcaccatgatggccagggtggtctcaaactcctgatctcaagtgatccacctgcctctgcctcccaaactgctgagattataggcgtgagccaccacgtccagtcttgagcctgattcttataagacagattg

SEQ ID NO: 93139 - DNA, 1366 bp, Homo sapiens
agccagggacaggaaattgagtgtctggcgtggacaggactaagtgtgcctgcggtgggcggtggtgtgagccgggggtggcagggaaggccctgggttgggaggctcttgcagcagagatccttttatgagggttagggcgggtcatggggaaaccgcaaggtaggagggaagaggtgcttctactcagcaatgcccttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggaggtgagtcctgcccactgtccccccacagcgtcctctcctgcagctctcaccaacttgggacctgttggagttgctgtttgctttgcctttgagtcaaaatgtgtcctgggggcctccggggctctcacctctctccctagtccctgccttttcacccctgtgccattacccggagtctgcctgtgcttggccccagggaaaggaggatgtcagggcattgggcctcagggccactcttcacctgtgcccagtctaagtgtgtgacaggaaggcccacccagggctggtc

SEQ ID NO: 93140 - DNA, 1047 bp, Homo sapiens
attaacattttagaatttattcatttattccttcctccaagcatttattaataaccttttctatgccagtcacttggctatactctgggataagaaataatgaagagtgagtatcaatttacagctaacatttaaatcctcctttatatcattctctctaaagttatttaaatgcagttatttttagtttaaaagcatgtttgaatgtagacttgatttaaaaaaaaaaagattcccacttatagctacattaatgcaaaattgtgaacaagaggaagggcctccagctctatccacgttaatgtgcatgacttgttgggaagctcttagtgagagaaacaagaaaatatggacccctagaaaagcctgccctcgttccaggaaggtgataaaaacaggggtgcagaccaaagctgagatgggcagggagaagagaagcattgtgctcactgtctgaggatgtgagccccgggctcctgctgaaaaggcagacagcccgagaaccagcgagcagagggtgtgaagccagcagaaaggctgactcaatgtgagtgcttcctaaaaatagcagagcagggttgtaagccttcctgtccaaacagatgtaaaactggcaggtagtgtgggctgggcgtgggggactgcgaatgaaaggagagtgggggcctccttgaccacagaccccaacactagggttctgggtgcacactcagctctgccacttgcttcccattcagcaggggatggctgcacgtggtgccagcagcatctcagaatgggtgacagacagaattgctaaaactactctgaacccatttcacggagatgaattttaatggagtgaaaaagaaattttttaaatgaaaattaaaaagtgtaacatttttttaaggcctgattttgccaaaaaaaaaaaaaaaaaactcagcacatattctactgaatagaacacttttagaaaggtgcccagcagtgcctggcatcccccatgggacacagcaagattggaaaaaggatggcaaagcaggtggctaatttattttcacc

SEQ ID NO: 93141 - DNA, 1040 bp, Homo sapiens
caccatgcccagctaatttttgtatttttagtagagatggggtttcaccatgttggccaggatggtctcgatctcctgacctcgtgatcctcctgcctcggcctcccaaagtgctgggattacaggtgtgagccaccgcaccgagcctatgttttctttcttttcttgctttcttttttttaatttttttttttgagacaaggtctcactctgtcacccaggctggagtgcagtggtgcaatctcggctcactgcaacctccacctcctgggcctaagtgatcctcctaccttagcctcttgagtagctaggaccacaggcacatgccaccacacctggctaatttttcctattttttgtagagacagtgtctccctgtgttgcccaggctgctctcgaactcctgggctcaagcaatccacctgccttggcctctcaaagtgctgagattacaggcgtgagctgtcatgcctggccacttttttttttttaaatgaaattttaaactcttataggacctctgatacctccagaatggcttgaaaatcatgtctaaagggacctccacccaagtcagtaactgagaattaaataacctatgaggcaggagacagggagagacccactctaaggattttgtttctgagtgattttcatgttcctaacattcttttgtcatagttaaaacccaggaagctctaaaagggctgtttcccaccccatcctcgcccccaaacgtggtcaggcattttgtgttagattcactagcactacacaagaaaaaggtggtttatattcaccaaactctaaagcttgtccctgggaagtgtaatttagggaatggggttaggatagtttcactttcgtccaatcctgtctatattgcttgagttttccaaatgaatgtcaattacagtgtactttggtcatctaaaaagctatacaaaaccaaaaactaagcatagcaccagtttttttttaagctcactctgaagctgtttgtggggacctcttacagtatggtgactctaggctgtcat

SEQ ID NO: 93142 - DNA, 1452 bp, Homo sapiens
agcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacat

SEQ ID NO: 93143 - DNA, 2016 bp, Homo sapiens
gactgttaactgtgtttactgttcttgaactttaagaaaatcttcgtcttcaacggaattgatgtatttgttacatcttgagagtttctcccgctacctgcaaatcttgaaaggcactcttagtgcagaggaccgggtgtaactactgaccccatgtggacaccctctctggggaggcagagtggctggaagggcccttcccaggactcccttgtggggaagagggaggatgctgtaccttcctcaaggacacggggtctttgggacaaataagaattcttacaattcaaattgcttcagagagggagaatgtcattcttgttagcgaattatcagaattacacatgtagaaaaacaacacgcagggcaccaggaaggtcccccagagtatccttatgaaagaaggaggttcttgctagaacaagaaaattcaggacccctctaagagcagaaagcagaaaaggccctagaatgtacgcctaagacttggagaactgttaacatgaccctatgacctcagtctctccaagctgatacataaaactttccatcatagccaaggtatcaaaggccatctgacttggagagccacattagaaatccttcgataaaaataaaggagaaaggctagggcatttggtaaagcaccatatagcttataggatcactggaaccctgaattagaaaaggaaggtgggaaataaaaccatctggtagagacagagcttaatctgactggggagtggctgggtacttagagccctctgggaggcctgacaccagaggatgatgaccagtggggacagggacagatgggtccaggcccctccccagccagttttggctctttgaggagctcagaagcctgcagctctctcctggagcgctgctggtttatcggaaccgccggattggagaagcactgctactgctcctttcctctctggataatactgatctctgtcgtgtttcttctttggtctcgtgagctcattgtcattctggactacccctttccagcatcccttgcttgctcagtggtgtcaccttcttgggcctcagattcctcgtgaccttgaccctggagctcatttcagcccctttcttttcatcttctcctcctggatattcagctcatcatccacttctgccatttctttctttatcttttatcttcccttgtttccttccataaataccttaatctaaacttgtactcactcatgcctgggttatgtaacaacctcctgtatcctaacttcaagaaacagttttcccagcacacacttgtcatgaaacacctactgttgtgattgtttatcaggcccaggtgttggggttgttttgcttcccgtctgtgctgtgttcgggctccattccaggccactgttggttctctcccagaaccccttctttcagaaggcaactctggatgccttccctggtgcccaagcccttattctttcaatcagcaaagatatgctgagtgcctgtgaggtgccaagtactgcctgttttcatctgattattattttactaagtgttttgttagcatttatatactttttgcattgtgcaataataactttttcaatttgtgttatatattacatactatttattggttggttgtctgttttctagtcctttaatcctgcctttgagaaagggtaataatttaggatatgttcactgtaagagatactatgtgtgtccaaacagctaacatgcagtgggttgggctgactctgttactaacatagatcttggcttcttttcccagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgc

SEQ ID NO: 93144 - DNA, 1199 bp, Homo sapiens
gtgtgaacccagatctgtctgactccagagcctgtgctcttttccattgtatcacactgaggctctgagtttggagttctaaagttggtgtgcagacccgagagtcagggaagctctgcctagcaccctgggggaagccagctttgggatgtgatttataaatggctgtacccattgctgacacttatgtcattttggccttaagttcttttgaattgctcactcaccttcctaattcttcctaagaagaactttatataattgatgttcttttaaggtctactataattaaagactgattgcctctagggagtggaactggaggtgggacggggtggggcaggaggctgttgttttccattgtaagtccttctatgctaatacatttttagaatgacattactttgattctataaaaaaccctctaatgaccagtagaaacagatacaatagcaaacactaagaatacacaaaagaacacactttgccaggttaatgactgtgagatacattcttataacatcacaaaaactacgttttgtgtatctgtccttttatttgaaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaaggtaacccctctggaaatggtgtgttcagatttctagggaaagagtggagctttgagtgttgggaaacaaaaagaaaagaaaaattccttattgtgtaatatggaaatcaataacctttcaaaacataatgtccctaagacaaaaacaaaacaacacagcagcctaaaacctgctatatcaaaatttgtatacatttttttttttctggtgccatacatggggaaggatgttggtgactgagtgggagcaatggttcctaataatcagactctgacccgactggagtaggggcattaattaggtgatgtggactatggaaaggtgtgaaaagcagactatggccccaagggtatggcagatgtcatgaagccaactttcacagaactgagtaacagctgttttcccaagggatcaggtgggacattgcagcagcaggcactagtcctgttgccatagaatatcagtctaca

SEQ ID NO: 93145 - DNA, 1050 bp, Homo sapiens
ttgggcaagtttggggaatgagagattccccagtttgaaggtcaggagctagtgggaggataagactgggaaggttggtggaggactgatcagaaacttttaacatcatttgagaaagttggaactttggagaatagtttaagaaggaagaagttgaggggtttcctgtgtgcatattgaatttgagattccaacaggacattcagctggaagaatgttgtgctaattagaaatgcaggtctggaacctcagaggagagggctcatcttggagattctcacagttgaaactgtacaagtggttgatgttgctgatttgggaggaaggattcaaaacgaaaggaagaaggcataggacaggatttgggggattttggtggtaagctggagtgggagcaatagagagaaggggagttggtgaaagagaatttaagagcctagggaatgtgatgtatgggagccaaggcagtgagagttttagaaaagaagagagagcccgtcgttaactgctgtagaagggccaaggaccatgagtactgagggaaaggactggtgggcttcatcatcttcagttctttctgattttgttggttttaactttaggggatagcttcttaggtttctgtaaacaaataggagcacttaatatccttggtccagatatctgcctatgcccagaaaccctacccgatgtgtataacatgttttcatttcttactacatagcttgtgtgggtctgagtacatttgggaattttgtgaaaagaacatataatatatgggctctgtcaggattctttctggaactttgtcccggaaaccccatgtgtcaatgctgctccttaacttctctctggccctaatgtttgagtatgcccatatttcatgctgcctcttcccacatttggaatgaagcccagagaatgaatgcaaggaaggaaggggaaggtgttaaatagacattgtttttcaggcaccatgctaagtactttgcctgcattatctcatttaaccatcataataaccctgtgaagtaagtagtattatcccca

SEQ ID NO: 93146 - DNA, 1042 bp, Homo sapiens
aaaaataaataaaaataaaaatgaaattcacattcttttttttttcttttccctgagacagagtttcgctcttgtcgctcaggctggagtgcagtggcgcgatcttggctcactgcaacctcagcttgctgcaacttccgcctcccgggtttaagcgattctcctgcctcagcctcccaagtagctgggattacaggcacatgtcaccacgcccagctaatttttgtattcttagtagagacagggtttcaccatgttggccaggctggtctcaaactcctgacctcgtgatccgtccacctcggcctcccaaagtgttcggattacaggtgtgagccaccgcgtccagcctgaaatttacctttctttctagttttcttttcctctttcctgcttcaaagcataggatttcatcagtgatatagtaggacatcctatttaagatagttttgttctgaattcatataagtagctagtttatttatctaagatgtgagaattaccatattatgccaaaggaccatggtatagtcaacagactattttgtttctggcagaaatttttttggaagagatgtttgtcccatgatgagtcaggaggatataattgacagaaacctatttcaaaccaacttaagcaaaataaaagaaaatggatattaatcagttcacataatctagcaacaaggatgcagctgggcctcagagatggctggaatcatagggaatatagataggtcatttcactacatctctctccctctctacctgttggcctggaataacttttaaacattcatctttgtgtttttcttttgtgtttgaattatttatttttcttttttttttttttttgagacggagtcttactcagtcgcccaggttggagtgcagtggcgtgatctcggctcactgcaagctccacctcccgggttcatgccattctcctgcctcagcctcctgagtagctgggactacaggtgcccaccaccacgcccggctaattttttttatttttttagtagggacggggtttcactat

SEQ ID NO: 93147 - DNA, 1698 bp, Homo sapiens
ttctcctgcctcagcttcccgagtagctgggattacagatgcctgccaccatgcccggctgatttttgtatttttgtagagacggggtttcgccatgttggccaggctaatcttgaactcctgacctcaggtgatccacccgccttggcctctgaaagtgctgagatgacaggcgtgagccaccgcgccccgccacttttgtcttttgaaaatgctttttcatagtgatgaatggaggaaccataatgaagaaatatacttattctgtatgtgttctcactatgtatttactaaatgcctgtattttttacctttttagagctgtattataaagcgatactgtgagaaaagattcgtgtctaaatacctggcaacaattggaattgactatggagtcacaaagtaagtatattgtttccctgggtttgtaagttacatagaagttcagaactttccaaaatgatccatatttgcatcagtgctcttgtgtaggtaatcttgaaatggagactttgaagataagttgggaaagataggaatagtagacctttacaggtatctagtgatcatatcattcattcagcctgtgtattggtattgagcacatcccattcaccaggcctcgtgttaggtgtaggctacagcaatgaacatgtcaacacaaagcctaaatggcaggtgtaactttccaggaaacatgtttttatattagcaggtccttccagcaggtgtgtttttagagcattttgaaatattctctctaaaaagtctataaatattgtgtggaacattttctaccagagaagtttttttattggtttatgatcttcatagctattagaatccagcaaaaatgggccagatgcagtggcttatacctgtaatcccagcacgttgggaggccgagacgggcggataacgaggtcaggagttcaagaccagcctgaccaacacagtgaaaccctgtctctaagaaaaatgcaaaaattagccgggtgtggtggcacacacctgtagtcccagctactcaggatgctgaggcaggagaatcacttgaacccgggaggcagaggttgcagtgagctgagactgtgccattgcactccagcctgggcgacagtgagacttcatcacaaaaaaagaaaaaaaaaatgaattgggaaaagtaaagttgggtccaattggggatttatctggagatgagtcaggagggggttgagcttgaagagttggatataattagcaggaaatacccatacagtagaattggggtagatagcatactccttaaacatgaaatttcaggtgttcactatcttggccccactctggcctttccccttttgtcttttctgttacacactttactttccatccatgctgaactgctaccctcagactttctacctcagcaccattatccagcctgtccacttggaacagccctgcccatttctccaagatataaacattctcctgttcccgtaaggtcttctaaacatgccctttattggtcaggactctttttggttgcaaatgacagaaatcctaaagttgtctatggtatttatggtacttaccaaaaattgccttgtattgttattatttgtatatgtgtaatgtctcctgctagattataaactccctgaaaatttattagtataaattttctccaagtgcctggcatagtgcttatac

SEQ ID NO: 93148 - DNA, 1024 bp, Homo sapiens
ggcggggcgcaggggcggggcggggcgaggggctcgcagaggcctcgggttggccgagccgggagggaggagcattagtattagcatagcccccgccccctgcgcgcagcagtgcccagcaacccgagcggaggcggccgctgcagcccggcgctgaatgggctggcggcgcccggctccgtcctgcccgcggccggcccccgcgtctgctccctccccgcccgggcccctgtcggccgccgccagtccccgccccgactgtgaatgaaaggcgggcgccgccgagggctggctgggaacgccgcagcgacgccggcctctcgagaggcgcgcgccccgccgagatgtacggtaaggagggctccgcgcccgggcccgggcccgcgggggcgactccgcaaacttccccggcgcggaccattgtccccctgcacggccctggcgcggggccaggccgctgacctggtgcccggcggggctgttgcggtcgctctgtgcgcgcgcgtctgcgctgcgaggacaaagatgcctcgggccggggaccctggggtcctctccaggcccggcgcgtgccggtgctgggcggtggtccttcggggggcggaggctcaggggaaagcgggtctcccggagccgagcagaccgggagtgctggaggaggtggtcgtgtggcagcatttgcggaattaacaaaagcggtttgtgcctgggagttttctgtgggaagccggtccagggctgagggagacgcccgcggccggtcgtctgcgcggctcggagaaggcgggaggcggcgccggcggcgcagaggcccggggagcagccagtggccgagtctcgtctcgcccgcctgaatggactcggcctctgcctgcccctgccgccccgcgggatccaggttcaccaacttccagattttccctccgcagtgatgaagggaggagacgctgctgagagggtgcagcacagccctgacctctccccgcctccaccgccatcccctcaactgccgtgcaacagttag

SEQ ID NO: 93149 - DNA, 1021 bp, Homo sapiens
gtcctcgggtagggtctcactctgtcactcaggctggagtatggtggtatgcagtgcaaggtatgatcactgctcactgtagccttgacctcccagtctcaagcgatcctcccacctcagcctcccaagtagctgggactacaggcatgcgccaccatgcctggctgattttatttttatgtttagagatgaggtctcactttgttgccctggctggtctcaaactcctgggctcaagtgatcctcccacctcgacctcccaaagtgttgagattacaggtgtgagccaccatgcttggccttggatttagatgtcttaatagcgattggtacttcacatccaagaataaaataaagataaaggacattaagggctatcgttgctccaacattccattttattctaccctgccttttttctcctaagttgggaaaaagattttaataataattatcatagtaatactgatgatgatgatgatgaaagctaacaattactgagttcttactgtgtgctaggaatagttgtaagaacttcactctgttaacttatctagtcttcaccacaaccctattaagtagattcccttccttccattttgcggataagtagaccaaggcacacaagattgtacagctttgccaaagctgaagctgggtttgaaaccaggctttctatttccccaaaatggttgggataaaattttcctgctgttagtggtcccgagagacagagaatggaaaaacattctgttcattttcatctattctttgcttgaagagcatatcaaagcccaaagaagcctgtagttcatgaagaattgaagccctgacattaaatcaatcagacacgtttctctccttttaaatccccatcctcaattaaggtggcaatcagattaaccaagattggccggaaacgggtgagtgtctcggaagctctagagctccaaaaggtcaggccactgacagctactgatttgtgtgttacttcaggcaagtctcacccacactatctccc

SEQ ID NO: 93150 - DNA, 1066 bp, Homo sapiens
tgaaatggaatggggagaaaggcccacgttgctgtcccacctgggctatctgtgcactaggctagttaggtcggttgatcccaggctactagagctagactcgggtcgacgggggcgggggcgggggcgggggcgggggcggggcgtggggtggggcgtggggtggggtggggttcgtatgccatctggtggctgtttctggaatagcatctcactgacaagctgctgtggtctctgggctgggagtcctccggctcctgttctgtccagatgtgggcccactccctgtgacttgagtatcattgactcttgcctgagccaaccactgtgcctttccttttccctccctctctttcctctcctttcttccacttctgttttgttttttgcctccctttcctatcttcatctcccatctccttttccttctgaagtcttaggtgcatcaagacacacatgttctacacctcacctggcccatggggctcagagcatccttcccacagtggtacatctggaaatctttaaggatttccagaaaaagaactttatcttttcttctccggtcttcccccacttcccccagtgggggcttctttacccccatttaatttctgacagctgtgacgcctcccctattgcctagtgcaacccatgtcaaattcctgcttgtcttgtgtggatgaaacacggaaagccgggattgtacagagcctgaccccagcctgcatgccaccctctacccatgtgcctctgtctccccagccggtctccctcacccctccaagcacctgagaaggagaaagagagccccgcggagctggctgagaggtgtcttcgggagctgctgggccgggctgcctttggcaacatcaaaaacgccatcaagcctgttctcatgtgagtgcccccacccactgccttggccccagccttcagcctggatgtgtttcaggtccctggcatctcctggctggctggggggaaggggatattacagttgtggtgccgcagccgagtcgatcccttccctgtgcctgtgttccctgcactgtgacagcaaaag

SEQ ID NO: 93151 - DNA, 1070 bp, Homo sapiens
tgagtgagggcagggcccaggcatggaggctcctgcacccccaaggctttttggctgtgctttatggcctctggcttatactcaacccaattttacaagcatgaacttagacttctctttagtatttatatatttaaaaaccaagtttaaattaactcaaacttgacagcaactaacctctgaaagaaactttaaagaaaattgaaatcttgagccacaaacatgttctttcctcactagctcctcccaggttttatcctgcacccagcttggatgagagacccactgtttcttgtgcctacttaacattagggttccccgtggcagcttcatcctgagcactgcctgtgagccctggttctgggacttggcagtcgcctccctggagcatctttccagagccagcattagaacctgagatccccagatgtttctgcccctcatccccatcctgtgaatagagagacagaaaaggtgcaggttcccattctgcatagattctgctgtttcctctccaccggtcccaggcagcttttcctttccatcactgccgcttagcaaaaatgtgcttcttttgaagaactggtcattttttttgagtgccctcttctcagttttgtttaaacttacactcagtagagtgttgggttgtctgctgacatggagtagaacctggattctggccaaataggccagaatcggaaaggtgaaggtgagtgtgatagtaggtaatctcctcaccccagcacaggccctgggagagaggcaaagcagtttgatgggatctggaggggagggaggtaccctggcccttggtctagcatcagtgagtcctgcccttccaagcccctggaggctagtggcattgcattgtgcccctttttgccacccttctctgatgtgattttgagcgaagaggagtcagtaagcccattgagaccggctgctcccaaagcccgaggactctagctgtgtggggaagggctagcattggtcaggactctgctgacagcactgagtaggcaggaatgtatttgagatttggaagtactgttaatttggtggagtca

SEQ ID NO: 93152 - DNA, 3945 bp, Homo sapiens
cctggaccccaatctactgtctcctcgacagattggtgtttaagatcatgcccagttgcttcctgtcacctcttgacaggtggtgactgggctgctgtggggctggagcagcgaggaagggagcctctgccccctcagtggagtccctgtgctaactgtggtgctcacccagctcctccttgctcccgcggggctctgtccttcgggcctggagtccaccagcgccactccaggagggctgggggaggaggggctgcctcaggcagtccaaggtgctccctcccccgctggccaatgctaaggtcttcccggctcccagggtcaggacagagtcttctaaggctcaggctctcccaagccactgcttagtgacagttagcctttcccagcggcccaagctccaccggaactgggcctggtgctccaaccaaagggttggtgttgggacttgggaagagacttggtagccaagggcatggcaagcctgggggattcctgtgggccggcttgctcgaggagggagtgctgggcacagaggagcccttatggctgacagcttgagagcacttgttcctccagatctagccacttgaccaggccctagaatggaccagatgccccaggggtcatggcccccccccccccccccttgcagggacgagagttaacaatcaccagcttttcttccggcccagcctgtgtgcttggtctcacagtagaatttaggagagtgtggggctttgggattgtgccaacttggccaagctgagatatgcttaatccacctcaacgctggggcctctggggacaggtattgggtcaccttccaaggggtgctgaacttcagcaggctgtagataaggcagaggttagaggcagtggagtgggggaaccaagaaggcctagggaaaattgccaggcatattccctgtggaattttctttccgaagagtaggcccatttcccccttagaaacaagggttctgggggctgatgacagcttcccctgcaggtgccaggtggcgcatgatgccaaagagatccgtggctcttgcctgggggaggtagccaggtgctcgtgctggggacacagtccttggcctcctgcctaagcaggaagctagtttccagcaggcggctggtactaaccccccgccccacgggagcgacaggctggtgcaccggcagactggggggccgcaggcgggcactagcaggggtctgcagtccatagatgatgacatgaatctgttgctgtccttttgtctctaggccccagagacttcttgctattgaacatcctattggaaagcaaactttccaagagagcacccgggacctgttagcttttgaaacaggcctgggtgtgattgactggtagagatgcctgtgtgatttttggcgcattgcaggagtgtggattgggacaggcaccccagcaggaaggaaggctgacaccaaaggggtctcacagggcccagctccccttgcttcccgataattggccaccaggccatggcgactctggggaagcctagatgggaacacccaccttctccagcagtagaaggaatatttcagcagagccatctgggagatgttcttataggaaaactgcagtcattcatttcatagttttgcttatataaatagagtacatttgggaggcagttttgaattcctgttgctactctgcttggtgcggagttgcagtggccccaagtgtctttcagagctgttgcttttaggatccccctcaagctgtgggttagggccagggcagggagggggtgctgcctggcactgtgccctgaagagggctgcttgcttcctttggtcgggagcacggcagagccaacattctggtgggaaccgagtttctagccaggcccctgttttggtcccgggaggtgagtaatctgagtttgtcattgcgtattctccacgctgcctgctctcagtgctggagactagagagcgaccctggagttgtcctctgggagtcctgcctgtttgccagggagcagctgaaacctccccgctcccaatcccgggggtggaaaaggtgtagtggaggaatggtctggagctgggatggcccttctggccatgccctgctgagccaggattaaggaaagtgtcagccgcctccttaccaggccctgtgctggggtcaggaggaccgggaggagagggaaggggtgagaggatggactctgctgttgtagtgtgagctctggaatctttacgttttggtaaaggcaggccagggtctttgaggatcgagttggggaaccttgcctctgtgtttccgagacccagctaaggtgggcctttggtgggtgacctgtctctgacccgaggcagcagagttttgggggagggagaaacaagcaaggagcagggaggacaaggacacaagatccctttgctggtggtgacttactcacttcccccaccagagggcctgggactcccgaaactcccgtaactggaaagctccctggctcagctccactggggggtgaggagggcggctccctcagccccagcctagcggcctccaaccctgtgcctgagaacatgagcagcggtctaaagcatcccctagtcccatttcacttcacagaccgatttggttgcacagccctagaattcaacagacaacaaaaatgctgaaattccttagaatacgcagagggaggaggtgactcaccaaggtgctaaaacattttattaaaaatatatattgttaaattaagtctgctgtctggacaatgactgtttgttttgttttcttgtagtggagtttaaaagagactattattttactctgatatattattattaaaaaggcattttaactttgtacttgaaaactaaatgagcgatttcatgtgttttagctgaggcattgaagtagcgggtgcttacttatttgtgggaaatcatgtattcatactgaagaataaactccgtagctgatttggtaataacttttactgttacagacgatttcgctttgaccccggtggcagagcacttttactccacattccacgcagctaaatgcaggacttcccagactcttccctccccagccctctttcctttctcttaagttcctcttttctcctttattattattatttttttttcctggttccagcatcctttcaccactgtattttttttttttttttttttttttttttttttttttttttttttttttttttagggttgcttctctatttattgacaataataatgtacatttcacagtctggttctaggacattcagggaagggcgagtgggggcccgaggggtccctgccccacccgcctggtgtcctgttgtatctctgtgtaagtgatgctcgtgacatagctgtttatgaaataattaaagaggtcaatgcgtacaacagatgtagaaagtctgtcagttccgccttcatcacatttttttttgtgcccagaagaatataataaagctcctttctaatgtacttgtgctggagaacacttgaataaatggactgtttttgtgcaaaaagaaaaatggaaaagcaccgtaataatgtcgttttgtcttgcgtctcctttccctgccatgactgttcacagcctcctccagggggctcaagtacctaagcggggaggtgctagcgtcgggcccagatgatgtagggcctccctaaaaaacgtcacctgtgtgagcatcaaattagtaaatgggagctgtcccctgggtgcaggaaagagtttggttgactggaagctgaaaaataagttatggtgagacagggttgctgggaaagcaaattcagctctgggctgagcaacagaagttttcataccagagcagggagaagagcgcgccttatgccaatgccttggtcagacacggcgcgaggaggatttttgaacctaggtactca

SEQ ID NO: 93153 - DNA, 1297 bp, Homo sapiens
atccagagtgtgggaaagtgacagtcaaaaccccacctggagcaaataaaaaaacatacaaaacgtactggtgctttcctgtctaagtcgccttttgtgtgttcttttatgaggcccccaccatccacccctctgtgcacaaggcggctcccggcccctggaatgtgatgtttttggtcatctccaaaggctgcagttttatactgggaggctgatgacaccttttattataattattcttatggttctggttataattatgtttgttttaagattttctttaagaaaacaaaaacccaacacccttccctttaggtttcaaaccaaggtgcgggagcagggtgcttctgagttagcggtggctctggtgccctggctcccacccctcgggccaggtgggccactgggcatggtgacagctgggcggccagggagtccccaaggtctgccttctgggcttgtcactcttctcttctacttcccctcctcttgagtcgggtgtgtcagggctggagggaggaccggccgtctctctccttgtgtgtgtgattggagtggtgtgtatttcttttctagtacttggtctgatgatagctgtgctcttacctcgagtcagcagcacctggagccccaagtgctcaacactttgttctacttcctacaaggcaggcggcctggcgtcagtagtaggaagggatggcattgttggctccagggtgagggcccgacgggcaggtgcttgcctgggtagatggggtgtagatatgtggcatatagagatatatattttataatgggaggggggatggcacctcctgggactggtagagctgggaggtgtgtcggcaagcacatggccccaagtccacgtccctagaaagatggggcctacagtgataggcgctctataaatacatagatagggtcatgtttaagaaatattatggggtggggagtgggggaagcaggcttagtgtgctgagcctcggtccccactgcagacctaaaccccacaccaatcagtcaatctcacacgcatacacaggagcatatttctgtactgatgcataatgaatgcactcacacacacacacacacgccagggggctcccagcactcttctcccagggttcaggactttgtggagtcagcccgtgcagctatttacctctgttgccctgattgcaggtagactgtcaatcccagaagttgctaggtgctgaggcaggaaaaggaggaggtttcttttagcaggtgctctcctctagcaggtagtgttctatctcttttgcccctg

SEQ ID NO: 93154 - DNA, 1706 bp, Homo sapiens
ttccctgctcttgatggggaggatgctagggctacgtgttcgttacatgcagactccaggtgtacgttgccgagctaaccctgcaggagaggagaactagagagtgtgtcctggaggtatttctgagggattgttcaaaattactcttatttctgctgggttgtgaaactctaggcagtgatgaccttactacctttaaggtcacagaaaccagcacagtgcctggcacatggttggtgatctgagtgccgggttgtttataaaggacagaagattcggcagaactaagcaggcgtcagaggagttggtgggtgtgagtgcccctgtccctgcacttcgggtggctgctggtcctccgggtcctgctgtgtggttagacggcttccgggcagcctggtctggccagcactcaccctgccctctctgccttttctcccccagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataacccttt

SEQ ID NO: 93155 - DNA, 1007 bp, Homo sapiens
ctaccgcctcctgcatgatgcgcggcccaaggagggagatgatcgccccttcttctggctctttgagaatgtggtggccatgggcgttagtgacaagagggacatctcgcgatttctcgaggtatagccagcaaccttggtttggccagctcactaatggcttctaccttggactgctgcttcatcctgtctcatctgcattgtggagctggggactggtgacttctgctttgcaaggggcctgtttgggaagccccaggcttcctggatagaaagggaggaagcagggttagaggcctacctcggaaagaaccagtggtctcactctaagaggtggcattgtgggtgtggacctccggggttgaaggacctgtcactcaatcaggtggggtgccagactcctggggttgggtattctgtatggtgtttgttacacaccaggatctttgagaggacaaaatcagttttccctgagcaagaagggcctatcctcactccctggtaccatgacaggcacctgagaagaaaacaagacttagctcagttttcattccttatcatgtgagtccccgtttaaccctgagccaagtctgagccgcgtgcagagggcttctgctgccagaggcgtgcttggagtggcccttctgggagcttgagcccacctgtgctcctgagtcttggggtgggtcacactgtgagctggtgttctgactgtaagtgtgagcaggcgtctgtttgagttctaatcagggctcatggtaaacacacccatactcgctggagcctgggctctcccagcctctgggtagtctagagcagcactgtgcaatatggtagccaccagccacatgcggctgtttacattaacattaaccattcagctcctcaatcacattggcctcattttaggtacaaaatagccacctgtactagtgggctagtggccactgaattgaacagtgtagaggacaacccaccatcgcagaagttcatttggacaatgctga

SEQ ID NO: 93156 - DNA, 1078 bp, Homo sapiens
cttgctctcatttttctcctctgaaagattctttacctctctcaagccccattttagtccccagatgtggggatgggagcagagcagcggggacaagctcaggcagagtgtagcagggttgccgtgccctggggagcccaggagaaaaacccagggctgcaggaaggcccaaggtggtggtgcagccccctccctggccttgttctcaggctgctctttggttctgtccatggcggtgcacaggcagatgaggtttccccttcccagatctgcagctggggcctgaccctggctaaggtggtggcggggtcatgtcttcagggcttaggctctgtgaggccaggtgtggagcctcccttcgtcctggccgtcctgggacccgtcctggtggtttctgacccttcccgctgctgtctagaactgctttctggagtgtgcgtaccagtacgacgacgacggctaccagtcctactgcaccatctgctgtgggggccgtgaggtgctcatgtgcggaaacaacaactgctgcaggtgaggctgttgtggcctccagtggtctccttagctgggccccaggctcccgccgcccaccgcctcccctcctctcccttccccacagaccctccaccccctagccatgctccagacccggtctttccattccaggtagcacaccttggcctccccggaccagggctgagagtctcctctgctcactgggtctccttccaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgtgagtgctgggcctggggcgcggtctcgagctcccttggctgagccttggttgtggggcctgagctgtgcgcagggtgtgtgggtctaggagcctggctggagggccagcgctgggtgggagcttgggacaccgctgggcctgcatctgacctgttgtgct

SEQ ID NO: 93157 - DNA, 2132 bp, Homo sapiens
cagcccctgccagttgcaaggcatggggtgggtgcttgcaagtgtaagcctcggcaaacaaggcctggcttgtccccccaggtgtgtgttgagaagctgatgccgctgagctcgttttgcagtgcgttccaccaggccacgtacaacaagcagcccatgtaccgcaaagccatctacgaggtcctgcaggtgagtgtccctgctgggagctcggaggaggagcctagagcactaggaggcctggaagttggagtgcaggtcgggcttgagcagaacggaggcccaggaggcagcgactcctttctctccacctcgctcgcccgtatgcacatcccgctcctcctcagcggttcctccccatcttgcctgtgccaccctcactactcagagtctggccttgagcctgacccatctgccttccagcctgtcctgacaaccccaaccctggcgtgtcaccctccaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaaggtaaatgagggcacccagctttctgggacccctgcccgccaggcagatccacaccagggctgggaaagccatgcttagggagggctgccaaggcctccacagaggggcccagtgggaacagccggggtctctcttgccctggggtcaggacttgaatgacctgctctctgttggttggctagaaccgtagagttgggaggtgggaacaagttggagaccaggccgcaccccactgtaaggagggtgggggaaggggctggagtttcctgtcagcctgtaactgaccttggcacctgctttcctcctccagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagaggtagttggcctgcttctggagagggtggcaccaggaggcctgcatccgaggagcaggcgcggcctcctctgacgccagctctcctccccttgcagagcggctggtgtacgaggtgcggcagaagtgccggaacattgagggtaagtttgttgcctgggaactctggcactcctagtgtggcatggggcagagtagcagaggcacttaggaaggtttgaatgacatgggaccaggggccacgtcctgcgtgtcacaccaccttcaccgtgcttcgtgcactgtctgtctttctggtgccatgattctgctctcctgtcaatggcgtgggctggtcttcagggtgtgggactccccagtggccacagaagggcagcccctcttgggtgtgactgaactcacctacaggtcccctttcagcctttcacctttgctcacctctctcatcctggggctgtcgccctcagcctggtgctggtggatctggctcaggaccctcggcctgggaggattggggcaggggtcaggacttgaggattaccccgggaatccctcctgagtaacctggaaccagggctgcttctcatgagcaggtttctgtcctgctgtcactccatccctgtttgtggatggtggcattggtgctctgagatgatggcgttcgagactggggtcacagtgcctcccttttccgtggggcaccctggactcttttctggctgccgctctggcacaccccttttttgtggctggtctggtgctgggctccggcccggggagggagaggcccttcggtggtactcaccccatcccctccctctgctttccagacatctgcatctcctgtgggagcctcaatgttaccctggaacaccccctcttcgttggaggaatgtgccaaaactgcaaggtaggagcacacccacccaggagaggtgccgttgaggccggcccttcggccttctggctgactgtgtccaccgcttctgggcatgtacagggtgacacccggtgtgcgtgtgatgtagacttcagagcttcctctggaagcagag

SEQ ID NO: 93158 - DNA, 1499 bp, Homo sapiens
atatggcgaaaccccatctctactaaaaatacaaaaattagccaggtgtggtggtacatgcctgtaatcccagctactcgggaggctgagacaggcgaatcgcttgaacctgggaggtggaggttgcagtgagccgagattgcgccactgcactccagcctgggtgaaagagtgactctgtctccaaaaaaaaaaataaataaataacatttccgtatcatagggtaggcaaccgatatgctgatgagattgaggaagattagatctgggaggaaggtttcctaaaaggcagaaaagaaggctggaattgtgtgacttgagttcacctctctacttcaagtctttccatttttcacggcaaggcagctggttggctctctccagcccttgaccttctgtcactgttccgggttttgacaaacatggtccccttgagtgtcaggtggccttgctaattcctggagaggtcaaggtgactttttgttttttgtttccccaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggtgagcggcttcttcaccagccgtggccagctctttccgggggccttccactgccagctcctcccgtcctgctctcctctctccatctcccacgggccgctcgctctctccacctgaccccgggcctcttcgtctccccgattttgctctgtcttgcctcattcagatggagctccctcctggctgtcctgccccccagatgcccagggctggggttgccatggggggatcagggtggcagggcctcgtgaccactgtgtaatgatttctgctccttggggctccaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtaagttgtggggtttggcagtagcctggggtgggggaaggttcttgatcccagggcctgtggttttggctgggggcagtctggaattggggtgatggaagtgggttctgctcacccctactctgcctgtggtgggtggaagaagctgtagggataattaggttgcacctgtggctcagagagctaggatgctggcccagttttagccttccaggaacctattcactagaattcctttccacctgcactcaggtacttccctactcttggtctggactcctctttgcatcgggtaattatttatcactgtatctggtcccctccagggctgagactga

SEQ ID NO: 93159 - DNA, 1060 bp, Homo sapiens
aaaggactgctccaaagtcagctgctggttgtgaggctccgacaggaatgtagaggctgcaacttcagattagagctcttcttcatactccaggttgcttgctcatcctctttacccttgaggatgggtttgcattcgcagctctaggcccatgggggagctcttttgaaaggcatgtagaaaatggggttttctcccctctaaatctggtatggtggaaatgggtgcaaagccttgaagtcagagggccgtgtttcctagattcagtaaaaggctaatggttctcagagctaagtatcaaggatttcattctcctttgtagggatcctggagcgggttgtgagaaggaatgggcgcgtggatcgtagcctgaaagacgagtgtgatacggtgaaaggatggaggctgtgcaatgggagaataactggggtttggcttattaatttgttggtgggatggcagagagcacgcctggtctatagtgcctgctcagtaaataactgaatgaatacatgtatttatggatctgaagggtgcacatagaaggggtcgaatctggtaacaatacacactgggtgtgatccataagaactccagcatggcgtctgagcatgggaacagacaggctcttggggagcttcctatggtgtttgagcatgtgctggggggagatgggctctttaaacccagagcagtgatttcttcgtcagcagacatcacaaaactagaattgtggcctggaaaccaggaataggaaggattgattgcccaggggaattgtggagaagaagagagggtcccccttgctttttaaatttttggtgacagggtcttgctatgttgcccaggctggtcttgaactcctgggctcaagtgatcctccctgctcagtaactgggattacaggcacatgcctggctgaagatcctagtcttgattaagaagataggagagggtggaaccaatatctgtgtctaaacaatagtgcctgattaatatttggatagaattaacatctccataggtagggggagggatagcattaggagatatacggtat

SEQ ID NO: 93160 - DNA, 2654 bp, Homo sapiens
aggccgtccgaaagctccggcttgctttcgcccggacccccggctccctccgggcaggcggctcgggagcagccccttccctcccctcccggccccccggccccgcgctaatctcttccagagctgggggaggggccaggcggtcttcccgaaggcggggcgctccctgcagcccggcctgggcgggccctgggaacgggcggggaacggcctcgccccccggccccgcgcccctcggaccggagaagaggggctggcccagcgccagcgtcggagcgccggccccctccccgggccgctcgcagccaaccaggccctccagcggggcccacgtgacctggagtcctagacaaagaaaatgttccctccctcccccccgccgcccccctcccctcccagtggccccctccgcccccagccccatcgcccccttcccctcccccaagacgggcagctacttccagagcttcagggccgcggctcacacctgagcgcgactgcagaggggctgcacctggccttatgggtaggttcctggacggagccccggggagaccgggggcggggaggcggcagggccggtgggaggatctccgcagccctccgggtttgaaaagagtgaagtatgcctccccggcccgcagcagccgcggcgtcccggcctggcccgagttctggagatgctgacttagtgctggcccgccgccttcctgcccacgagccccaaggccccactcctcgagggctccagtggcacctggcgccctcgggggacaggaagagcagccggccgggagcccgggcagtggtaactgcaggctggggcacgcggagctggtggcccaggagttgggttggaggcagcttcagctgagctggcagatgggtgcctggcacttccctggtgacctgcgtttctggctgggggaccacgcggtcctcagggccctgccagcttgcggcctcttaagagggacagcttcctctcctgcgagttcctggaagcctccaggcaggccgccagaaagaagtggtggggggcgggagagcacggtgcgaccctgacagggggccggcctgtgacaccagggtagcccaaggccgcatgggcttgggggcggtggcgctcagacctctgacctttggaatgggaagcgctgcagtcgcagggggaggtggaggcgggacaactgcctgaggagatgggactggaccggaggcagtagtcaccggagttcccggtggctttcccagtctggacggactccaggcccaggggcttccgtgagccagcagggagtggggaatagtgtggtgtctcttgaatgccgcctggtttctccgcccccctgggggtgagcagcccgcagcccaaatgcgagagcctcgagttcacccctgtttctcttattgtttgcctggggaggaaggcaggagtgcagagggaaaggggtgctttccctacgccccagacaggcctagtctagtgaggcccctcccccacccagctccggctgccccttcccctttcgtcaggccccctgctgctcacccacccccccccccgcttcttccttcccccaccccactgccccagtcctgatggaggccccttcctcctccgccagcccttaccgggccgggtgcgtgttctgcaccaagtgggctggggatgctgaacagctcgcagcgcggcatctgacaagctgggggaagttgtgggggaagaagaatgttcaggaactcgctgtgaaggggctgagagacaaaggggccgtgggggagtgctgagggtggtgtcaggcacgactcctagacctggggagccagaggaggagcccagcccacctgctgctgccgctgccaggaactgatagcgggtcctttccccttcccgcccactgctacctgcacacctcgtactggctcaggggcctcgccacgcctggaaacggggtctttggatcatccgaggcatcaccctaggtcagccacccatgcctgaagcttgagaaggcgtggtgggcgaggagcagcggcgtggtgtgggctcctctgcgagggtagctgacgcagctgaggatcccagcaagggaggcaccctcccccatagcggggtccacacttcagtgcaccttctcgtaggggaggaggcgatggctaattgatagtaggaaggggagggcagagttctggccaggtgagagtggggctagggagcgatgagcaattactccacattcttccacccccgcagtccgatccgtgagctcattccgccatccatgagctcattttcccagctgtttgggggttgggggcaaaggatgcattatcctgttttagaatttgttgagtcagaggaagaactaggacttaacatcttcagtgtttttcggaatcgccataagaaacagattggtctgtggcttggaggcaaagacttgaagactcagtgaaattaaatgaatctgtaagacaatacattggaccactgagcttcaaacaaaggttcttaacctgggacccttggatctggggggtccattgacaggctttgggagagtcctgggaatcattggtccatatatacaccagatttttaaacaggtcagaaaagctttccagaaatccttccgttcaggtgccttttt

SEQ ID NO: 93161 - DNA, 1008 bp, Homo sapiens
gctgggacttcccagcatacaccattagggaagtgtagggttggctgggagagaacgagggagccaggggctctgggatagaggtggggagagaaggggaggtgagggtatcagcaagagggaagttgggctttcctttccagcagttgggctcccccatcctgcatcttcctccttgatttagaagaattcatctagagtgtcagtgcaaaaagccccttaccactccccctccctaacagataccctaaggctgtgcttgtgcttttcattcctgccattcatctgccaggaagctcatgcagttacagatgccccctagatctggccattcctgtctgaaaaacctgggaggttgtgcccattcctagtttccgctctttcatcttcccttgagccttcctgccttgactgatcccagctgcctctgagttccttcggcacatgtagaaagcatccctaccacataatttaccatctaattgcatgctgtcttgaatgagggctgtggtttcatgtgtggtgggtcttgggtacacaattaggctgtgagtaacagaggcctagagccccatcatgtctactagctcttgcacctctttgcttcccttccccccagcctacctactgcaggtgctaaggactgactgacctgatccggtgtttaggtgagcttcaggcaggctcccaggataaagcacaattcgcttacaggttctaaaaccagactgctcagtgcaggggttaggggggtgcccctgcccgacagcatttgcccaaatgccgctcctctccccagactcagggaggaggttctggggcagggccgaggtttggggtgatggcatagagcccaaccaggcagcacactgcagttgccatggtgacccttttgcttttcttcaggaggatggatttctcttttagcccaaatcatctgcctgggctactctgagaaccagattcctagccccctaccttccacattctaccacagggggcagcttg

SEQ ID NO: 93162 - DNA, 1043 bp, Homo sapiens
cttagacttcaatgtttctcaaagggtgagattgtgtgttacctcaccagaaccacctgggcagtgcattaaaaaggcacactcctggagcagaagctctgggacagtacttgtaggtttgattttctagccagcccccagatgattctggggcttactacagcttgaaaaccaccaagcctcagatgattagaggtaaaccaaatctggcacagatgagattcccacacagatgtattggtagatgcatttattgtatcgcctgcattggcggcgggggtctctctacacattttgtttaaacctgggccaggttaatcacgttgggaatttagtgatgtacccagcaagggtggtttcccaagctctccgggtaattgatagggcttgggttgccagtctgattgtggtaacaagcaaaggaagaagtagggactgtaaggcgggcagacctagggaacagtttccaaacagggttgggggggaaagaccggaaaggacttggtacaggaatttaaatgtttcctttcggatggagatggcaggggtcctgctgttttcagcaatagttaccgcagtgcctgtctgctgggctcctctggagtcttctctttggaccctgaaacttgagagggtctgcatgcctgaatctgaatgcggctcctttaggcccctccctttgacccctggagcctggagaaggggtgggggaagggtggggaaaacaggcctggctgttaaggtttaccaggttccttttggccacaccccccttagtataaacttaacacttctctccagggtccagtttctaaagcaaagtgacagcatcgacacgtccctaaagcaaacttgtcatgaagtccctcacctctcaaatgtgagtccctcctggcttcctttgattttatctgtaatatttagcagatacgtgtgattctattaggctagttaggaaaccaaggcccaaagaagctaggggttatttaaggtcttgtcatcagctgtaaaacaccctgctcagcgccctgctcagtgaaaga

SEQ ID NO: 93163 - DNA, 1343 bp, Homo sapiens
tcacacctgtaaccccagcacttcgggaggccgaggcgggtggatcaccttaggtcaggagtttgagaccagcctggccaacatgttgaaaccccatctgtactacaaatacaaaaattagctgggcatagtggcgggcacctgtaatcccagctacttgggaggctgaggcaggagaatcactggaacccaggaggcagaggttgcagtgagccgagattgtgccactgcactccagcctgggtgacagaacgagactctgtctcaaaaaaacaaaacagactttgtaaaactcatgaacattttctaacatatgcagaagcagagagtagtgtaacgacctcccattgccatcacctggctccagcaattatcaaaagattttctagtaagtcttcaacccttggcatttgcatccccactcccaaccaatgaaggtagcagtgggcattattagaaaaaccaaaatgttgatttaatttaaaagactttagtacacttgacttgcaatgtggagatctccaaacaaaatatattttctgctaataacattattccttattcctatgctgtaattaaagaatccatgaattccagtacaagttttagaactactgatctcattttcagactaggggacttggggctaccgagttttataactggccacaagctcccaatgaagaattgggaacaggactagaatggaattagaatttacgtttcctattccaatgtggggcccaggccctgactgtcacacagtctcctcctgggctatgcctggggttaggaaggggctagatgcaggtatcaagaatggggaaaacacaggtagctttcaagattcccaagtcgccctcagactcaagagtagtagctgttgctatcaggcctgttttctttgtttgtctgtttttgagacggagtttcactcttgttgtcaaggctggagtgcaaaggctggagtgcaatggctcactgcagcctccgcctcctgggttgaggcgattctcctgcctcagcctcccgagtggctgggatcacaggcacctgctgacacacccggctaactttttgtatttttagtagagatgggggtttcaccatgttggtcaggctggtcttgaactcttgacctcaggtgatctgcccgccttggcctcccgaagtgctgggattacaggcatgaatcactgcacccggcctatcaggcctgtttttgttttttggtttttgtttttttgagacggagtttcgcacttgttgcccaagctggagtgcaatggcacaatctcagctcactgcaacctccatctcccaggttcaagcgattctcctgc

SEQ ID NO: 93164 - DNA, 1031 bp, Homo sapiens
gaagagctggctctgtgaggagtggggtcagggagagtgttctaggcagaggaaacagcaccagcaaggccttgacttgtttggcaaactgtatgccagggtgaaatggcaaaggagaaagggccagatgcagccagagaggcaggcggggctccacacatcagttggagacctgcagagtctgcccaaaagctggcttacttctgacaatactgggcagccatagaaggtttctgtgcacaggaaggatgtgatgtggatttgagaggcagcagtggagacagagaagagctttggggtgtattttggagctagaatagctagggcttgctgatggaccggcagggaggggaactggtggactcaaggaggactcacaggggtctggcctgaacacctggtgatggttgtgccatttgctcagatgggaagacccaggggaggatgagtttgggacaggtgggaattgagggctccgtgtgagatgccaggtgcctggagtctgggctgtagggaagtacgggcgacagaggtgggatttgagagcagaaccctggcatttaaatccatgggaacttaagggctcagcaaggggagaaggaggagagacgaagtctcagaacatgtccatgaaaaccccgacatttctgggccacatggagaggaggagtggcaggcagtagggactgagggagaaagcagtacagagcggtgtctggggaagcacggggttttcccagagggtggctgcccagccctagggaaagctgaattcactgagacatgcccatggcgttggacaacctggaaaggagctggtgactttatagagaagcttctgtgggggtcggggaggtgggaacagcccgtggagggcttcagccatgcagagaggtgagaaaatggaggctgaaagactgaggagggaaatcaactcgccacgcacaatttttgagctgtcttgtatgtttgattagtagagaactgggtacaaagagaagtgggtggtgacctagctgcacaggaaaaga

SEQ ID NO: 93165 - DNA, 1060 bp, Homo sapiens
aagactcttattatcctcatttttcagatggggagactgaagcttcagaaaggttaaattacttacccaagattatgcaactggtgagagaccggattagggtcagcacaaaacccctctctactctgagcatagggccccttttcaggccagtgactgccctctgaggtaaacctggctacagcctggtcatggagatttgagttcattttaaagagaacttgggtggcctctggctgagtatagctcagactcgaaggcgagtgttagaagcaccctggcctcccctgcccccaagtcctgagatgcactagggtcatgttcgggcctgtcagggccacactggaaggtcacaaccacctggccctggcggtgaccctgggcctgggccaggagcagttgggctgcataggccgtactgagagagcagctgaccctccctgactcacgacaagtgccgcattccgaggcggcccggccaggctggaaagcgtgtgtgtctgtgtgtgtgtgtgtgtgtgtgtgtgtgtgtgtgtgtgatcactcaagtgggcatgcgcagagtctgtcagggagaaaattccagaaagaagccagttggaaactgcatagggaaaaatcgttctgttttggggagcttggggggctgggaaattaggaagggggtcacattgagaaataacagtagtggtgcagcggagagggagcttgccggggcatcaggacccctgaaaagctcatctcagctccggccttaagtcactccaccccccaggtctcagctttctgcaaaatttaagtgctgaacaagtactcaatgatctctgcaaagcctttcaaccctgattttctaatattctaatgaataaataattatccgtaaaagtaattaaatgccatggagggtcccaagtaggaaacgtttgaggttctaaagcgggctggggagaaaatgcagtcggaagccccaagtccaggtccgagagccagcccgggggtcctccactccccgccctagccgcagggctgacacagtggttcccagcgccaccgcgagccc

SEQ ID NO: 93166 - DNA, 1084 bp, Homo sapiens
actgtccgttgcatattggcagagcctaggccactgcccaccccgcgaggtaacatctcaccaatttcagcttccaggcagtgcagtggccttcagggatcctaccagctctgatccctgccagaatctatacttcctggatagctgggaccacacaggagtgtaccaaggccaaagtttgttttttttttttgtatttttttgagatggagtctcactctattgcccaggctggagtgcagtggcacaatcttggcttactgcaacctccacctcccgggtttaagtgattctcctgtctcagactccggagtagctgcgactacaggcatgcaccaccaagctcgactaatttttttttgtatttttagtagagacaaggtttcactgtgttggcccggctggtctcgaactcctgacctcaagtcatctgcccgcctgggcctcccaaagtgctaggattaccagcatgagccactgtgcccagcctcaaggccaaattttggaggtcaaggagacttaaagagtttttgcccaccacactcagcactaagattctaaggaagatccacctgtctgaaagtcccagacccaggaatcatccttgacagcatctctccctcacctctcatgttcctggcatttgtcccctcccttcatctctgctgccatcctgctcatcagcccctccgatgtcatcctgcttcccagctcctccattccatcccaggatccagatgacatgagcttttcaaattgcaaagctgattacatcacacacactgcccactccccgcctccccaccccccgcctccccgcccccccaccccccaccccggcagccacctttgaaggcctggcctgtctgccccagcactttccacacccttctcctttgctctctgcactctagccttgtgacatctatcagttccctgggtgccctgctccctcccacctgggagccttcttccctgttctcactctctccctctacccctcacccagtggactcccttcgcccttcagctcgcgctggacagcccaggccaactcaggttcttcgttgcagttcccctggac

SEQ ID NO: 93167 - DNA, 1064 bp, Homo sapiens
agaactacggccttaacctgcctcaaaaagctgctcacaggagaggactgaggaaaagccggaggcaaggtgggggttctgcccagaaggaaagcgaagattggcaaactcggagggaccccaggaagtggtgggcaggatttgaagacccaaagtgtggtataccgggtgggggtaggtggacagtgggtgataggaccaagctgtactgaaatctagaatgatactagattcacaaccctcctgtggcccccatctggccccccacgggaggagaagtgatgggtagttactgcggcttttcccattctgaaattgtcacctgcagctgcacctgctggtggtgccttctagaatggtcggcacccccaacccagccctctcccagataatgggcaacatgagtatctcgggggtgtgctgtgtctctttcaagatgactgtcaaaagcaaacaaaagcagattgtttaacagacatggcagcaaagctgaaactccctctagcttgagtgcaggaggttctcacttttagcctcgtctttgccattcacgaatcaattgtgaatattgtctgagcacctgtcaggtgccccactccctgctaagtctagccggatcgagcaaagtctctgccctccagatcgagcaaagtctctgccctccagaggtcaacaagctgtggagacaggggaaaggaggggaggagagtggctgggaggaggacatggagttgggggcagaagaggccaggcctggctggggtgcccctccctcctgggcttccaggctgaggtttctgcccttctcaccagggatggctccttcagtgagcacccagctcttccccagagacttggacagttgcttcaggccatttgactgggacctttttccttcctctggatggttttgtcctgctggtcaccctgagccccagagagccccattgaggggccacacttagcttgagggagttcttgatgggtaggatgaatcaagggttgagcgtggcagaagtcattgccctcccccccaaatcccagaactttggctgaatcatctc

SEQ ID NO: 93168 - DNA, 1099 bp, Homo sapiens
ccctaaactcagccgtgtgggttcagaggacccctcaagcccaccaactctgcaggcaaatgaggctggttcatggggtgggggagagagcagcctcactcctgcctcagtgtggccgtggcctgtggccttggccgtggccgtggcctctccctcctaggccagagccaaccaggcctgcagcctgagctcagacctcagctttctctgggcccaggcaccggtcctgaagtgaggtgacattcatttcactacatcctgtgactgcactcacttcctccacgtggcgggaggtgtgggggtgggggtgaggacagattagaaggaaaacgtagctgggctaggggcctctgggggaggctgggatttcccaggggctggttggggtgggagggaggatgcgggaagctttcaaaggagagagaggctgtgaatgaagagaagggaggaggcggaggcagctggaggtcccagaagtggcacccattggccgcagcgacacggaggggagactgctgccactccaaggctctcagaggctgctggggtaggaggtggccctgaagggagcctgcctcggtttctctgctctctggggtgctggtgaggccagaaggaggagcaacaccccaggcctcacaggccaggtgtggccctgggctgagggcctgacccagggagggtggggtgctccgccccactgatcctcttctctcccccacaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggtgagcagcgggctctgctggggaccctctggcctgggagagggagagccctgtccctatgtgatgacagccggctcctcatactgagtgcatgaccgcatcactcagtgctcacgacagggtgtg

SEQ ID NO: 93169 - DNA, 1017 bp, Homo sapiens
ttgtggtacatacaaaagtaatttgtgtgtacatacatgcatatatacatatatatgtacacacacatatatttgttaaacctacacacagtgtttattttattatttcgataaaactattattcacagctgagccttgtggtgcactgtaatagtttcttttcgtttttttttccctgaagttaataattaccttgtttctcatctgccttatttttttgtacctgttgctaattcctaccacaacttctaatataattttatttttctttaacaatactgttaccttaggacttctttttctttttttctttttaactgacacataataattgtgcatctctatggggtacaatgtgatgtttcaatacatgcatacattgtgtaatgatcaaaacaggatagttggtatatccatcacctccagcatttatcacttctttgtggtgggcctaccacactttccaatagccatcagtattgctttccacacgggcagtcacagcaggtaaaagatgtttcagttccattttttaagttatctatcctctttcactctgggctagttgctttctaggcacattgtagctgatgctctgtgacttccttttgtggtcatctttggaattcccattactttccggttggaatctctgttttctggctttcgtgtcctcctcatgcttggctcactcccctcattagagcacatcttccaggacacacatctgtccatatcaaaatccattcatggctgggcacagtggctcacgcctctaatcccaggactttgggaggccgaggcgggtggatcacctgaggttaggagtttgagaccagcctggccaacatggcaaaatcccatctctactaaaaatgcaaaaattagccgggcatggcggcgggtgcctgtaatcccagctactcgtgaggctgaggcaagagaattgcttgaacccacaaggcagaggttgtggtgagccgagaatgcgccactgcactccagcctgggctaga

SEQ ID NO: 93170 - DNA, 1082 bp, Homo sapiens
cgggcctggaatgatgcagctgggagaggtgggggcacggccagagcagtgggcggaggctgcgttgtagccagccctggtgagaccaggccagagcgtatattttaccacgtgtgcaaatctttggcatcaccggatttttaaaaataatagctttaagatataattcacattccatacagttcacccatataagtgtacagttcgatggttttagtacattcacaatcaactttttaaaattgtcatgaggtgtcataggttttcatagagggagccatgtgtgggcaatccttgctgatagggtggggtgggaggtagagatgccagaggcaggtggacccgctccagggcatctaccaggttattgtgccacagacacaagaggtacaaagggcctggagggaatagggggacgagagaagcccaaggaccaggtacctgctggatgtgaggacccaggggaaaggtgggacctgagttttctccagggtttgggacttaggcagctgaagggaggggaatgttacttccacatagagggaaaaaccagaaaatagagccggctctgaaagaagcatgttctggaagagtaggattttagggactgcaagtcatccagttgggatgaaaataaatagagctggagcccctggcagtaggaggcgtatgttaacttatgcccaggtgtcttagaggaagagcatttagagagaagctgaaggtagaacatgacctttgaggagcacccaccgtgcagaagtgggatcaagactcccggacagccccagagacaaagctgcagaatctgaggctggagacccagaagcaaggagccagatggagtcatggctgggagagaacacacagaaggcagttgctggtgagctccagaagcaggggtctcctttcactccagggcccggctccacaatggcactcaagaaatggctgttgagtgagtgcttgaagcagggagtgattagctggccaggatgttgaattgagctcaagggccatgaggatggaaaaaagccctttggggccgcgggtgactgtatcagtcagggtccattcagaag

SEQ ID NO: 93171 - DNA, 1002 bp, Homo sapiens
caggacccagtgggaccacagctgggaccttgccctgtagctggctcagtgtgccaggggataggggcacagagccctggtgggtctgggagatgagcttgggaaggacttggcctggacatgggctaggctgccctgctttccgagccagacctcaggagatggcagagagggccgcttcctctgtgagggccgtacatgatggcccttgggctgtatggtggccttgtgacatgcagccacacccctggggagacctttgaagcatctctgcattctggaggatctgctgggaagatggcttcgcagcggggctcttgttgatgctgccaagaaggccgggtgggagtcgggctgtctctggctgggggtggggtgggggctgcggtccatccgagtgtggaaatccacgtttctctggtttgtgcagacctgtgcaagcagccatgctgcaggactggccccctggaagtggggcatacatgaactcagggtgtggcgttgtaatcaaatgaaatgtacagcataattaatctggcatacccttaatgatatgcataattgtgctgcatggtaattaggtgtaaatggtaagcagttcacataaatgtttttgtaattggtattaattttgcagaggcaaaccaagtttatgtggtttttctcttcttgctctgttagttttctagtacaggcatttccaagcttttggaggaattctattgcaaatgtttgtttatagggcaatgttttgtgttttctctcagaacaatgttatgaatggttatgaggttcccaagctggtttccaaatgcctctttggcccatacagtaggtgaaatgtgcaacgcgtgtgcctgtgtcggaaggcccgcccagcatcctctggctccaggtgccccagcgtgtgcagcatgaggggggctgtgtgcgtgtgtgaacctgtgcgcctgggtcatctctgcatttgtctaggtatatctctgtgtgtgcatctatgtg

SEQ ID NO: 93172 - DNA, 1050 bp, Homo sapiens
gcgggtgggatttccccagggggaggctgagccaggccaggcttgcagaaggaggctggagcctgagtcataaggcctggaggcggggtgccttgtgcgatggatgagaaaggcaggtgcatttcagtctgtaactggtacgacccctgcagatgtttgaaggaagattttgaggaaggtgctcgcacccttgcattgggaatgctgatgagttagcgcctctacttcacagtgatttccccaaaagatgagctgcaaggcctagaccctggccctccacccaggacctgcggcgagcatcatcaccgtctgagaatctttgggtgggctggaagttgatgtcaagctgtccagcctttccgtcactctccattcagaggcaggtctgcggagagagataggagggacaagctggggacagcatttttggaaagcaaacagaaaagaagcaaaaactgttcctctaaaatagaaaggaggcttatgtgtgttatgtgaaggataatgtggaaggctatttccaaagaatttctcaaaaaatgacgtgagccatgtcagcatcattgaatttagatagaggccaggagcagtgtggcatcgtgctggggccaccaggctggggactggacagatgatggtttcacctcacccctgccacctccttgctgcgtgtcattggaagatcactcaacctttcttaggctcagttttaccatctgtaaaatggacataacttcacaggctggtgttgtttgttttgagcattgcttcttggactaaacctggatattttttccttccctccctcgcttctgcacttcctctggttctttgcctcccaagaagcctgtttcctcctgttccctccaaaactccaagttttgagttcccccttcctgggaaggtccattcgtcatgttctattgactctcttgttcccaattattccctgcaaacctggttcacccagtgtatttgaagagcatctactgagctaaatgggagttattgggggtcagttcctgttttctttttaataaggggagggag

SEQ ID NO: 93173 - DNA, 1112 bp, Homo sapiens
caggtagggccagagcatctaccccaatgccattccccatgctgcggccctcggggaatagcttctacttttgtttgaatattagtatgtgagcagagagcccgtcagaagcccacctggcctgaggctgggtttctgcagggactttgctgttcctgagcagggctttaatggtctactaaaggtgccagatccctttccactttaattttgagggctcattttcaatcatttctctctgacgatttttccctaagaacatgaccaaatctgagatccatgaagtgtcagcctgagatttatgtctgtatccgagcctgcctccacttggctaagtgtgtgggcaagacgaggttcagtgcacatgtgtctgtgcatgatgtgtgtgtacgtggtgtgccgccacctgtggatgggtaggacttgcttccacatgagccagtgtcaaggcagcttgaggccctcgagtcacagggagctgcactctgacacctcccagcggcaggaacttgggcaacaactcgattccctgggcctcagtttcctcacctgtaacatgggagtgtgcgtggattctgcttacaggtggttgtgaggatggagtgagatcatgtgcgttacagccttagaggagcgggagccctcctgttagctgtgtctgttttcatcatttgggtggctcacgtggactagcactgcaggaagtgctctaagaagcctcgtccaccttcctgtgtcttttgcagaatcttggtcagatgaggaaagtgccgattctgattaaaaatcctgggaggtgggaggcttctcagcgacacttagcaatctgttgagttgaacaaatctcgtgtcaacaggttgttttgcttccacctgaaatccctcccgctgtagtttcagctcgttattctcatcctgtcttgagtgcagcagcactttcccaccgtattcgcttccattttccagagatgtgctgagcatttcctgtaagccatgccctgtgctggctttgaggggacacggtgtgtttaggatgcgcccagctaacgaagaactgcagagtgggactggggtcactggagagggagaaataaagtgctcaaaggagagtg

SEQ ID NO: 93174 - DNA, 1023 bp, Homo sapiens
ctgcctgcctttggagagttgggttgtagggagttcctgctgggtttctggggcaaaatggtccccctctgcctccaggttctaccgaggccctgcttgggctgtgacaggtggctctgtcaaggtgggagtctgtgtgtgcacatgtgctggctccaggcgagggaccaggctggcctgtgcagcagctctggcacctgcctgcctccctggtgggtccccctcctctgtgcagctcctccccagataagcagctgcggattcaggccgaccaaacttccctcgttaccccacccaggcaccagtgccttccataggagactgaccctaagaaaggtgaattccttctagactcaaggagtggactggtccacagggctgccctctgagtccttcctggagaagcctaggaaaggacgccagcagccatctgtcagggtgtctgcggacaggattcctctgtggggtgggggttggactagagccggaaggtccattccagctttgacattctatggctctgattctagtggtggaatttcaggcctagcaatggggacagggtggtctgtttttcggcacatggcagtaataggggaaggcttccaaggagaaggagatatgagagagatcagggcgcccagcgagttgggccttgggaaggagaggcagtgtgaggagggtccctgcaagagacgggttggtcacgtccgactctgcagagggtgtaaaaagtacagcctcctttaagcctcggcacgtgtgtatcctgtaggtttgtgtataaatccctgtgtgtggataatttctgaggtttccttttcaagtccaattcacagtaagctcctcagtcccttatggatgttttactatcgctttcacacccacctctgccagtggttctcaaaaagctaggaagacaggacaaacggtaaaatccttgtccagggtcaccggcaggaagaagtggagccaggcctgcactcgggggaagatgccccatgctatacctcttacctgggc

SEQ ID NO: 93175 - DNA, 1217 bp, Homo sapiens
agaaggaactggggtgcaagggaacgtggcagagccatgtgcccccaccgccttgttgcacatggaggaaaccaatgccccacaccagaagctccatgccagaagcagaattggagccgggtcttctgcctcctaatcctgcgctctctgacccacatcaggggtgatgagaaacaccaacagccgagagttaaactaagagtataaaacttgggtgccgcggattcatggatgcccaggcctgcgctctgctggccgggggctgaggcttcctccctttcctcttagtattcatcggcacacctcagtcctccctgcccttctcctgggccacaattctccccaagaaatcaccccattcaaaccttgcattgtgaacccaattctttcttccacggaaacacttcctgacccttaggaatgatggcagaggaccctaggtaccacccttcagcccaacgcttgaaaggcgcccagcatcctagcagcccctccctgcagggcctcctgttcacagtagatgttagcagcttttgtcctgaaccctcaacagtgcccgtgactaacggtgagtgtgtcttgcgcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaagctcttgtgtgtttgtgacctgatgaaacacttcctggcgtctggccagcacgtggggtgctcctgaacgtgggggcacaagtttccttatctttgacctttaaaaaccaacaggtttcttccagcgtgcaaagaaagcgtcaggccttgctcggctctgtagacattcacaccctggccacggtgctaaaaatagtctcacactggttaggcttccgcccgccccgtgtgatgccgccgcctgcagcccgggagggaggggcggagacccagccgcgcgccgcagccgggctgagcctcctcggagagggcgggaggg

SEQ ID NO: 93176 - DNA, 1026 bp, Homo sapiens
gggccatgcctcacatgggaatcagactgggtttcccttgcccagccctccaggccccagggtgctgtctctgcacctgcactcccctgtccacatcaaactgggtttcccttgcccgggcctccaggtcccaaggtgctgtctttgcacctgcactccactgtccacatcagactgggtttccctcgcccgggcctccaggccccagggcactgtctctgcacgtgcactgccctgttcgcatcagactgggtttccctttcccggcactccaggccccagggcactgtctttacacctgcactgccctgtctgcatctcttctgtctttctgtgcctcttgcccttagagctccttgtctgtctttcagtgcatataccagaatgtctgtatgtctatgtgaaatctttttgtgggaatgcctgaatttttacgtatgtgactttctggtgtcatccctaaggccaagagtgttaagagttggggtgagagatggtagagttttttatgtttggctctccacattatataggttctaggatatgtccctgaaactacaacgtagctcatacatgggcatttttataagactaagtgtttttatgggtggacctcctgattctctgccatgagctaggcctgagattttacagacctaggactaactgcagtcacctggacaccagagatctgtaactgtcaaccgtaaagagagagagtatatttgcttctttggggttgaaaccatactgacgtaatataaacagaatttggtcagcaccatcaggcaaacatagtctgctcgataaggaaactgtgagagtcaaatggaacttttgaagaatctagaccaagctgaacttccctgccatattcacccctgcctcacgcctctccctgttcacccctggctggctggctgcatcctggggaatgcttctgctccatcggggtacccttcctcctctgcatctcctcaagagaagtgtaaccaagacacatagaagaagcacagactaacacac

SEQ ID NO: 93177 - DNA, 1062 bp, Homo sapiens
ggagccaaaatctcactttctgtaactgatttatccctgtcctctcaagctacccaggataagctcagtccctcctctgcaggctcgcctttcacgggttggatggcaaatgacaacccttcctagttttctcctctgtagactgctacacccaattccttcaacctttccaaacgtgacatggttttctcttaccagcctgcttgaccataccaggatgtggccattttccaaggctcctattcaaagtacatgcccagggcccagcaccctgctctccatcacaggggatcttgtccctgcagagcacaaggcatctgtgaccctcttgagtgtcccctggaaaagcaccttagacggcattagcacttcccacatagccactttgcactgtgcggtcattttaagtttatcatcagctaaaacatacggaattttttttttttaacagaaccccgtgttaatctaggtattcccccaccatatattgtatggtcactttcttaaacctgaatgcaagacattagatgtctccctggtcatcaccacctgagggcagacaggcatagaacagaggcacgcaaccccacactgcacgcccccagccctggtcaggaaagtgagcgatgtgaccgcactgctccctttgggctgtggtcttacgggctcctattcagcagtgctggggcgtgggccgcacaagtgcagactggtgagctgaagcaccctcagaggcctgcagccaggagctgttagctagagtttcctcccaagcctcagcagttgctttgttcaccctccttctgtacttgtcctgtgccgaagggtcactggcctccttggacttgttttcacagcagaggaaggtgcagaggaagaagaagagaagatgcagaatgggaaagacagaggtaaaggcagctcagcaggactgctcgtttaaatggggagcccgagctcatggatcagccgccccccactttgtttctgcattcctccctgccaccacctttcccagagctttcggacccgaggtccctgtacctacttttcccatctgac

SEQ ID NO: 93178 - DNA, 1092 bp, Homo sapiens
agctgactccatcaccaacaccatgtcatccctggtgaaggagctccattcaggtgaaacccagagctcccagccagcttcctggcctcccctgccttgcccgcgcccttctcacttccttgccagcaccggcagaacctcaccacccagcttgcaccaccccatttcatcacctaactttgccttctaggaacacactggatgtctccacccagagagcctctgtcacacaggatcgcgtaggggcggtttcacattcaggcctatctcaggagtgcatcttgtggagcaagctgaatgtagagaaattcagacctttcagtgcaggcaggccccttcctcacttacctcgtcttccatctgtactttgtccacagccgctctctccctaggcctgaccgaccacctcattctgaaacttccctggaggtctggagcggaatcagccaggaaagctctggaccttcccctgctgcctttctgctctctcctgtttgatttgtttttgaaacctattccctccttttgtccgtgaccaggctctgatttcacctgaagttcatgacctgagtctgtcgcctcttctgctccttgtgttcagctcatctgtgacttctttctcagtctctccatcacctcaccaattcagtgacttcccaaagacctttacctcgtggcatttcaccttacataaaacccaggaaagagagagaaaataaaaggccattcacgtatcctcctatctccaggaatccccatgactctaccagttacgtaggggccagagagtcactaacgatttcacagcggtggggtctccatgttttgtgttaaactaatggtttccctccctaagcgctgtaggtcactcacactgatggctctcttttgtttctttccacctaatgtagtgcttttaaataccttgaagtagcttaacaggattattaaataaaaagataaagcagtttttccacggacgattcaaacacatacacttattcaaacactcttagggaaggcaagccttgggtatttttcagcccttcgtaggagaaagctcacatgtttagggttgtcatgggactggac

SEQ ID NO: 93179 - DNA, 1010 bp, Homo sapiens
tggcttggtatggtggctcacacctgtaatcctagcactttgggaggcgaaggcgagcagattgcatgagctcaggagttaaagaccaacctggacaacgtgttgaaaccccgtatctactaaaaatacaaaaaattagcccagcgtggtggcgcacacctgtagtcccagctactcgggaggctgaagcaggagaatctcttgaacctgggaggcggaggttacagtgagctgagatcgtgccactgcactccacctgggcaacaaagcaagactctgtctccaaaaaagatatatacgtatataaatatatacatacacacacacacacacacacacacacgtatgtcctttccactcacaggttgccggcagcagcggggggaggggtccaaatgagaacatgtacatgaatgtgtttgcaaacaaaatgaaagctgtttgcatgttacttcctgccctgcaagccaagcccttctagagccctggcccagtcacgcagctcactctgtctccaccactctgtgccagcctcttctttccctcccattcttggtcttgttcttaggatgttctctctctctgccctgcacgcccccttccttttttccttttcttcctctctccagtcttggaagcagcctaactccttcctttcaagtatgatcttgtaccactgaactgaggcccactggctggctctggttgatggagaaaaagtactttcttccttcctcaaagaggtcaggtacttgagataacgtattttctgtctttgaatctccaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtgagtttctggagcagagttcagcggggagctgaagggatgtgcaaacacggacaagattcc

SEQ ID NO: 93180 - DNA, 1066 bp, Homo sapiens
attgttttgtgtgtatgtgtttcagtttcatttagttctgctctgatcttcgttatttctcttctgctgggtttgggcttggattgttcttgtttctccagttctgtgaggtgtgaccttagattgtctgtgctctttcagactttttgatgtaggcatttaatgctatgaactttcctcttagcatcactttttccgtatcccaaaggttttgatagattctgtcactattattcagttcaaagaatttttaaatttccatcttgatttcattgttgatccaaccatcattcaggagcagattatttaatttccatgtatttgcatggttttgagggttccttttggagttgctttccaattttattctaatgtcgtctgatagagtgcttgatatgattttggttttcttaaatttactgagacttgttttgtggcctatcctatggccattttacatttctatcagcagtatattagggttctaatttctccacatccttgccaacacttgttattacctgtcttttttattatagtcatccttgtgggtgtgcggtgatgtctcattgtagttttgatttgcatttccctaataatgctgagcatctttccatgtacttactggatatttatatatctttggaggaatgtctattcagatcctttgcccattttaaaatattatttgtccttttattattgagttgtaagagttctttatatattttatatatagatcatgtatcatatatagtttgcaaacattttctccctttctgggggttgactttcactttcttgatggtattcttcaaagcacaaaagttttacttttgataatattcaatgtatctagtttttctttcatagcttgggcttttgatgtcatatctaaaaagtcattgcctaggccaggcgcggtggctcacacctgtaatcccagcactttgggaggccgaggcaggtggatcacgaggtcaggagatcgagaccatcctggctaacatggtgaaaccctgtctctacgaaaaatacaaaaaattagccgggagtggtgacgggc

SEQ ID NO: 93181 - DNA, 1445 bp, Homo sapiens
ctcaggaagctgaggcacgagaatcacttgaacccaggaggtggaggttgcagtgagccaagatcacaccactgtgctctagcctgggaaacagcaagatcctgtctaaaaaaaaaaaaaaggtcaggggcgatggctcacgcctgtaatcccagcactttgggaagccaagcgaggcaggtggatcatgaggccaagagattgagactatcctggccaacatggtgaaaccccatctctactaaaaatacaaaaattagctgggcatggtggtgcacgcctgtagtcccagctactcaggaggctgaggcaggagaatcatttgaacccaggaggcagaggttgcagtgagccgagatcgcgccactgcactccagcctggtgacagagagattccgtctcaaaaaagaaaagattcactgacgactgatagatgtattacttcctggagattactacctgctccagcacttttcctgctcttttccacttttcattacagaagaaaaagggccaaaaatgtgatgcacttcattgtcatttaacaagtatttattaagaatttacctgtgctgagcacagggattcagaggatggaatttaagaagtgagatagtgctgtgatggagacacacaagattccgtgggagtatctcagaaagacattgtctcatcctagaggagatagtagtgagactgatgcccaggggaccagcaggagccaatcagacagcatgggggagagtagtgctcccagcagagggagtggcaagagagagcagagtcccatcaacagagtcaagtgtggatgggcccacacttttgcttttttgtcaaaaccaccaaggaacagagttggttgacatcccttgcgtgatgtatatctcatccaagatcggctccggtctccaggcttcctgaacccttagcctcaggcctggcgaaagcccatgcatattggtgagctatcacttgtgcctctgacccacccaggattgcaaactggtattaccctacacaaaccagaattcacggagggccctgacagctctgtcctggcttcattttcatccagtgtgatcctaacgccaagggctggggcataagacccatggagaaataacacctgcccaggagtcgtagcttttctctttcaactgctctgaacaaacacaacttctagaatctggtttttatcttcctcagaaggcatgccctaggtaatgatcccaggaagagggtctgattatttccaggctgatggtgggcaggaggtttcacttccagatactagagctttagacacatgtggctggccaccctgcctacccctcttgtctcatcccccatcatcatttcaatatcaaagtatttgcaaaggttcagtgtcatgctgttatgaagcagcctggatgttcacctgggtcctatgactctgatgtgcg

SEQ ID NO: 93182 - DNA, 1111 bp, Homo sapiens
aagggaagtcctatttttggagcccctactaagtgccaggcatcatgctggggccacccaagcatggccaagaacagtgcagtatcattttcctactaaagacactgcctttctctccgtgcagctggtctcctggccagttctctctgccacagcatgtgcgtccctgcctctgtgctcagatgcagagctggtgaaggatccccgtgtcctcagggcaccttctctggcattttctatacctgttttggctccaacaagagattgtttttatacataagagattttcataatccctgtattctcctttctcacatttccttactgggaatgaaattgactgtcccctggaaaatcacggttagtgtcagtcatcagaagtcttgactgatccatgttccttttagtctcagaaacattgtgctgtgatcccaatatgcttagttttccgccagcagtttgaggcaattagcagacccagggaccagtcctagcctgtctactgattttgtgtgtgaccttgtgacctctcttgacctcagcctcctcaaatgaaaaatgaatgttggactaaaacaagctagtttgctggggtcatgaaccctctgattttgtaatttctgaacacttttcttggaacatgatgcagagctttctcgggttctcagggtctttgctgatttgaaaatgaagagccagcagtctagagagcttatcagattgtaatgtttcactggctctacatttgcaacagaattgtttccaactgttatacaagggacctctgtattgagagaacctgagtcacagggcatttattgtgtttagttattggttagacccatgattggcctgtgctggactcaagcctttgttacagcttgtactacaacaagattccactccttatatcaggaaaccttaaaacactgagtagcacattgcagagcttcccttgcttctccaggcgaattgccctctcctggcagctgaaacccagaggcacaagagtcttttgtgcctatcattggacaacatatccccatccttggagccacctgactagttgctctacctttgcagatttctaggtgtttctcaggtttcctgt

SEQ ID NO: 93183 - DNA, 1011 bp, Homo sapiens
tagctagtattacaggcgcccacactgggctaatttttgtatttttagtagagatggggttttgccatgttgtccacactggtctcggactcctgacctcagttgatccgcccgcattggcctcccaaagtgttgggattacaggcgtgagccatcacgcccggccaaaattttaaaaagaaaagaattgtaaaacacttttaaaatgaagagtttattagatgtgcttcccaaaactggctctgtaaatccattatagagaacttttgatagtgtccaccttcttgcttcattccccttagggatttactgcttactactaccaggatctctttctacccagataacactctgacaccaaatgtgtaggtttcttacaccaaaaaattcagttctctgcagacaccagctgggtgtcctacgatttaattcaattctgacactacctggagttagggcagagcccacaggttaagggctctgtcccacaggagtgcctcacacttcagacaccaatcacaagtagtggttcttcagattacccacacttctgtccaacttggctacaaatcagggctcccacaaccccttcctcaggctcaataatttgctgtaatggttcatgaaactctgagaagcactttactcactattactagtgattttaaaggttattataagggcacaggtgaccatccaaggtgacgatgtacatagggcaagttccagaagggtccaggagcttcagtccccatggagttggggtatataccacctcctggcatatagacatgctcaccaaccggaagctctctgaacccctcagttagggtctttatgggggttccattatgtatgcatgattgattcattcattggccattggtgattaactcaatctttagcccctctcccctccccaaggcctggtggaaggggctgaaactttcaaccctctaataatgccgtggtctttctggcaaccagtccccatcctgaagctatccaaga

SEQ ID NO: 93184 - DNA, 1054 bp, Homo sapiens
caggccagagtacagtggcatgatctcggctcactgcaacctccgcctcccaagttcaagtaattctcctgcctcagcctcctgagtagctgggactacagtcacgcaccaccacacccagctaatttttgtatttttagtagagacagggtttcaccatattggccaggctggtctcgaactcctgacctcatgatccgcctgcctcagcctcccaaagtgctgggattacaggcgtgagccaccacgcccagcctacccatttttttaaaaaacacaaatgtatacatgttttaggttaggaatataaaacattatacttataatttctagctaggagagcaatgggaccatagagtaaaggcgagaggaaaggaaagaagagatcagtagtgaggggaggaggtgagaagagggtacggaggagacagactgtcagggggaaagaagatggcacatggcatcaagagtggccgacaacccagaaatctgatggctttcgtggaaccaaagtgcacttgttttggtttttcctaggtttggttttgcttttttctttattcacacagagtttattgcttccatctctggcgtttctgcatcagtaggtacacttacatgggcaaagctgaacaggatgcaaatcaagcccagccattacatgcttcttccaggaagtgacacgcatcacttcctctccatttcattggccagagcaaatcacatgaccacacttcacctcaagggggctgggaagtctaatcctccagtttatctagaagtcccagagaagcagatgttggaaatacctcccccaagtagacaaatgagtgagactgttggagggagaggaaggagactacttatccttccagctcctgatggtctcatccccttgttatgaagtattcccttcctgatgatccagggtgtcacttcacctgttgttgctgaccactagcatcccctccttctcttcagccctccataccccagagatgcactttgcagctgcagctacttgctgcaaacctacttccaacagtctgcccag

SEQ ID NO: 93185 - DNA, 1027 bp, Homo sapiens
ctgagttgctaatgtccacattcagcaccaggggaaattcgtgcatcacatgacatcgcctcattaaagctgtcagcataactttaccaaacaagttatataacaaccaagaagccactggtacaggataatattcagaatgtgacatgtaaaaattgcaataagtagaatatattttttatgttgttgaacaaaagaaaattgaaagaattaaagcaatccaagggcctagaagcaagtgaattctctgatacctgtgagtaaggctactttaggacagcccatgaatccattcctcgggttgttctgagctccttgagaaatggccccaactgggtttttggagtgaacctggttcaatacagattgccttaggatgttcactgaaagtttcggcttgctctggactcccagaaaacgttcaaagaatcgggttgttacacaggtggtttcattgtaaggatgaaaggaataggtttggggaagtaaatcactgagttgaagcttcagagatgtccttccacgtgaaccaggaaccactcaggatccaggaatcagtttatttgccttgaggtcttctgggttgaagcaaagagaggggaaaggtaggcctgtaggtgaatgacttggtacccagtaggagtcctgttacctgtaccacaggttggtcagcaatcaaaagctggcttaaaatatttctgcagatgtctgctgacgtctgtaggggtgattgttttcaagaatttgcattaaaatacttgagagagaaataaaatatgggatagatgaagcaaatgtgtcaaaaatctttgtaactgtttaacctagtttgagtatatggaaatacattattttctctccttttgcctatgttaaaaatactgttactacatttttaaataagttaaaatagggaaccacaaaaatgatacctatatacttgaacatttctctgcatgtcctcatgtatatttggatgtaggaccaagcccattcactgagtgtaggtcctctggagctccaggtt

SEQ ID NO: 93186 - DNA, 1107 bp, Homo sapiens
caggtaaagagaatgaagtgtatgcccagcggggtatttcagcatatgtaaaggccctgaggctggaggtcgcatgacctgaaagttgacattgtggctagaatgcagagaacaatgctggaatgaagtcagacaggcgggctcatgcaggaccatattaaacaaaccagtacgtccattttggaaatgcgtaccaatttatgttttatcttcatagggaaatagagttacgaaagctgcaaatgggaattcttgctttgtttctcccccaaaaagtaacttatccctttgagtttgtttagatttcaaaatcctttccttgaaaatctaatgtcagctcacgtatctgactctaacattacaactctaaaggttagttagtgaaatggaacagaatagaagaaaaagcctgagaaagaaacagaaaagtgctatttggttagttaaacctcagacatgccctcagtcagtcacaactgctctaggtattttagacattaaaatgtataaataaacttgttgagatgggccgtgctatggttggattttaaaaattaagtatattttatgccgttatatagtcttactgagtttacatagtacttttaaaatgttgtcaataaaagctccaaagccatttgaccttgaaaagatttcagtactcccttactgcaaacaagataagtctctttacacctgatagtttctgatgccaattctttaattcttctggaaatgatcgttgttagaatgaatactgatatgtttgggccctttcatcttgggtttattttgcagagtgtagttatcttataactattgagccactcaggaaggattcttcttgactagagttctgttatacagaaactcctaatcctctaatctcacattgatacaagtgctttgcataaagtgggtgtagtgctcgaaagaatttatttataacctgccagataggtttgtattgatttttttcaaagaccttcttccacattgttaaataatttgagcagccagcagtgcgccctgtagcatgcttcagcgtccgtgccataacttctccctagatggggagcggggctgcagaaacctctgtgggctgac

SEQ ID NO: 93187 - DNA, 1018 bp, Homo sapiens
aagaacccttccctcatccagataccacattgtctgatagcctgtctgaatgggtccttagatttttagagtattggtactcttgttgaaaagtaatgcattaaactaattaactccaagatggggctatagatgtagaatgagcatagtaaaggaagagaaaggggcatgaaaaggggaatatttgatgtcatggaatctttccagctttacagtgtgtttggcctgccctggcaaggccaaacttttgcttagccagtgttaagtatattttttctcagccctctgtttttcatgatgctttagttttctcttggtctttttgaatttgagatcaaggtctaaaaagtcatcagttttaaacatttggttagaaatccctgcctcagactttgtgggtgccctgtgttttctcaggccttgcattcaaaatgaagtgcccctttgatggtggaggagcagcggggatgtgctgccagtgaggaatgacaaatgtggcctcctcatttctctaaatcccctttttttcagaagaccattagtatctatgacccaggcctctagttcttttattaccattcttttatgagcttttcttccatctgttctttctgagaatggaacaagaataagggatgtttaatagacacttgttgcatttttatttccttggcagtgttctggacagtcctagccgactggatgaggaacaccgtcttatagctcgctatgctgcccggctggctgcagaagcaggaaacgtggtaagttaatggaggatcccaggagagtagcagaaattagcattactttaatatgcaaatggaaagggaatagtagacatgaaatttaggagaacaggtacctcggggacactttccacttttccacatgctaagagtagaaggaaacttcctcaccctgataaagaacacctacaaaaacctacagttaagatcacacctacagtttaaattttgaaatatttccccctaatattgggaacaattcagagata

SEQ ID NO: 93188 - DNA, 1093 bp, Homo sapiens
atgaaaaagacttttaaatattatactttataccgttttccatagttttcctgatatgactaaatagcatcactattctggggtatttatgtatctctaaagcttggagaagtagagttttcttttctttttttttttttttgagacagagtctcactgtgtcgtccaggttggagcgcagtggtgccatctcagctcactgcaagctctgcctcccggcttcatgccattctcctgcctcaacctcccgagtagctgggaccacaggcgctcatcaccacacccagctaatttttttgtatatttttagtagagacggggtctcactgtgttagccaggatggtcccgatctcctgacctcgtgatccgccggcctcagcctcccaaagtgctgggattacaggcatgagccactacgcccggctgagaagtagggttttctaagcttctaaatatgtttaataggcttaccctctaggagggaaggaagggcctgataattgtgtgcactgcatcacagagtgtctcctcatccaacagatgatttctttgcacactgtcccagcctcttggtctctaggaacagagttgtttcaccctaggcaagacaaattctttattatcactaaaggcaattgtccagagtgagcaaaagtttccatggtaaaaatagcagcagaatgtttgacaagagactgttacctagtaatttagcccaataagatttatggtaggtttagctaaggccctgaagtctcaccttggctccctgaacaaaaattggtggctggtagccctgggagaacatgatgagtgagtgagtactacatgacttcttgattagtaatctaagaagctgagcttcatacttcttccgagaagtcagaacttttctggctaactaattctgaaaatgaaagtcaattcaaacagaagaataaggatcctttctaatcattgaccttaaaacctctcatcaacacaagcttctagtttctggctagaaaacatagccaattaaagcagtctgtcatccacactcatgtataaatgacaaataggatcaaccttcctaaggagatagaatgtgat

SEQ ID NO: 93189 - DNA, 1132 bp, Homo sapiens
tcggtaaatatattgaaaactcagtacaactaaatatttactatttggccactctgtgtcatgcaattcagttttgtcccccaatcacaattccaactgtgactacattgaacttgatgcatttatagcttatatttgtaggataagtcattatcctattttctgaccttataggtaaacactttagagtttatatctgttttctaaaataaccacatattagggaccctgtcattgaccaagaacacacaaaaagtgctttcatgagccccgaagacagaaggcaaggcaagagcattgttccgaaacagatttctagtgttcatgtctagcagcttctttattttgcacttgaccctgatttaacttgttactcctggcttatttcttaaacttggctttataaactcgtgttgaccccttgtcagactccaaaggggccagtttcttgctgtggttctctttggactcccgtccttgcgctttggccctcggtcgttttgtagacttacatactaccttcaaactcagacccagtggaggagcagctgaaatccatgtggccactgttccaacatggacagttcagacaagcatattgcagcctggaatggtcctgttagattaggagcaccctggagttgatcctgggctggaaggtttgccaggaagcaaagtatgtttgttccagagttgcttttcctgggagcttcatcctgttatgacaacttggaatggtgcagctatcttccttagtttctcaccttcatagcaatgaatccctaggctacctaaaacttacctaaggcatagtagggttcgagagccactttggaatcaaaacagacttatggttgtaagccactttagttcctaacatccaactaaattcaagaatataagacaaagactcccgaactcctctcagatattggcatgtgcacaggtatataactgacctcagaacacttcccagccaccacatggtacacacaagggcagcggttggcaaactacagcttgtgccaactcctgcccttgtgtataccatgtgtatacttgttttgtaaataaagttttattggaacatacttgtttatatattggctatagctgcttcccctaccatggc

SEQ ID NO: 93190 - DNA, 1057 bp, Homo sapiens
cagtgagcaattgagattgggccgctgcactccagcctgagcaacagagtgagtgagactccgtctcgggaaaaaaaaaaaaaaaagatttttcatgcacttcgtgttgggaaagaggtcatttgacaaatttagatagcatcacgactgctacttcatcaagacgagaccccgctgggtagataagcacaggaaaggtgagtagtggtgaacagttcttagagagccccatgtcactccaggtccttcattctgtccataacctggctgtgccagagaacctatagagcctggcatgtcattgggcttgtttgtctctctcacacgccctcatgggacagtactattttttctcattagcttgtaatacagcgaaggcacacactattttctttcccctaaacagagttgattgcatcaagccacaacctatgagacagtgagctgttggaaggatgttgtacttccttgccctttgtggctaaagtcctttgaggagagataatccagatggggagtgtccttacattctataaatccatctcttccacgctagtgccttgacattgtgtatttttttttagtgacagaggagaaaaggaacttaatttgctgagaattatttatggtgtgctgaaggatcacattagagaagagtaacattgcttgccccatggatctgagagtctcagtcaggcatttagagtactgttatactgatataacagcaggcatgtgtttacattgctataacaggacacagctttacatactgtgatccaaaattgttgtcttcaggccgggtgcagtggctcacacctgtaatcctggcactttgggaggccaaggcgggtggatcacctgaggtcaggagttcaagactggcctgtccaaaatggtgaaaccccatctctactaaaaatacaaaaaattagctgggtgtggtggtggatgcctgtaatcccagctacttgggagaccgaggcaggagaattgcctgaacctgggaggcagaggttgcagtgagctgagatcacaccactgcactccagcctgg

SEQ ID NO: 93191 - DNA, 1049 bp, Homo sapiens
atcacagatcaccataaccgatatgatgataataatggagaagtttgaagcattgccagaattaccaaaatgtggcacagagacaccaagtgagcacatgctgttggaaaaaatggcaccagtggccttgctcaactcagggttgccacaaatgttcaatttgtaaaaagcacagtatctgtgaagcatgataaagcaaagcacaataaaacaatgtgtgcctgtattaaaatggctttctgactgggtgacaaggtaaagagtttatcttattatctatagaatatagcagaatgacaaaaatcactatgtttttgtttttttaagaccaaggacaatagagatgttgggggaaactaagaaaaggaataaaacaaaagtgatcaagtcagaaactatccatatgtggactcagtgcatggattctcttcccacctgtgaaatgagaaaaatagagtttgtttgaaaagcaagaattaatgatagtttcaggaaacaactagcatgtatgaagtctttgtgagaatttcaccaagtcaacacaagaatagttttttctccagcgttttttttttttttaagacagaaaagcagagtaattgaaaattaacacataatcttagagaactgcagggtccttagtgttggcaggtgtccagagcctgtctgacagcctgggcagaccgccagttttcagctgcttctgggttgggattagattccatttccactcaagcatttaaggtaagcctttcaccagttctaactcagattagtacaaacagaaagtttgagtatttccaagtccatacttaaataccttagtttgaaaaatagaagctgacagaagcataataactaatagtttgtttcttcttcgcgttggactgaggcttgaggtcctgagcgtgaccaagcgtcacatccgtcatagaccatcggcagagccgactggaaggagcaagtttggggaaaaagatctcaagtgcaatgttgtcgtgttcagattgagatgcttgtgggatgctgggagtgaagacaagctttgt

SEQ ID NO: 93192 - DNA, 1052 bp, Homo sapiens
agaattctttctaacagtcatcactcagaaacaagaaaaccacaaagacattccagcccaccccctagtccttcctggaaaaaaatacattttgtgccatatgtaccgattgctttggattaattcagctatagaaatgctatagaaattttgactatataatacatagtgcttaagacaatgatgtttgttcccattggctaaaactcctacgtcagtgtttatcaaacctgactgatgagaagaatcacctgggtcacttgttgaaaacagatttctgggacaacatcagacccagtgaactggaatttctgaagataggatcttgagaagctacatttttattccagctgattcttatcatcaagcaagtttgggcaatagcctgacaaggaagctaacgagtaaagtgtaggactaccctgaagagagaagttagggacttaataaatcagagtggcctgataacacattacccgcatggagactcaggacctgaccaggtaagagtacttgcctttagccttgctagggcactttccagcagcaagagagtcaggccactgcttctggacagagctgagtggtacagggcaccagagcatggactcttgagccagactctttctgagttggaatctggctctttgcttaccttgaaatgttcttgtcttcattttttttttttttttaaatttggagacactgtctctgtctgtcacccaggctggagtgcagtggcccaatcttagctcactgcaacctccacctcccaggttcaagcgattctcctgcctcagcctcccgactagctggaattacaggcacctgccaccatacctagctaatttttgtatttttttttttcagtagagattgggtttcaccatgttggccaagctggtctcaaactcctgatctcaagtgatccaactgcctcagactcccaaagtgctggattacgggcacgagccaccatacctggccttgttttcaattttttatctctaaaatggggacaaaaataatatctaccttttggggtttatgtg

SEQ ID NO: 93193 - DNA, 1056 bp, Homo sapiens
aatttaaattcttatgtactaaaactacaaagcaaaagccaccaaagttacgtcctgcagtagtgtgcttataatcagttgcatctctggtacccacagctcagtggccctgtggctttgtgagggagaacctcttgctgaatttacttaggcttgaagtatcgatttctacccccctccccaagggttccccccctccatgggtccccacctccccatgggcctccccttccccatgggtcccccccctccccatgggtccgtctgtgcttaccgcgaatgatgattggtccctttgctcttaccatgcttatcgtcgtttcccttgtttcccctagttggtcattattaatataaggtaaatgtcttttctttcagtcctcctcgccctctgactaatatgaatgacaccatggttagccacatgtcctctggagtgcccactcccaccaagaggtacgtatgtcttgtgccttcgacttgggtgttggcctctgctactgatttgcgatgcccctgccagaaatgaggcctgaaaagcaggttgttccacagggcagaaaggactggtttgctttctcttcctttgaccgtcttttagtcttaatttctactttttattttccttttttcccccaccgactcacaaatatagcaactgaagtttggctttcagtggtgcctcaggtggaaacttcatttgtgacaagcagtggtggcagtgtcagagcagattaggcacgtttcagatccgtttttttaaccttaaacaatattttggtagtcgtgagtttcaacagttttgcctttgaattctttgtcaaagatcatttttgctctttgattagactgtgtaaattgaattaatcccttataaaattttctcctgaatcattctgtgtatgatttataaacatttaagttggaaagcctgagtctctctcttttggttatgcaaggagtttgctttaggggccttcaaggaatgagaactgtgtacttctttctcctctttatttaatttgctcttctccaaaaattctctcaggcaggact

SEQ ID NO: 93194 - DNA, 1536 bp, Homo sapiens
gattacaggcatgcaccaccatgcctggttaattttgtatttttagtagagacatggtttcaacatgttggttgggctagtctcaaactcccaacctcaggtgatccacctaccttggccttccaaagagctgggattataggtatgagccaccgtgcctggcctccatcaaaaagttccgactctgatcaggaaattaatgttaacatcttagcaaaaaggatccagaagcatcaaaggagggagttcttgccaagagtacatagagatgtccagaaggaaagttgacattacttgatagtgtgactttatagtaaacatgagggaggaactgcagaaatgaaggaccacagatgaccttggaacaactggaggttcctttctgaaaggcccaatgatattgatgtaatgaaacttgatttgtatttgaaaagatgtttttacactcttgtcacaaagtttttttcttttttgaagttcctttcattcttttgaagggttaattccttactattttctgctttgacacagaaatctcctgcaaagaagctgagccatgcaattagtaaatctttggggtgtgtacccacgagagaacccccgcatcctgtttttcctgagcaaccagagaaaccacttgaccttgcacatatagtgtaagtatacccctggatgtgcatgtggatcacactgaaatgggggccttgtgaaattcctgtggatcaaaaccagggatcacttaacatgaccattcaacttctcaggtttttactttcttttgtgggaacttaagacttcaagctttcttctctgtaaatcaccgttaagtgtccacatggaaatctagctcctgattgctgaagcctgagtaatatggcagcctccagaaacatgagcccattgaagagccattattgttctggttttagctgggctgccttttgtgattttgggttcattccttaaatcagtggcagagatctttttctctatagcagtaatgcccatagggacttaaattaatgtagacaacatggaaatgaaaatcaacttaatttgctgttttttgtattgagggaaaattaggaaacataagactatattctacaaataaaactggtattttgtatgtatttatttatatgtatttagttgaatattcatgctagtaaagcaaagctagaggagaacaataaagttgagaaatagagaaagaacaaagtagggaggaagagaaacagtgaagggtaagattcagcctgtaaactgctttcttcactctgaattaaatgatgatactatgcttccctgatgaataaatttggtagagttttggatcacgaatctttatcaggtgtcagaagtttttctgttggagtgggcattcattttctttcacctccctgatggaaggtagtttgactaaatgagctctagagaatcttgatcttttttccttttttctttcaattatttagatacctgtttatatttattaaaataatccatgcatgtgaattacaaattcattcatcc

SEQ ID NO: 93195 - DNA, 1067 bp, Homo sapiens
cctggtattcattcagtgacatctcagttccaggccctggagagtgccaccatacacagaagcacatgggaagacctcttagtcttccaactctcatactccctctaactccagtctgcctttcttgggatcctggctgcctgtggatctacttccatagtatttgtgtgctctgctttttttggttttagctgactagaacttttgtttacctaaacctgaaatattggtcacactccttcctacttcagttctgccatggaacccattactgcatttgagtgccagagaactgtctgctgtctgtattcgagaagcaacttctaatacaaagatgacttataacacatgaaagttttttcttacagagtaatgttttgaaagcttttacagttatgtctttggtctgagactcttatttatgtcttccactcacaggcagcactatgacagtgttaaactatttgcagttgcctaatacactatattttcttagttttatgtttttgaatctgcgattctagtttcctttatctcctcttctccccatcctcccagctttcccttaccaacctctgtatatcctttaattagctcaggtatcactactttttctgattctccgagtggtttgatgtgtctcttcatggcccgctatatcacactgaatacctcttttaaagcacttttcacactgttataatcatcttcatagaatctgcttatttgtctatatatttcattagattgtaagtcctcagtttattttcagcctttgcatcccaattacctgctacacataatcaacgtttattgaagaactttatgaaagttggcattttccacttgttccagttttaaattactttcgattttggaaatgttcattttatgcccagccaacttgcaaaaaatgtaggagattgataatattcagttttggcaagggtgtacagaggagaactcttgaagattcttggtaggagtatgaatagataaatgcaggtgacagaatttaaatgcatgtaacctttgacctaacagttcctcatataggaattctccca

SEQ ID NO: 93196 - DNA, 1064 bp, Homo sapiens
ctctgagaacttggtctggcagggtaggttgatgggttgtgaaggttgtgcagcccctctggagggtatgccagagcccacctggcccagaaggatatcggataaggaagaaactcctgctccggctccaccgttgtatattgggagcaggaagggacggtgcagatagttttttttttttttttggcgatggagtctcgctttgtcgcccaggctggagtgcagtggcgcgatctcggctaactgcaagctccgcctcctgggttcacgccattctcctgcctcagcctcctgagttgctaggactgcaggtgcccaccaccacgcctggctaattttttgtatttttagtagagacagggtttcaccgtgttagctaggatggtcttgatctcctgacctcgtgatccacctgcctcggcctcccaaagtgctgggattacaggcgtgagccaccgcgcccggcctggtgcagatagtttgcctttttagttcatagattgcatcttaaggagttctgtatgatccttatgaagaagactgtgccatatccagagatcctggatgcaccgactgaattggactgcacgtgttctgcctgggcatgtgtggcatggtgggaggaggcaagggtgctctgtgcataagaaaagggaacaaaaaggtacctgaagattgaagtttcagtagtatccacggtttcctttgcttaaattccactggagagaactagtcatataggcccatctggccacaaggagggtatgttgtatattatatatatatatatcgcttctcagccaaggcagtttgaagcaggtgtgcctctgtctttaccccccactgccgatatacattgaccaaatagaatggtctccaaaggaactggctgaggcagaagtcctcagatggaggaggctgggcacctgcatggatggagcacagcccttctgccaacctgcatgggactctaacatgagcagagtagcaagtggagtcaggaacttagggctggggagattggaggttgaatagggaagtcatataggccttgttgagaaaat

SEQ ID NO: 93197 - DNA, 2880 bp, Homo sapiens
ataaccagtttttattttccctttggttgtcttaaaactcaaccaagaaaaagcaaataaactcacttcaggaattaaagaaaaaaggaaaacaaacttcaacccacatctacacttaactctagttccttcatctctgaaaatctgttaaagatcctttttttttcctagataggtttctgttataattaatgataaaattttgttaaactgaatatcctatcctgggtcttgttgtgttgtgaattccattttttttggtggtggtggttgtgaagagccacttttaaaatccaaaaaaaggaaaaaaacacagtagtttcttttctttttcattgaataaagaaaatttacagattttcaaattgtttctttttgctttcttaaagtacaagtacttcactatgttaattgttaatgttttttccactggttttttttttttgtgtgtgtgtgtgtagagtctaattctttacactgggatagtttttgctgttttacctttcatgatgactgagtttgctggtatatttctactgaaaattcttattccggatgttggggctaagagaattgggaacttcttattccccctggtttgaatttcctcatttggctaacctataactcttttaaaaatgggggttttgtatttgtttagagacaagtgactgatactgctttatgatttgcatgttttcatctactcttgaattttttcattgagttataagatacatacagaaaagtatacaaatcacaaatgaattcttacatttctgtttgaccctcacagcactattgtgaactaagtcttatttgcatatgttgttattcttatttcagcttgttttatgaattcctttatttttgttaaagagacttaaatttttttaaaaataagcattgttatcctgcataattttgaagctagtgtgataaacgtattagttctgaattttgatggatgtatgccttgtgtatggtagatgcatactggtaaggctgagtaaagaggtttccagctaacaaaaagatgtgctatcaatttaatagtaatttctttgagattgtcggctgtgtttatactaacgttttgaacaaatgtttctatatgctcatacgtgagtttaagtgtgtgtttaaccagctagtataagaattttcattgtagatgtgacatatgagttttaagtagtacctggaagtttattttgatttttccaaaaatttctgttgaatgttttatctcagtagctatgcagtataattcattcttttagtctttggtccattttgtttgcctttattacaaagaaaatgccgtatggtaccatatctgagatttatcctgtctgttcattctttcattcaaaatttattttttaaacacctactgtgtgccaggtcctgtaagaggtatttgggatacatctatgaacaaaccggacaaagactcctgccctgtggagcttaagttttaatgagtgtgaaagagactgctggagcttgtcagcattacttttttcctattcttgttggcacatgtctagactacacttttcagccttcgtgtagctaaatggaaccatgtgagtagttcttgccagtggaatgcgaacagaatgataggtgtctttccagaagaagacagttaataaatagcagggtgccttctgtaccctctctgctatcttggtggaaagaacgtcattaggactccgcggagggtgaaaccattaagcgaaaggtaactgggtccttgaatgatggatggagaagaatatccagcaacccacttgactgtgatggaggcatgataagaactttgcgttaagtcactgaaattttagtactagaagtagagttctgttaaaatcttaagatgtgtgttattgtcttagcagtcacgtggcacacttgatgaggaaactgacattggagagggaaagtcagaaacccatgttatatagtggtaaccaatttggtaaatgtgtcatctgtgataatttggaaggcacgcctcacacccaccgggctctaggtcaagtgttggaaaagatcagaatgtgagactgttaatggtaaggtgacataggatagagatgagcttagaaagaattggctagtgtacaagcaataaatgaaagggaacagagaaagctctgactcttggggcagtgaaaggaaaaacagactgcttccagaccctagagagaaagccttaagagttgagaaaggctttaagccacaaagtcctagtagaccttctcagttgaaaaaggtgacccagtcctgtggtaaagatcagatgaagggtatggtctctttttcttggctgattatcagaatcccctttggttctgcctgcagagattctgatttattggtctgaggtacatgaaaccctggatataaacagtttttaaaagttccccaagtgggccgggcatggtggctcactcctgtaatccgagcagtttgggaggccaaggcgggcagatatctgaggtcaggagtttgagaccagcctggccaacatggtaaaaccctgtctctactaaaattacaaaaaattagctgggtgtggtggcgggtgcctgtaatcccagctacttggaggctgaggcaggagaatcgcttgaacctgggaggcggaggttgaggttgcagtgagccgagatcgtgccattgcactccagcctgggcaaaaagagtgaaactccatctcaaaaaaaaaaagttccccaagtgattctatcatacagccaaagccagaagcaactgaccttgttcatatggcctccaggtggcttctgttagttgaaagcaagtggcaaagaactacattagtcttaggaaagaactttttgtgtgtgg

SEQ ID NO: 93198 - DNA, 1064 bp, Homo sapiens
ctttttagtagagatggggtttcactatgctggccaggctgatctcgcagagacttattactttaaaaaggataccaagaagtaggctgggcatggtggctcacacctgtaattccagcactttgggaggccgaagcgggtggatcacttgtgatcaggagttccagccagcctggcaaacatggcaaaaccctgtttctactaaaaatacaaaaattagctgggcgtggttgtgggtgcctgcaatcccagctacttgggaggctgaggcaggagaattgcttgaacctgggaggtggaggctgcaatgagttgagatcgcaccactgcatccagcctgggtgacagagtgagactctgtctcaaaaaaaaaaaaaaaaaaaaaaaagaaaggatactatagtagtcatatcagatcatacaacttcagctataggcttttcctccctaagattccagatgattgtttcttgtttgagcccaactgatttttagccatgacttcctgcttcctctttgatttatcaaactcatatctctaaaaaactgtatatatgctatatcaactgctaaaactataattattttggaatgatttaaagaaaaatagccaagatataatttaacagtgggttccctttttttttcctcattttttttccttcaccattttgccttgaaactattcttggtgtccctcccagtaatttgacataaatctttgttttgctttgagttaaaatggtacttatctcttagtgacttcttaatttttcctgttcttgccatcagtttatctcctcctttaggttgttggagtttgttaaggggaaggccattgtgtttctagtaaccttccctctctccaggctcttgcctttcttcattcctcaaaagagaacgaggaagagccaagagtccacttttatccccccggaagaataaaataaacatccatactgtttttattttctcgctttcctatccatacttcagaataaaattttctcagccttttacccaactatggctttagttcacaagtacctcagattaaggattca

SEQ ID NO: 93199 - DNA, 1024 bp, Homo sapiens
aaatatctctgtaactatactcagaagtttgcataaaaatgttttaacctgaaaactttagaagtgtccctttcaagacagttaactaaatgtcatacatcatttaaatgataaggcaatgggtaaatatttctatgttgcacattataggagtttttgttggaaatgatgaagttggagactgtagcaatgatgatctatagctaaattattttattttctcatgttattttattgatactggatttttcatttttaaggggttactcctctccccttttaaaaatgggaagaggtagtcaagggtggaggaagggaagtgagaatggcatgtagggtaatagttgtcagtctagattagaataacaaagagcaacaaacaaacgcttgtttctaagaaaaaatatgagactgcatacagtgataaaagcagtctcagtgttttatagagggaggcataaatcatggtggtttcgctcagtggatcaggcagctgttaaaaggattagaaatgaagaatttgtacaaaacaagatgtttaatagaacgttaagtgaaaaaacagatgatgtattcatatctattctgttcacaagtatgtagaaatatatatacatctggagggaaatagagaaaaatgagaattgtgggaatgcatgatttgcattttattatagttcatattaatattaagctcttaaaaataaggagaaatgcaaagaatgtgttcaactcaagagcaaaaacaaaataaaaagataggggacaaaaagagccaacctgcctttcataaaattatttattgagtcatggaattttagagatgggaagcctctcctaacaggtctcaaaatttttggtctcaggacttcattatactgtaaaaattattgaggaccccaaagagcttttatttatatgggttaagtctgtcagtatttccatattagaagttaaaattgaggctgggcatggtggctcacgcctgtaatcccatcactctgggaggccgaggcaggtggat

SEQ ID NO: 93200 - DNA, 1063 bp, Homo sapiens
gtcccagctactcaggaggctgaggcaggagaatggtgtgaacccaggaggtggagcttgcagtgagccaagatcacaccactgcactccagcctgggcaacaaagtgagaccccgtctaaaaaaaaaaaaaattgctagttagttcaaacagtaatgttcaaagctaagtgtaatatctttatctttgatttgcttatgtcaatcaggatttgtcatcatttccccaaactagaaacttaaaataatcctaacttttaaacttcctttattccgtaatctagtttgccatcaactgcagttccttgcattgaaatgccttggacttggcctcccctgtccccgcacacactgtcactgctgtaatccaggctcccccacaacctcctttgtgcattgtttacaaggtttcctagctggtgtctccaattccattctttttcttttattcattgtgtgccggtcattaacagtctaattgccttgaaacctagctttctaaaaatttgatctctacttaaaagtttttaagctaaatccagattgcttccctctttcatcgttttcttttataacagaaatactcttcctattcagtctttatttttctttttttctcactataaattggctgttgtagaattttttcttcaataccctgtttcctgcttatcaccggtaagagatacaggctgcatgctcctgtcatagacttttatcctactcttctttagtgccccccagtccctatcctcaacctgttttgaccccatcattccagatcctctctttcaaggcctagcttccaaatgtctttattttagaacttgacaattcctgcttatgtgtttttgtatctattctaaattatattttgaaggagtgtggtgtaatggtatttattttggagtcagataggtgtggttttaaacttgatttggcctctgaactttttgaccttaagcaagttaacctttctaagctgtaatagtagagtaatgcttagtgttagagtttgttgcatgagagcaaaaacccggaataacagtatcgtaaacaaagtt

SEQ ID NO: 93201 - DNA, 1040 bp, Homo sapiens
ataggatgatacattctttttctaaacaaagaaggtatagctctcattattgcaaaagtgttttactctaagttacaatgaaacattgtgaacacaagcttttaaaaattaacacaaaaagcacattcttggcttacctgtgataactttaacaaccaactagtgaagtttttatctgctgtgaaaccagggcatagttgagtgaatgaagccgtggacactttgggtcaggggcctcggtgatattgtcttggttctgctggtggtgtgcagcattaccttaggtgattcatttatgttcttctacatttcgtctttccagttcctaaagaagaattaatgttactatcccttcctcttcacttttcttacagtggtgtattagaagatctgagacaggtgtgattgagcttcttagaataaacacgtggtaacataaaggttgttacagtaaaaacaaagatgaatgtactataaaatcttcatagtaagatgcaccctgttgtttagtatgtaacaagaaaccattgttgtaatatcctgatgtaaggttatgtttctgaattatattcaaaccaggtggcccctcagttttgaatacttaagaactacagctgtggatttaatgggtttaattaataggaaattcacttcaggttcatccatttgacctctgctacatagccaacagaaattacatagaatgtttctaaaacttccagaaaattcaggctagctttagcattcttcacctagcataggtgaagtcttaattctacaaatgaaaaaaaaaaaatccagggtttctaaatgtggtaaaattgtaacagacaaggtcaggaatcaacttactgggttgctcagtatttagtgatacattcgagtccttttgtggtttcagatagcaattatttctaatataatttattttgcagtgagggccgaggcaagttgacggtattttcagttaaagctatgttagcaaccatgtgtggtggaaaaatgctggacaaattgagatgtaagtattttcatattat

SEQ ID NO: 93202 - DNA, 1074 bp, Homo sapiens
atgaggtaagtctcttctcaggaagagttgcaagtgtgacctggctctcttgctagtgtgctggactctgccacactttcctgtctgtctgcatagatagcaacagtttcttttctgcagcaaggaatagatacagttttgtctctttgaaggaggagagatttggagccagaaagatttacacaactgcagtgtgattaattttctgtaatcttttattatgtcctttgatttatcactgccaacaaaataaaagctaaagtcttactcttgcattcaaagctctatgttggtggttctcagctctggatgcatatgaaaatagcacaagggactttttcaacataagaacaggatggggtttaggcatctgaatagtatctttattctcataccttattgaggatttgtatgggtttagaactctaaaaatacacaagaaatgatcctgttgatttctacggaaatacccttttgtgaattcaattgggatttgcgaaataataagaaatatacatgttggtctgccctcagtccctggcacagagcccctgagacccttgtaatttcctgagtgataggggttgtaggagaatcttttgttctaacgtttgatcgctgcccgggttcctgagacagagctcctgatacccccttgtagataggtggtagaatcttttgttctagtatttggactttgaccgcagttctttacactgaactcctaatacctttgtaacttcctgagtgataggagcatcttttgtcctaaggaggccactcttaggatatagactgtttgccaggggagctaatcatgtgattgattagagagttgggactttaagccccactccttaacctccaagaaggaagaggggctgaaggcagatcaccagtggccaaagatataatcagtcacccctaggtaatgaagcctctattaaaaacccaaaaggactaggtttggagagcttccagatagctgagcaggtggaagttcctggagtgtagcacacctcgggaaggcatggaagctgtgtgccccttcccgtaaaacacaccctatgcatc

SEQ ID NO: 93203 - DNA, 1076 bp, Homo sapiens
gcccatgcctgtgtcctgaatggtattgcctaggttttcttctagggtttttatggttttaggtctaacatttaagtctttaatccatcttgaattaatttttgtataaggtgtaaggaagggatccagtttcagcttttgacatatggctaaccagttttcccagtaccatttattaaatagggaatcctttccccatttcttgttttcgtcaggtttgtcaaagatcagatggttgtagatgtgtgctattatttctgagggctctgttagacctggttttgccatttattataaacaaataatcttgggcaaatcacgttacagctgataaattctactctactttaagtcttactcacaaatcttaacttaaaattctctccgaagagtttatcatgccatcctagatcgaagtgatgtttctttctccagtggtttctcaaagcattattttttacattgtgagttgttacccattaatgcttcatgaaatcattttgatgggctgtagccagaattaaaaacatataataggaaaaaaaaggaagaaaaataaaatattagaatgcaacttatgtggtaaggctaaatgtgttctgatatctggatgtatctatgtgtttgtgtgtgtacatgatgatttaaatatatttctgtgatgatttaaatatatttatatatctagatatatgtatgtgtttgtgtgtatatgtgtgtatgtgatgatttaaatatatttctgtgctcgtggtcaaaaagttcgaaaaccactgccttagaacaactctcgtttttataattcctgccataattattcttgggaaacagtagtctacgtgtggagtgttgagagcctgactaggctagtggcattagtaatataaagtaaaagatgcattgttctaaaggttttattttgttacctttcacgtaggattctagagttgatctgaaaaaaattttgagactgtacaggataagtagtagtcagttttcaagtttttccatatgtatgttcagttgttcctttactttttgttgaaagggtcaataaacagaagaaaataaacaat

SEQ ID NO: 93204 - DNA, 1050 bp, Homo sapiens
tacaggctgccacagactggaaggggacctttcaggcaaccggtccgttccctcatttcccaaatgaggacacttatgtgcagaggcacgccgcatggccacagccacggggcatggccacagtcgtattctgtggttggtcaggctgggacaggaatgcagcttttctgactctaggcttgggtctttctcacgatgctgccctactcccctttcctaatcatagttcactcactcacctcataagtgttcctccccctggagttttctccgatgagcagacaggatatcaggagctagactagcagagttcctgcacatactggagatgcacgtgtttcctatccttttctccctctgttgttgttttaattgacccaccgtttttaagaagtcctagctgactggtatactatgacaatacaatagaatggagtcatttcctagcgtttggaaactaaatggtaaatctagttgagcatttctgtttgccttttttcaggtgctcagaattttgatgtcatacgactatcaacttacagaacagcctgcaaattacgatttgtacaaaaacgatgcaaccgtgagtcatttctactcatttctgtgatagctggatagagttctcaatattagaaaagactttaacatcttttagttgtattgtaatgttaattgaattatttttgtcttaagtatttattagtatgtaagctttgtaatggaagaacttgtcattttacttctttgtccttcaaaatgtttaacaaactcagtcatgtaactagttttgaggctgttgtagtattaatgttctttaaatgggagaatggatttctctgtcacttttattaaggaaatgctttatgtaaaattaatacaatttatcagctgctggaggaaaagaaaaacaatgtttttgataaaggtataattggaattgattttcttcattaagcttaatgtaacatgaatcaaccttttctataaataattgctaccatgtggatcataaaataaagtgtgtgtgtgtctgtatatatgtatatg

SEQ ID NO: 93205 - DNA, 1085 bp, Homo sapiens
aagtgttaatgagagtcttagtcatcactaactttttttttttttgagacggagtcttgctctgtcatccaggctggagtgcagtggcacgatctcagctcattgtaacctctacctcctgggttcaagggattctcttgcctcagcctcccaagtagctgggactataggcgcatgtcaccatatctggctatttttttctatttttattagagactgggtttcattgtgttagccaggatggtctccatctcctgacctcgtgatccacccgcctcagcctcccaaggtgctgggattacaggcatgagccaccgcgcctggcccctcactgacttcttaattaaatggacatccaaagaaaaactgacagggagatggtgggaggtggtgaacttacataagaaatttcaatacttggatgctttgacgtagctgagagctggcagggttaagaaattaacaaaaagatggaaaggaaataaaggctatttaacacaaaggcatgtacagagacatcctggagacacttccaaagccttctctccttttcctttagtctttactgtgggagttacgtaacttctgcgtgtagacgtagtccaggtgtgaaacactctattttctatgaatagaacagagtgtaagaactaacaaggatccaaactttttgctgcactctcttcagatcctacttagctccatgatttaaggtctgatccagcaccacagttttgggacctgtgttctttccttattccttgaggcctcatgttgccctggagggggcgatgtgacacaatagaaagaaaatgggctctagcgctttagcatcgtcatggtcaactccgcagattcctagctttgcaacttcaggccaagttacctgaccacttagactttagtttcctctctacttctaacacccctaatcctgaaaatctcctcaagctcagcacggtcttgtcttctcacctacttttaaaaagagcaatagtctccaaagtgggaggtatgtaaaatgatcctctaggcagggtgttacaagaaaatatgagcaatcaagttttaccagtatttgaccc

SEQ ID NO: 93206 - DNA, 1049 bp, Homo sapiens
gacagggtctcattcctgtcacccaggctggagtgcagtggcgtgatcacggttcactgcaggctcgatttcctgggctcaagcaatcgatcctcccacttcagcctccctagtagctgggactacaggtgtgtgtcaccacacctggctagttttttttttgtgtgtgtgtttttagtagagatggggtctctactctctatttttagtagagaggccggtctcaaactcctgggctcaggtgatacacccacctcggcctcccaaagtgctaggattacaggagtgagccactgtacctggcctacatttttaaaaagtataagctactaactttctaactactactatacaactaattttccatgcattaaaaaagaaatgagaaggaaggaccaagcatttgagttcatctacatcaatagaatttgattagcaaaataatagaaaataattttaagctgtaacatatgcaatgtatgacatgagttcacacgatgaagggaagggatgtcataggtgcgattgttcactatcattttccctgcagaattaagaacagaatttgacatgaaggttatgagtacacagatttgcatcttggcaggccagtgtatcacctcttaaacaacagttgtacctagacggaggggtgaggcaaacctgtcccatgtcctttctgtgagatgccatcctgatctcctcacctcaagtaagccagctcccttgtccaggaggaaccacccacccaggcttacacctggtgtgggttgtgggggtgctgacaccacccgcttatttgaaccttgtttctgttctgtttccttttgttcagcttacacctccacagcagacctagtttcctccctgtagtggtgttcccagttaagggaaatggtgtcactgtgccccgcggctcctctttgaattaaagcatcttggtttcaaccatctctgctagaaatggttatgtgcttggctttcctaactagctggactcctggtctgtgctgcctggcagcactcactgacttacaccaacaaccagg

SEQ ID NO: 93207 - DNA, 1183 bp, Homo sapiens
gtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccccctaacattactggaaaagtgaagaaatgcggtgcagcctctttattaatgtgcccattgtttgctcctaaatcaaagaatggtaaggaaatatctcgggggaaaaaataggttttcctttctccacagtggttgacatttactgccaccactttccaggccttaggggagtgtgaagaaatagtttcttgaagatgatagaaatttttttttttccgtttcccagttctctcagaagtgagtttcatagccagtcatgtccttcctgcccgtctaatctggagaggtcaaagagcaaggaaaataatgtgaagagaaacacctgtgccttgattaggttctatttcagcatttgacacttgaattttgaactcctctgggtcaggaagggtagctatggaaatgaggtctgagccagttggtag

SEQ ID NO: 93208 - DNA, 1809 bp, Homo sapiens
tctttgatttaggagcaaacaatgggcacattaataaagaggctgcaccgcatttcttcacttttccagtaatgttagggggttaggagacaaaacagattaagggagaaaacatggagacagacagataaggaaaatttaatcagttttacttaaattccaaaagaaatacactaccctgatttatcaccaagttcctcattttactctcttccatacaatctgtgggaaccatcccataggagtataaggcagtaactgaggactcttacccacgccactctcagatgtatgttaaacctcaagattcaccaaaaaactccaaggtttttattttcacttttaatgatcttttacttaataataaaatgaaaaataagaatataggaatacatacaatctatatacatatatttattgcaaatacttaaaattcttatgtaaaatgattttctatatttgtgaaaaaatatgactttttaaatggtgttgacaccaacttctctgtacataccctcaattccaatgttaacaattcctttaaaaaggcaaaagacacaaaagtttagcatttaccaaaccagtctgtacaaaccttacagccagaagggaaaaaaatagcttgtggtaaataagtcaattttcttttaaaataaaaaataaaccccaaaactattccccttattgcatttttctgaaataatctgagtgtctttagagtaacttcctttgaaataatttgtgccttaacagtgaggtcctacatcaaacataccatatatgagaaattcaaagtcttccactgtcactttttacagatattaaaatatatattacttaaaatatattactggaaagctatttttaaaattgatcttcaatagttgtatcaaatgtaaagcattaaaaaaaataaagtaaccaagaatctacgaagctattgcttcaactttaggaaatgttttacctactgttctctttcaataggtttgtaggtattgaaacatggtaggaaaggcccctgcctatcaccatgtttctcaaagtctctttggactattctataaattgagctgaaaactacccttggccaagttacttacttagcacacagttgtaaggagatggggagacttttccctccttgctatgatgtgaaacctctaggtcaaagagaaaacactctggcactgctcactgatagtgagttctagaaataaatagcagtgtaatgaccagagaagtctccccactcctcacccccattatagcaaatcacttcaccagagagttatttatggctctctaaggtggagaaaggcaataataaacaacagaatgttaactgtcaggtcattaatatgtatgactttgcaccttcacctggaaggcaatgaggtcttcctttggctatttaaatctgagataagctctaaaacatgtacatccgtatgccttcacagcccaataagtatgctctctccaccccaagtttcccatttgccagctcttattcttagaaatgttacatgaaataccacagatagcttcagtatcttgagcataggggttatggaacaagtaggacaaacaactccaggctatttggctttactttctgtttaataggatggagaattctaattctccaaaattatttaagattcagggagacttatttactagacaacttagaatctttataaacaagactgagactatattattgatgctatctcctggggtgacctgcagtggaggacatctgaaggctagataggggtgcacgggaggcgtatgcatcaggca

SEQ ID NO: 93209 - DNA, 1038 bp, Homo sapiens
ctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatac

SEQ ID NO: 93210 - DNA, 5173 bp, Homo sapiens
atgtgtatgggcatggtgggggctcctatagatcacacattgtcttccttccagtgctgtctagaagcctgtgtaatttgagataatccagcccaagtgtgtgtgtgtgtgtgtgtgtgtgtgtgtgtgtgtgtgtgtgtggaacagagaagagcaagtattttcccctggaccttggtagtaaagctaagaactaaaagacagtagtggtatgggtggctggcttgcttgcttttctcttctttctcaaacataaatacactttttaaaaatgcaaataccatagaaaactttgtatcataataagcacttgtaatagtggcattaggagggagttgagataggaaaagaggtgtggggatttggggtgagagtggaagcagtcgtctttggcaccaatagaaaaagtggatgcaaggaccctagagacaaactagtattgctgtctccaaggtttggcctctcggccatagaccacccatgtttgtcacaggtactgtagtgttcatctgtttttaaaatgtgagggctaatgaagttttgttattcttacaaatgaaaactaagctctgttgtttttttcccctctacttctttcagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccacct

SEQ ID NO: 93211 - DNA, 1049 bp, Homo sapiens
tctattaatgaatgctttcgcaacatgggctatttttcaactggaatatttcttttttcccctttttagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaaggtaagagaatggagagaattagaaaagcagagatcgtctgaaccctatgtttttggtcatacctactaaatttcaagtaaattgtggtagttcttaatgcagaagcagttggatatatttgataaatatgtaactatggtcttacacaaataaaatgatagatgggcatttagaactgcagtcctacatacaggtctttactgatgtttgcataaggaaggtacctgggcatctaatgtaaaccacccctgtgctcactact

SEQ ID NO: 93212 - DNA, 1208 bp, Homo sapiens
gcctggtacaatttgtggaacaattagaaaactgacaactccagaataactccctacctttttactggaatctcgaatgctagggccatagcttttctttatgcagttagaggtaaaaagcctaaaattaacttgccttggagaaactgatctttaaaatagtaaaaatgcccagtggcatagtttattgaaagcacatcactttttcttttagtggaaaataaattggaagttctaggtaagagataaaataaatctgtatggagtgtgatgcttggagcgtgaggaaggtaccacagggaagcccagcgaaaaggctttgtcagcctcagctgagtactgaaagctacctggagtggtgtgcaaacatatttttatttcacctaatggcatttaggtcctcctttacagtgaggaggtttgaggagtttctgttactttcacatggtagtattccaattcctgcgtgagtctttcatgatttataaatagttacatgttgcaaatagcatttttctattgaatatccttttttgggtacattgcaggtgagtttacacctgagatgcaggtgagaattcgacaagagattgagaaggagaaaaaagtggagccatggaaagaacaattctttgaaagctactatgggcagaggtaatattaggacaggttctataaaccaaatgttaattcctacatataagtcatgtagtgctttatctcattaccttctcagaaaatctaggccccagtttccttctgttttgttttattttgtttttttttttgtctcactgattcttctttaggaagaagtttttttcttattatgaatcacgggttcacagaattagattactcatcatactttacccttaaaactgtcattgtaggtgaaatggcttctttaaaaacaaattttttagctgggcgcagtggctcacactataaccccagcactttgggaggccgaggcgaactcctgaggtcaggagttcgagaccagcctgaccaacatggtgaaaccccgtctctacttaaaaaaatacaaaattagttgggcgtggtggtgcatgcctgtgatcccagctacttgggaggctgaggcaggagaatcgcttgaacctgtgaggcagaggttgtggtgagccaagatggtgccattgcactccagcctgggcaaaaagagcaaaattccatctcaaaaa

SEQ ID NO: 93213 - DNA, 1111 bp, Homo sapiens
atatatatataaatttttatttacattttaatcctttgtgtactcagttttttgaaagattgtaaccttctggttgtggacagatttcctgaaactgctaggctattaaatcataatatttttagccaatgtaaattaaaatcagtgaaaaaaaaagtcatgagaagaggcaaaggaagtcagtatgatttgtagatttgggttttctttcttagacattcttcatatcatttatcataaactttctcagttttttgggggaaataatctagtctcaaacataaaatgcagttttagtatggtagaagacccatttttacagactttattctatttatgcagagaaggtagatacattgtattcttttatcctctataaatgaacaaaacttgttttgttagtcttagaagaaaattctaagatcttaagtgttaccttcttcgtagtgtgatatttaaatgcttacaattgtggattttttatactgcacagaaagctacagtttatatagaaacaggacttgtgagggaggcccaaacgattcttctctgtttttgtaggacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggtgcgtcattgaactccttaagattttaaaaatagctgtttatgtatacttgtaaagtggtattaatggtactaagtgagaagtaagaatatttttacataagtttcttaataggcaggtttttttaaggcttaggaaaaaaaaattctcctaccagaatttcaagatgacagaattattttgactgtattaggatgtaagcatccatagaatgaaggtgaggaggaagccagacatggtggctcacacctgtaatcccagcactttgggcagccaaggagggcagatcacctgaggtcaggagttcaagaccagcctggccaacatggcaaaaccctgtctctactaaaaatacaaaaattagccaggcgtggtggtgggcgcct

SEQ ID NO: 93214 - DNA, 1856 bp, Homo sapiens
atgactgactttaaagatggtctaatctaataaatatttggaaacctctaatcagcaaccttaaaatctgatgtttccaagaggctcaaactaaactcttagccagttttctgtaaaaataacagggtttcctaagaatacatacaacctttgagtttcttttggacatgtctgtaaggcctttggatcttttgttgtggttgcttgtttgtttctactctaaactttctagacacagactctgtattgtattacataattcagtttgataccataagctgattctatgggcctgccagactcaatctgaatcttacagaactgcatttttatgagaaaggaaatttaccactagaagcaaatagtatgctgggaggaaaaacagggttttattttactctttgactttaattttcaaactcaaaacacattagggagggtcacattgcctcatacataacttcatttagtgaatgttgaatgattgattaattgattctgtctataatctcagtgctaccagtctttatacgtatttttttctcctagcaacatgggaaggaaagcaatctgatggacagacaggcagccctcaaaactcaaactccagcttttcttcctcagttaaagtggaaaatactttactaggcttggggaagaagtcattccagagatctgagagactccataccagtaagtttgcttacaaagacttcagttttcattgccatgatttatcagctacatgtttgaaattcatcagctacctggcttaggtacttataacttagatttgagttacatagcaaagattagacataagttttttttgttgctaacataattactgttaagaaatgaaaagtaacaggaacggaattgatttagtatgtctttctcctgctatcccctgtttacctttgagctcttgactatgttcatgttcttcctgtcttcctcttaacaaactttatttcagagaaagatctattatcagtcattttgtggtttatttccctttctgccaataggttgctttgtccagcattattcatgttttatttctgtgtaaagaaagatagaagggcgtatgattaaatatatatgacagactgaaatttcttctctctattccttttgaaatcccactgaaatgataatatagaaatacaaaagatcaaatccatacaggtgaagaaaacaaggagaccacagctgggcaagagatgtcagcaaattttgagagatgaaaactggatagaatttttcactgagctgaagagcagttgccagggataaagcagccacataaggttgcagaacaccgggaaggctcaagaattggagatacaatgtattacagaagagaaggggggaattttgtttgaaagttagtaagaagcagtttgatgccttaccccagcaggagacaggaggtttattttgaagtgaaatttcaaccagagaaactccacattcagggatatcaaacatagctgggggcagatgaggaggcactgtactgaaatctggaaaatcaagtaaaatgtaaatactgtaaatactgaatagggattctcctccttggcttccaaaatgctactaacaaggcatatttctaacaccactacttccttcttcctcccatcgtgttcgagcttgagattggtggattggtacctaaagacattgaatagtcttagaaaaaagtctgcaggcaaatgtataggttcccagataagcagagatcatcttgataatgtttcagtaaagttgaagaaatttcttagaaaaatctgtcaaagttaaaaagaggttcagtaggagagaaaaagtaagaaacttggaacaccaat

SEQ ID NO: 93215 - DNA, 1024 bp, Homo sapiens
ctacataggtttgatgcagatagggctctttttgttataaggcttagaatttcatttctagaaatgattgaaaacgtactgtctctgctttacaagactgggaagtttttggcttacctagtgatttttttaagttccaaaaaatgctaatgactttttcacatttatataaaggaatgatactggcaaaaactatccaaactctaagaatcatttaggccttgtgtttagttggcttaatttaaattgataagaacagatactacacttgatcttagccaaaaggccaagaagcgagagttagcttaatttaggtttttgtttgctttgatagatttcaaagaaattgaacgatcagcatgcttcttgccatttaaaaaagaagtaatttatattattactaaaaaactgattggttttgtttcttatagtctgttttatctttataggcgctaaagcagcaacagcagaagaagcagcagcagcaatgcaggccaagcatatccatctcctccaaccagcatctctcactaaagactgtcaaagcagccagtgactctgtacctgccaaacctggtaggcagtttgggcagtttttcaatggaagtttctttttcctagtatttttatgttggttttcctgatttgtttatgacatcatttatttttaaattatatttacttacacaatccttgtactgccaaaacatcaatataaatccaggataaatgggaaaagttgtgtgcaaaataatcatgcagttattaaaaaataactcagagcccaggagttcaagaccagcctgggcaaaatagtgagaccctgtctcaacaacaacacagaaaattagccgggtgtggtggggcacacctgtagccccagctactcgggaagctgaggtgggaggattggttgagctcgggaagtcaagactgccattagccctgatctcaccactgcactgcagcctgaatgacagagcgagacactgtttccaaaaaaaaatgttagcactgggatttg

SEQ ID NO: 93216 - DNA, 1129 bp, Homo sapiens
tttttgagaccaagtttcgctcttgttgcccaggctggagtgcggtggcatgatctcctcaccacaacttccgcctcccaggttcaagcgattctcttccctcagcctcctgagtagctgggattacaggcatacaccaccacacctggctaattttgtatttttagtagagatagggtttctccatgttggtcaggctgttcttgaactccgacctcaggtcatccacccaccttggcctcccaaagtgctgggattggaggcatgagccaccgcacacggtcttgtgtgtacttttatgacatcttaaagcttattgcccttaccatgggatatcattttgctatttgggccttttcagtccaactactatgaataggggaagactttagtaaacattcattcttcaagagtcatcactagcagtagtgattataatttttttttaataagggtactgaatcagcaatttctgtatttatcgtaaacactactcacatattgtttaattttatagaacataaatatctacttgctgtttaagaggtatagattcttaaagaacccttgttcgcataagacccactcagatctggctaaactctgccaggcaatataaaacagctagtgatgaagtagagagtggttacatcttatgcaaattcaaattgcttccattagagacatcttaaaatgccctctcacgttggtaagcctgtaactgttgatttaaaggatgaaggaatgtaaggattaaaactgtggtagagttttgaggtcgaatggccttaatgtctttattttaaactgccaacccaaggcccttccactgtatcgtgttgtcattagatttactgtgagaccatagatactgtcttaaaggccctagaatctttcctaagttttatctgatttgatgagtcattcttcagtcaattctattgaaaaagtaataaatgaaaagtaatgaatactaacactcatcccttccctatcctatcatccttcattagaactttctgaggaaaaaaactgaaaagggaggctgtttgcagtaaaactccaaaaagtacatcgttcccaaaagtgtttggtcatagttcttactccaggtagcagcatatgattg

SEQ ID NO: 93217 - DNA, 2515 bp, Homo sapiens
tttttattttaattttttcgcttcttttcacaagtgttgattctcctcattttaagcttttccttttaagtttggaattgtagatctaagattaggagccaagccaggtcatcaagtaagggaagcaattagcaagattcatgttttctggatgggattgggacagggaaatcaatattaaagaaagtcttgtaaaatgggaatatacttggggcccttgcttttcaagagccacatatgctgctctttgaatagtggctgttgtatctgtgtttcttttgcttataactaacggttattaatggctgtctctaagaatttgaggtgaatgtgttaagatgtaggaagatccaagaattaaccatagaaccctattgtcagtagccgaataggtagatatgaataacataaccttgctccacactctgcataataatagaagacatgaacaataaggtaatatcaaattgaatattgggtccaattgtttttgagctgcttttcatttattccttttctagaaattattataatattgattatttgtcctcagtttacagtaagatgagatgctctataaagctcttttctggttgcaggtagtctataataaagcctagaggaaaatgggcggtgtgtggtatctagaaggtgaggtgagaggtgcgcatgatgtcacatgtgattcatgtttaagcagctctgatattctcaagaaatgaatgccaagctaccaattatgaagaatgatttagtctctcatagaatatgcatctgtctttcatgggtcatacatgtgatatagataccatataatttgtaggtatatattatatatttgtggatgtttttgtagtccagtgcaaattaaagtgacagacatgtagccagcagtgagtatacagcaaagcagttctaaatcttagttatcaataaaggtaaagcaagctaattgtgcctattactttttcttatttcgggcctttactctcaatctgacatcactttatttcaaatgcattgtaagacaggaagaacactgagatagtatcaaaacccacttccttttatgtacaaaaataaagagctctgacagcaaaactgatacttctagttgaaaatcgatagaaactttcttgatatatgtatacctttcagccaaataggaacagagaatagaactttgaaattcagtccaatattaaaactagtttattgatttctgtgtaaagtggaagacttaaaagtttgtagttttggttgctagttttcagacaggatacacaatgttcagagaagagttttatggaattccaaataaaggtaaggtggaataataacttcagaaaaatgaatacgaaaatcactatttatattgcttttttatgatcatagctaagtgaagtctctgccttttccccaaaataaaatattgcattatgaagcaactgtaggactattatttttatcttctgatagaaaaagttttgtttagattttggtctgcttttaaagtgtcttaagaatgaaattaattacataaagtataccttttctctgtaaggaatcactgtttcctctagtgtgaactaatgttaattttactgcttgttcagaactactttaaatcaggaatttgatatatattgtgtctggagttatttaaaataccataaacctatctaccttctaacatttacatgtgtgttaagttactgaatgggtatgattatgtctccttttaaaagtatactggaggcaaaactttttttggcaagttaacttagatggagagagacctttaggagattttctcttttcctctgaggttattattggtggctgaattggaggttttagcactgtgttgtgttaaagatggctacactgttagggctttggatagttagactacccagaagcaaggaaagtgttgaggtgtggcctttcccatttaggccaggggactctgaatataatcaggaaacaccgcctgcctagtttggagtagattgcacttggtgttggaggaagggacttagaactaaaaaggatccattacctctaaagaaagacctgttagaataaaaactctccctcaagagaaacataactgtttctaaagatcaaaatcatttcggaaacttcgattattatcagtgcttcaacaatcaattcttcaactatatatagttcttaagtttcaattttgttaccaatccttcagtgtctgatctctccctaatacttcataggggcccattaaatgtctttgggagaaaataaaaatttaagtcagagattatttacttaagcttttaactcaaatgcatctactattaatagtctgtatctttttgaccttgttcgacattataatcatccattgaaatggaaaattctcaatgctgtaataatgtatgtatgtaccttttgacttaaactcagtgagcagtatgtaaatatccagcaacgagaagctactgcagtgaactatgtaaaactgactgataag

SEQ ID NO: 93218 - DNA, 1005 bp, Homo sapiens
acctgtatctggatttcttttctttttgacatgtggagttctagttaggaatttaattttgattttattttaactttaaatagccacatgaggatagtggctaccacaccagacaacattctaggttttacctggatttgttcttaaggtcttaagtcatccatagccttttaggatgcttttattttacttgcctaaactttgagcacttaatgctctaacaaccctccttaggaaaagaatgcttttcatttctactagcaaacactgaatttagtctgctggtctttgctcttattccgtttggtgtctacttcataactcacctgaaaagctttcgttagggaataatgtctgttgctgcagcttccctggaatggattttccagttaaggatatgaattattgcctaattactgctaattattctgtagcttcttgtcagagtctattcaaagagggcaaatcttgtttatcccaatatttataatttagctgtacatggcaaggcaaattttaaaccaactcttgatgattcctttacaaggactgacatgttccagagcaaaacagacattcaagattttttctagcttgaatatccttttagatttgagtgatgataggtgagttgtctttggagctagaagctcaggttatgttggaatactagactcattcatttaagtcccttcagaatggttactatgcctatattagaaaaatagttataattcactaccatccctctgttaatgtttttgctactcctggagagaattgagataattgatggcctcatctgttctctgctatagctactacatacataatttgagcgaactttgtaatcagagaatcttagctttaagttgataaccacttagagagctacccagacctcaattgttaggaataaatggaatgaaagcaagacaaagagggtgcttctgactagttaattgttgatgtgtggttttaaattaatccctgtcagtagtgaaa

SEQ ID NO: 93219 - DNA, 1054 bp, Homo sapiens
caccctctgaaaggccccagtgtgtgttgttcccctctgtgtgtcatgtattctcatcatttagctcccacttataagtgagaacatgcggtatttggttttctgttctggtattcatttgcaataggtcatttctttccattgtctgggtgtgccacagtttgtttatacattcacctactgaaggacatcttggttgcttccaagttttggcaattatgaataaagctgctttaaacatctatgtgcagattttgtatgtgcataagttttcagcacctttgggtaaatgctaaggagtgtgattgctggatcatatgattaagagtatgtttggttttatagaaacttccagtctaccaaagtgactgtatcattttgcattttgcatttgcaccagcagtggatgagagttcctgttgcttcatgtcctcgtcagcatttagtgtggttattgttgtggattttggcctgataggtgtgtagtagtatctcgttgttttaatttgcatttccctaatgacatatgttgtggagcaccttttcatttacttgtttgccatctacatatcttctttcgtgagatgtctcatcagttctttgacttattttaaaatcaggttgtgtgttttcttattgttgagctttaagagttctttgtatattttgagtaacaatcctttatcatatgtcttttgcaaatattttctgtgtcttgtctttttttgttttgagacatagtctcacactgttgcccaggctggagtacagtggagcgatctcggctcactgcaacctccgccttctgggttcaaaggattctcctgccttggcctcccgagtagctgggattacaggcgcccgccaccacacccaactaatttttgtatttttagtagaggtggggtttcaccatgttggccaggctggtcttgaactcctgacctcgtgatccacccgccttggcctcccaaagtgctgggattacaggtgtgagccactgcgcccatccagcccgccgcacctgtcttgtctttgtattttcttggcagtt

SEQ ID NO: 93220 - DNA, 8056 bp, Homo sapiens
cttcaagtattatagcactattttaaaatatttggttggtgcaaaattaactgtggtataattattaattatattttatatttttctatagattattatatacctgaaattctagtaaagatgataaatatatattagaattaataaacatttaaccaagttgctacatataaatattcagaagcctacttaataactttttaagtgatctcatgataggtttgaatacaagagacaatggcaatgtgttagtttcacaattaagattcagtctggtgcagcagtatacaatggaattattactgtttatttgaatctgtgtgtgtttgtgttcttttttctcattttacctctggacatttgtaaagcttgtgctaaatagaatgtttacaaaatatgtttgtaatacttctgtatttttcttgacttaaatgttagatactggatcagcattaaggaattactattttgtagatacatggaaatgatttttacatccattttctccatggcagcccctttctatattggtagacttcttatagtttataagatatgtttaagtcaaaggagtattgactaattaattttattttgagtgttacataggatattcagagacagaaattaattgttgtgttccttatcacatctcttctttgttttgcagtgggacttctcctcttgcatgcctgaatgcaatgcttcacacaaactccagaggtgaagagggcatcttctataaggttccaggtagaatgggagtatatactttgaaggtaaatattttgttggggagtcatttagaaagaaaaaacaggaagtgaccacatataaatatttgactcgtagggacagaattctgttcttgaagagcttattttcaggaagaggtaatattttgaaacctctacccaatacattttttaaaaactaatctataactaactataggtagatcagagaagtaactttattttttattcttgatgataatcttatctagaaagaacgaaattaaaatgacttatggccaggcgtggtggctcacgcctgtaatcccaacattttaggaggccgaggtgggcaaattgcctgagctcaggagtttgcgaccagcctgggcaacacagtgaaaccccacctctactaaaatgcaaaaaattagccagggcgtagcggtgtgtgcctgtagtcccagccactcaggaggctaaggcaagagaattgcttgaacccgggaggcggaggttgcagtgagccaaaatcacgccaccgcactccagcctgggcgacagagtgagactttgtctcaaaaaataaaataaaataaaataaaataaaaaataaataaaatgacttctagtgttttaaggagccccacaacatttgtataataattgtttctttggagcattctgcttagatgctttacattacattctcatttcattctctctcacaattcacagttggggtgaataccatttaataattttttattgctgtttgttttgttagataagtacaaaaagacaggaaaaagaaatatgattacaattaggaaaatgtatatttttctatagactattatatacctgaaattctagtaaaaatgataaatattccatttttatgatggagagccccacaacatttgtataataattgtttaagaagcctcacaacatttgtataataattgtttctttggagcattctgcctagatgctttacattacattctcattttattctctaccacaattcacagttgtggttattattccgtttttataatggagaaagtcaaagttcagaagattggattttcttgcccagtgttgcccatatagtatcagaaccggtataggaacccagatctgactgaattcccaagcccatattctttctaacataacaagcttgctaatttctttcttttctttctttctttcttttgacagtctcgctctgttgcccaggctggagtgcagtggcacagtcttggttcgctacaacctccgcttcctgggttcaagcgattctcctgtctcagcctctcaagaagctgggattacagatgcccaccaccacgcccagctaatttttgtatttttagtagagatggggtttcaccatattggccaggctggtctcaaactcctgacctcaggtaatccaccctcctcggcctcccaaagtgctgggattacaggcgtgagccaccgtgcccggccttcaagcttgccaatttcaaattcctgcactgagaagagacctttacttatcaataacttttcacttacgaacaggaaaaccaactcaaatgagtttgagtaagacaatttattagcttatgtaactgaaaattctaaggaaacccaggctggatccaggaactcagttgacatcatcagggtttggtgtctccacttccttttgacttcgctctcagtcagagtttctcctcatcatatataacttcagccccaacctgcactctgcaagctgtaaatctgaagagagataagaactaaagcaggagcctctgactttattctgatttggcttaattggtttggcttcgcccacatgagtatacctgaattatcacacttgtcaaatgattggccagttgtagatgtggttgagattaagcttgctcaagccaggtgaattgaggagagagttttccccaaaggaaatttatcagctgaaggggaatgaatgcttggtaggcagtgactgtgtccatgcatatatgtgttaccttttagctttgagctgcagtcatcactgtgcccaatggttgtgtagagcctaacattagaaagatctaacctacctacccacctgcctcctttttatatactttgttgaatttcctggggttacagggctctattctcacatggaactttctgtatttctttttggttttagctgttctagaccttccatactgtttaaaaaatttattaaatgcctattctattgtagagattggggggaaaaaaaaaccaaagtgttttccctattctcatacaccgttaagtacaatacttctaacaccagatgtgtggaggtttctcctcacataccaagcaattctccagcagacatcagctggatgtcctttaacaattagagttccagtctgtggcccgttaggaacccggctgcacagctggaggtgattggtgggcaagcaagcatgactgcctgagttctgcctcctgtcggatcagtggcagcatgagattcttgtaggagtgcgtactctattgtgaactgcacatttgagggatctaggtcatgcactctgtatgagaatctaatgcctgatgatctgaggtggaacagtttcatctgaaaccatcccactccctgacccttcagtgaaaaaaattgtcttccacagcaccagtccctgatgcagaaaggttggggaccactgctgtaattcaactccattctgatgctatctatctatctggagacagtgtcagattccacaggttgagggctcagtaccctcccatccccttcagatgccaactgtcgcaagtcccaggttgtgacctgtacttctgactgtctggttataattggggttccctccttgggtttgattaatttgctagaatgactcactgaactcaggaaaatgctttacttacatttacccatttattataaaggatattacaaaagatacagatgaatggccagatggataagatgcttagtgtgaggtttgtaggaaggtacacagagcttgtgtgccctctccaggcttgccaccctccaggaacctccatgtgatcagctaaatcattcattcattcattcattcattcattcattcattttgagatggagtctcgctctgtcgcccaggctggattgcagcagtgcaatttcagctcactgcaacctccgcctcccgggttcaagcagttctcctgcctcagcctccagagtagctgggattataggtgcttgccacctcgcctaactaattttttgtatttttagtagagacagggttttaccatgttggccaggctggtctcgaacccctgacctcaggtgatctgcctgccttggcctaccaaagtgctgggattgcaggcatgagccaccgcacccagccgtgatcagctaaatctcaaagctctcagaacccaatccattgggtttttatgaaagcttcagcacatatgactgattaaattattggccgttggtgatcagctccaccttcagtctcctccctccctgagattggggagtgagtgaaagttccaaccctctagtcacatagttggttcccctggaaactaacccccatcctgagactatgcagtagctcaccaagaggaagaaaagatgctcctatcacccaggaaattccaagggacataggagctgtgtcagatgctccttttactcaggaaattgcagaggtcttaggagctctgtgttggaagctgggatcaaggaccaaataatagcaaaagattctactagtaacactattgcttaggaaattataacagctaaaaagagctctaggccaggaactgtagtcaggaaccaaatatatatttcatactatatcacaatattacctctgtgctggacactatagagactgtaaagagggttaagctgtggcccctgagctcttgaagctcacattatagttcctaaaataattgcctgctctcaaaatgttctttgcttttaaaaaatgtgataatatagagaaataagaattaattttgaataaaggaatgtagccgttttttgttgttgttaacttgtaagatttgagctggactttgtcagataagtagtaagaagaagggccttccaggacataggaatagcttaagcaagggcacagttggaaagattcagagtggacttgaaagtagagtaaattggagtgattagaccataatctttgcgtggacttaagtggtaaagattccagtgtggtaaacgttaggtagagatcaaacattggaggcctttgaaaacctgactgagcagtttgtgtatgggttgttgggtggtagatgtcacaggtttttcaggagaaaagcataatcaaatccaagtttaagagaataactcaagtaggatagatttaagagtgaagcaggaaaatttgtcagaaaggtggttatggttgtttggaagaaatactcagggcctgaattaagagactagtaaaagagatggagacaaaggacattagaggaataaatagaatatgtagcatttggagtgggtaaaaggggctgaaatgattctagaatttggggcataggcagttgatcctgtacggatcacatattttaagaaaagaagataattatatttatatttcagatacttgttgaacctatatgacaagatgtctggctgacaactaactctataaaagctgtcctgcattttgaaggaaataatagaaaaatatagggtgtgtattttaagaaagtgtataacataagagacggctcagagagaaatggcactaggacataaatttaaatgaaaaatacctaacttaactagatcagagtttatagtcttggctataatgtcatacggatgtcagttttatgtaggagggtcacatttttgtgtctgtcagaattattttttatctgattgttaaaacgatgtgggaaaataaaatattggaggtaaaaagaaccactgatagttttatagcttagaaataacattcacaggctaggcgcagtggcacacgcctgtaatcccagcactttgggaggctaaggcaagaggattgcttaagctcaggagttcaaatccaggaccagcctgggcaacatagtaggaccccagctttataaaaaaatttaaaaaattagccgggtatggtggcacacacctgtagtcccagctgctccagaggctgaggtgggaagattgcttgcgcctgggaggtcgaggctacagtgagctgtgattgcactactgcactccagcctgggtgacagagtgagaccctgtctcccaaaataacaaaaaaccacaaacactcactagtgtgtttagccatacatgtgtatttttatatattatgtaaacacatagtagctgatattttttgacctcttatgttgggcgtgattctaagcattttacatttattagctcatttaacttgagctaattgaagaatgatcttttaaggtaggtactattatccccaccttatagatggggaaactgaagcatgaaaggttaagattttaactgcacaattaggagagggtaaagccaggaagtcttgttttctagtctttggtcttggaactatcctgttattatatctctcacatgctaagctgacgtagttatcctttctgattagcattctctctcagtgcagaaaccaaagagtttcatatgatttgttaaatgatttctttctttttctttttttctgtcaggaagaaccttcatttaaaaaaagatttcttttttatttaattcttgctacttactaaccaatattcaggaaccaattagattcaaataatgcactatctcttactgtctagactcttactctgtaattgaattcagagtacatagtggtacttacatacacacatggacatacatatatttaatgaaattattttatttagttttttgagacaggatctcactctgtcacccatgttggagtgcagtagtacgatcacagctcactgcagcctcaaacttcctgggttcaggtgatcctcccaactcagcctcctaagtagctgggaccacaggtgcacaccactatacctggctaatttttgtatttttttttgtagaggtggggtttcaccatgttgcccaggttggtcttgaactcctgggcttagtcctcccaccttggcctcccaagtagctgtgactacaggagtgttcgttccaccatgcccagctaattttttttttttttttgcattttttttttgtagagacgggtttcaccatgttgcccaggctggtcttgaactcctggtctcaaacattctaactgccttagccacccaaagtgttagcattacaggtgtgaaccaccacgcccagccaataaaattattatgtagtttttaaaatgtaagagtatttaatcatttacctggactcatatctacccaatttttgtctaatttaagcctgtgttgtgcctgcatatgaatgttgtatataatttttatcttcggatatagttggaaacattagcttatttgcctcaaagagatgacaggaattcagaaaatattgctggttctgctactgaatcctatagtaacaaaaattagtgcaattaagttgcaacattgcatatcagaagttttaatttctgtttgcttaaatggtaatgattaatcctaattggatgcctacattttcagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaaggtaaatccacctgatccttcaataaagtactaaatgctgtaggacaaatgcccttgttagtagttcctcttttcccagactccaggtcagtcagtcactttcccttaccctctataacagtcctgtcaaggagagttttctgcaatgatggagatgtttatatctttactgtccagcacaacacagtagccagtagctacatgggcctattgaatacttgaaatatggttattatgaccaaggaatttaaaaaataaaaatgctttcttttttagagctgtttcaggttcacaataaaattgagaggaaggtacagagatttcccatgtacccctcccccgccacatgcacagccttccccactagccacattctccaccagagtgctatatttgttacagctgatgaacctacattggcacatcatcaccca

SEQ ID NO: 93221 - DNA, 1012 bp, Homo sapiens
ccgagagatggatgagcagatgagactgatggaccataacctgaagtgtctgagtgatgctgaagaaaagtactctcaaaaagaagacaaacgtggaagagatcaagattcttactgataaactcaaggaggtagagacctgtgctgagtttgctgagagatcggtagccaagctggaaaagacaactgatgacttggaagataaactgaaaatgtaccaaagaggggcactctgtacaaaggatgctggaccagactctgcttgacctgaatgagatgtagagcacctcagtctcaccctgctgctgctcctccctctgaccctgattccatctgaggccagcctacccaaagctgacctttataactggaaggctgctttctcctttcgctgcccccacctcccctgtgtctttttcgctaaactgtctctgcctcttcccagagattccagctgggctagaggctgtgcacctttgggaacaacacttaagggaatgtgaacacaatgcataatgcctttaaaagcatgttgtgatgtacacattttgtaataccttttttgttgttttatagcaaccatttgtaaaacattccaaataattccacagctctgaagcagcaatctattcctttttcacttttggaaggtgacttttcagcttaatgcatattgccctttccatagagaagaggaaaaggtataggcctgccttactgagagccaaacagagcccagggaaagaatccattatgggaaatttcactgctctgtaaaaagtaccccccaaaccagaaaggtgattccaggaggagttagccaaacaacaacaaaaacaaaacaaaaatgtgcttttcaggttttcagctttaagatatctttggacaatgttatttcttttttttttttcattagaagtgaccaaattaaaatggtaagacctctgaaactaaatttttgtcccaactctgccccctctcaactgcctgcagaatggatcatgtgcccctt

SEQ ID NO: 93222 - DNA, 1253 bp, Homo sapiens
cctactctgaaatttttcttacaattttcacatctgtctcagtgttggtgtcctctaattgtcttctttgattcagatagcgattttccattgaaccctggatattttggctatcatgttaggggatgtccagtcttatttaagctggcattcactgtgcttacttaggtttaccatgcaggtcctggactgttttagtggattgtggttccaataacagtttaattttcagatcctttgcagtggtatttgggtctgcttgttttatctggtgccacagaggctcccattgacctctgctgcttcttattgatctctgttgcttctgtttgaggcggtgggaattttcacaggctgggttgcctgatgcctgtagatgtggacaaaagggagtcttcagcctgtggggacagacaggcttcctggcaggatcccctttgcttgagctacttggctgctcagcatcttgtgagagcgggaggtgttgtagtctcaggcccacaaggacaaagaggcttcctgggctggactatttttgtgatcttctcccacttgcttgtgccatttggcctcccctagtctagtctttatttttgagacttgagggaacataaacttgcaacgaaagtcatttaataatctcctaagatctaccataactaagttacttctcttagttgggaaatgccaggaattggtaaaattaatgggtcaaccaactacttcaaaactctgaatctcaatataaatggctacatcaggactggtaactctggttcaaagtagaaaataattgtaataagtagtgttagctgtttagatatccaagctctgtttgctaaatcaacaagaataccaagtaggacaaaggtataaaattgcgaaatttctgtcttttggtttacttaattgaatctgttgatttttattctctctctccagctgagttctttcagaaccatgcccatagtttatattcattcataagtattttgttttcctcactaatactccttttacctcagatgataaaccctcgtgtgtgtgtgtgtgtgtgtgtgtatgtgtatgtgtctccctttctgtgtttctgtctctgtctctctgtttgtctcaggcaggagtgcagtggtgtgatcatagctcactgcagcctcgaccttctgggctcaggtgattctcccaccatagcttctgtagtaggtggtattacaggtgtacactgccacatctggcctactttttatttccta

SEQ ID NO: 93223 - DNA, 1795 bp, Homo sapiens
agtgtatatagcaagggaaataaagtcaatattctctactacttttcagcagaaatccttatccctgcagagtagatcatttgattatttgccaagctgaattgccttgaagtgatttcattagaaagagcttagttttagaatgaagaacattatttgtattgataatatatctaaggttggaggattcctttgtggttaagcctgcatcttcctcctctttttctttttaaacattttaaaaatattttttgtagagatgaggtctcactatgttgctcaggctcatcttgaattcttgggctcaagcaatcctgctttggcctcggcatgaggcactgtgcccagccatcttccctatctgttagttgcaatctgctttcaagcccacaaacctggtagggatgtcaagaaggattagtaatgaaaaaaatgacaacaaaatgcttggatattgacagaaaagagtattcttatccattgtaattcagatccataagagctccattatgtatcacagggaagctaataaaccttaagtccacagctgatggcgttatgatggctccttgaaattgaaatgcatgggaagaatattaaagaatgggaagtattcattgtatccacatttaaatgccctaacagttttactctgttacataatcaaattactgcaactgttttctgaagtagtttagactgtttagctaaatttgtttatctttagacattttgatatgatatttttggctaatttataaattttaatgaagaaattaatgagggggttactaatttggggaattgtggatattgctgggatgggaagggacagtttaatttttggttttattgttgctttgtaagaaaaattaaaagctttttttttccttctttcattttcctgcactgcattccaactccagaaggtaagaagtattactttattctaaagaagtattatgcaattataaagcacacttttataaatttaattgaacttacctttggatgcatgagttttactttataaaactaaataattagtccagaaactaagtaatatcgatattattatgttagtgtttattcgttaagtgtgctttgtttggttcttgcagtttgtaattattgtttgatcataagtttagaaatccgatctacattaaggtttattaaaatcaacatttgacttataaaagcgttgggatgccaagtattctgcagagtaataatgaaagtatttagtagactggaaacatgtatattaacatttgctttatggctgtaagattgaaaatgtatgtttgtgctcttaatttagataaaatattggtaaatcggctgggcatggtggctcacacctggtaatcccagcactttgagaggccgaggtgggtggatcacttgaggtcaggagttcgagactagcctgaccaatatggtgaaactgcatctctactaaaaaatccaaaaattagctgggtgtggtggccggcgcccgtaatcccagctactcgggaggctgagacaggagaattgcttgaacccacaaggtggaggttgcagtgagccgagatcatgccactgcactctagcctgggcaacacagcaagactccgtctaaaaaaaaaaaaattggtaaatcctttaggggcatgatacttaaaaccagggcagaatgggttaaaaatcagtctggatcctttactgaattgactttttgtgtgtgggcatggccttttagattcacctccactatagcagttcccgtgttacacgcctgtgagacctg

SEQ ID NO: 93224 - DNA, 1223 bp, Homo sapiens
aatggtgttagttacttatttctaaatggtacacaacattttaaatgttttgctattgatttatagtgactagtttcctgtctgatttgagaggttctgacaaattttttaagaaatggatgtaaccatgaaatcctaagtagaggacccagctaacctgtacccacaatcctgatacacttgagactgtgagataaatttgtgttgttttattctgtatgataataaaacttacaaataaaatgaatctgtgttgttgaagctgcataatagcaatctaatagtaatactaaaatttgggagtatgatagagcagggttgtcttaaagaaggtttgacttgggtattctaggacgatggataaagtatttacaagtgaatgatcggcaagggcattccaggcagagggaagagctgaaaagaggaaagactgaaaaatgcagcgtatgtttgatgcatggctaattaacctgtgagtgttgtgtagcataatggaagacaaaaccagaaaaggtcggttgggccaaaatgtggagggttatagaagctgggctgacaagtattttctgggagtaatagagaatttttaggcaggagataataatgtatctgttttaagcagattggggcatttgtgggatttattatagagggcaggaaagactggtgggaggagataaaactttcttttgtcgtctttcacatttttctcattgcatacctttttttacctatacttatcccacttgcagcttttcaacacctttacttaagatttttttgttttgttttttgtagagcctgtgttgcccaggctggtctcaaactccaggcctcaatctatccttattccttggcctcccaaaacactgggattacaagtgtgagcctctgcacctggccttctacttttctgcgagcctcctgaagtttccacacataaaagaggtcttggaatactctgtagcacaatacaattctcatttttttttagatagaacctgtctctactaaaaatacaaaaattagtgccaggcgcggtggctcacgcctgtaatcccagctctttgggaggccaaggcgggcggatcacctgaggttgggagttcgagaccagcctgaccagcatggagaaaccccgtctctactaaaaatacaaaattagccaggcatggtggcacatgcctgtaatcccagctacttgggaggctgaggcaggagaa

SEQ ID NO: 93225 - DNA, 1688 bp, Homo sapiens
agcgccaggcgtcagactacagctactgccggggcctccttggcgcgcatgctcctgcggagaggcggagaccggaagggcgggggcgtggcgaggtaccgcagaccgccggctcgatagctcagcggccgggcttgggaggcgggggcgcgcccgcgctcgttcgcgcggccggctgcgtacagtagtgacggccgcgcgggagcggtcacatgaccgtagcggcagcctgtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtaagggggagggagcgaaggggaaggccgggaggattttgttcccttgtcgcccgccagtcgcagggaaagggaggtcactggcccagggacccggctgaaggggcacaaaaccgcgcggagagggcggcggttagtgtcggggttgcgatccctgtgggaatggaggcgcccggcggaacgtgatagccgcggggccgtggcgtccctcggcgtctgcggcgagtcctctcagtgttttgaggctgtcttttggggtcgagccgatatcacctccgctctgtggtagccctcgccccggcacggggaagtctgtggtgcttgcacggtaaccggttcttctcccttgtgcggctggagagcccccattggatgcagataggagaaggcttgtgcgtgcatccagccccggaaaggagaggggagcgctggagctggatagaatttacccgttacagcggacgtgcctgtgaccccgggccccctgtttgtctggctcccggagcagacgagagatcacgaggcttttgtttttgtttggtgttggagccgaaagtgcaggaggtgtttagaaacgaagtaacaggtgggacttgtagaatttttttttttcctgtttccgtagagacctactctgaacaaggcagcaatgcatggtgggacgtgtagtttacccggccttcacgttaccctagccaaagggatggtgccctaatgaagttgtaattagtgggcaaaacaattttccccctaattgtgttatgacgaaatttagaggtagattttaaaaagtggaatattgaggattagtgagaacttttaccatattttaagaagaaaaaattaaaagcatgttgtatgcagaaatgaaatggcaggagatagtgaagttcatacatcgttgagggtgcagcagaaaagtaatagggcattaaacggcagcattttaatagtggaaagtgagaggtgttcacccctttaatggtgattaatgccggtaatacttcgacaacgtagcccttcttagtgaacccttattagatgccatatggtttattttttaatgagttttttaaatataaaagtaatgttcactgtggggaaatttggaaaattataaaaaagtataaagaagaacatttaaaaaaaatcacat

SEQ ID NO: 93226 - DNA, 1051 bp, Homo sapiens
gtcacggagcttgcttttttttttttctttttttttgagacagggtattgccctgttgctcaggctggtctccaactcctgggctcaagtgatcctccccaccttggcctcccaaagtgctaggattataggcatgagccactgtgcccagcctgtcatggagctttattcaagtagagatgagagagaaataaatagacaagacaatatgggatatttataaattctaggaagacagtaaaacaagctgatgtgaaagacaatgactgggtggaggcattgttagatgacaagaaaagcctctctgagaatttgatatttgagctgagacagaagtaaggaagacaaaaagcaactagccctctaaggatcagggtgtggagcattccaatgagagggaaggggagtttcaaaagccataaggcagaggagagagtttggaatgtcaacagaacctaacaaagatctagaatggagtgaagtggagagggatctgggaagatgtgggagaggtaggcaggactgaggaagtggaggaggaggtgggagatttgcagagagagagaatgtgtgaaaaagttgctttggagaatggaggaaagaatgtattggggaagtgtagtgggactgcttggcagcgttgacagtccttttgagaggtgtggtcctgaatttaaactagaactaattggcatagtagatgttctgaggattaggtaaaatgaacgggaggtttggattcatagctgatgctcaaaaatgttaactatcacaagatgtagaaaatattagaatgaaggagaggaaaccaacccatttatttttgctaccatttgcaactcaggaaaggtagataacacgctatgtgttctgatcttagatttaagactaactttttcttctaaagtgagatttttgcttctggatttttattttattttattgatttttttttacagaatcttgctctgtcacccaggctggagtgcagtggtgcaatctcagctcactgcaacctccgcctcctgggttcaagcaattctcatgcctc

SEQ ID NO: 93227 - DNA, 1034 bp, Homo sapiens
gacagggtttcaccatattggccaggctggtctcgaactcctgaccttgtgatccacccgcctcggcctcccaaaatggtgggattacaggcgtgagccaccgtgcccggccttaattttttataatttttgtagagacaaggcattactttgttgcccaggctggccttgaattcctgagctcaaggaatcctcccacctcagcctcccaaagtactgggattacaggcatgagccactgcacccagcttggaagtgaatttctttgatcagtcctttgtagaactagttccttgtattccaaatacaggaacttgtttcattttagtatatacacgaaatgtgcttctctagctttttcagtgctcagacaaaataaagatgtctgctggtaaacttctaagatgttttaaaatgttaattcacaacatttggtacctgggaacaactctgcagcctaggatatcacatctattacaactttaaatataatctccttcacaatgcagtaatggaaaaaatcacacctgagatttcctgtaatttcatctcactgatgagatctttttagacaaacccctttttgaacctccttaaggtttaatagttgtgatatcagaaaagcacttcttatggagcagaaaagcagaatgaatgagagttgaacagaacaggatctggagaaaggcttaaggataggatgttttatcactggggacctggggaagaggggctgggagacagctaggtgctgagaggtgagaatgacaactggttggcaggaggctagtgaggagttcagcaagggataagtgggtacaccaaccagagggcaacaggcaatggcgaggaacccgagagcaagcaatgtgtgggattctaggcacagagtctgacagcagcgcttagacagttccaaaggttgagatgaataaggaaggcccccactgggcatggcggcttacgcctgtaattcctagcactttgggaggccgaggcgggtacatcacctgaggccaggagttcaagaccag

SEQ ID NO: 93228 - DNA, 1051 bp, Homo sapiens
aatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccccagtccgagggctgggcccgaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaatgcagtt

SEQ ID NO: 93229 - DNA, 1116 bp, Homo sapiens
gcacagtgactgggcactgttcaagcctggcatgatattcccaccacaggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtcagtacctccatggtcccaggcagcactggacccaggaggcaggggaactgcaggcgctgggtgatgctaaagagggttttgctggtacccgaagggcaggaagggcaaggggtgactggggatgtcagaaggattcctgcagcaacaggatggggcaaaggagaggacccactttcctgtttcctgtatttccctaacctcccctttcgcctgcgtcatctcccctgcaggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctc

SEQ ID NO: 93230 - DNA, 1041 bp, Homo sapiens
actaaaaatacaaaaaattagccaggcgtggtgccacatgcctataatccaagctactcgggaggctgagacagaagaatcacttgaacccgggaggcagaggttgtggtgagccaagatcatgccattgcactccagcatgggcaataagagcaaaacttcgtctcaaaaaaagaaaaaataaaataaagtaaaattagccaggtgtggtggtgcatgcctgtaatcccagctactcgggaggctgacgcaggagaattgcttgaacctgggaggtggaggctgcagcgagctgagattgtgccactgcactgcagcgtgggtgacagagtgagactccatctcaaaacaacaacaaaaacacaatatactctaatagaagtgatgcaggtgtgtctgtctctcgaaacatctgattgtactgtacttgcctattttcagaccacagtaactgagactgtggaaagcgaaaccacggatgagggggacaactgcactagcttcagttgtcaagctgtattagagcaaggagaagaaaattccagaacttgcagtctgcagggcctcctagctacctgaatgatatttaggtcctcatgatgtcatttgctgtttgtgttccacagaaatcctttctaatatagcctctttcctacagcagtagcagccagatgaagaagcggccaacatctgcagtgggctacaagaggcctatcagccagtatgctcgggttgccatggcaatggggtcccaccccaggtacagggtaagaagcggagaggggagaaagagcctacgggagggaggccgggcgaggtgtctcacacctgtaatcccagcactgtgggaggccgaggcaggtggatcacctgaggtcaggagttcgagaccagcctggttaacatggtgaacccctgtctctactaaaaatacaaaaattagccaggcgtggtgatgggtgcctatagtcccagctacttgggaggctgaggcaggagaattgcttgaacctgggaggtggaggttgcagtgagccgaga

SEQ ID NO: 93231 - DNA, 1051 bp, Homo sapiens
tttttgtcactgtccactttgctatgtctgatgactgcaatttgcagtatttaatatttatttcagaactttaaaaaatacaaaaatagaaaaggcaagtaaaaaatggttctaggattttttttttttttagatagaattttgctgttgttgcccatgctaaagtgcaattgcgcaatcttggctcacccctacctctgcctcccaggttcaagtgattctcttgcctccgcctcccgagtagctgggattacaggcatgtgccaccacgcctggcaaattttgtaattttagtagagacggggtttctccatctctactctccatctccagcctgttggtcaggctggtctcgaactcccgacctcaggtgatccgcccacctcggcctcccaaaatgctagtattacaggcgtgagccaccgtgcccggccagttctaggattttttatatgaaacaagtttttaaaattactctttttaaagccaagataagatggttagaataaagtaaaaacaattccacggtaattgaaatcccagttgtgattctgacttagcagagagagtctggtggggcacagtagggggcagggagctgctggcctggatctctgaggtcatctgccccatgtccctcatttcaccacagaaggttgagggcagggaggtccttgaacaaggcagctttcctcatttcaggaaccatggggtctgaggctgcagctgtgaagcaaacttctccactccccagagaaaaggtcctttcttcagcattggatcccaccacttgccgcatcacttaattagggctaaaaaacaaacagaaaagttatttctctccaaagcatatttaactaattagggcgttgttccatttgctcaactcaagtgtggaatattttgctttatttcggcctgtggtattctggggatgagaacactaagagctgctcgaagtgagaggaaaaaacattgtttgtaagaaattacctgaagtcatgctgtcccattagaaagcttctgttcaaaaaacattcttcctccacct

SEQ ID NO: 93232 - DNA, 1049 bp, Homo sapiens
acagagaaaaggacattgggcttggagttagggcggtggtggtcaaatatcactctgccatttactggctccaaaccttgagcaaatcacttcgcctgtctgggccttagttttcttttatgtcaaatggggatcataaccattatctcataaggttcttgtgagcatcagataggacgattaaggtaaaaaggagttaacccagttgaggcacatggccagttgcatctgagactcctgtctcctgcggaatgtcacagataggtggcagtggcagggcagagcctgtttggcttctctgtccttgtaaaatcatacttgatgctatctttccagaagagtggctggctgggcctggctgtctccattctagctttccacgtcagtgctttatgagtactggggcctcctttctccccgctctggttttgcactccatttgctcctggaatagttaaaggtgagtctctgagtatccccggctgtgtctacaagctggcattgtccctgtagtgacctggctgttgtcacagcagctgacctgcctctgatacctggaatcagagccttagtcaaattgggaagttatttggaaagcacatagtcaatataagagcagctagacaggtggggcgtggtggctcacgcctgtaatcccagcactttggaaggtcaaggtgggtggatcacttaaggtcaggagttcgagaccagcctggccaacatggtgaaaccccatctctactaaaaatgcaaaagctagctgggcgtggtggcaggcacctgtagttccagttacttaggaggctgaggcaggagaattgcttgaatccaggaggcagaggttgcagtgagccgagattgtgcctctgcactccagcctgggtgacaaaatgagactgtcttaaaaaaaaaaaaagagcatctagacagattccttaattaggagactcaggcttcaaggactccacttctaggcctttgtttcccatctataaagcatgggggttggggttgatgattcccaaagtccccttggttaccctgcc

SEQ ID NO: 93233 - DNA, 1033 bp, Homo sapiens
caaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccaggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggtaagggccccagaggagctgggcactcgagatgtccccgcaggggatcccggcaaggaggctcttctttgagagtctgtgacctggcctgaagtggaggttctccctcagcaccgcacactgccctcctgccaaatgtgcccccagagcagccaggcaaattgctgtgataccgggctgccaggtacatgcacaggcacacacacacgaagcaacgtggacaggcggtctctcaagccagtgagcttggggtggtctgacctgctgtgggcatttcctgctggtggcctcaggatcagtcaggtctgtgggatggccaggcagcctcttgtgaatgtgggttcttgttccttcacagcc

SEQ ID NO: 93234 - DNA, 1070 bp, Homo sapiens
ggctcaccacaacctctgccttccgggttcaagagattctcctgcctcagcctccctattagctgggattacaggcatgtgccaccacgcctggctaattttgtatttttagtagagatgggctttctccatgttggtcaggctggtctcgaactcccgacctcaggttatccacccgccttggccttcctaagtgctgagattacaggcgtgagccaccgcgcccagccttggtaaattattttgtgtgtgtgtgaaatactgggttgaatcacatgaattctcattttgtaggttaataatgacggcatattgacttcaggccagatcgccggatatcagctgagtgactcttacaagtccttctagatcctgaagtggattaggtgccgcagttgctgctcgtgttgaatccagaaccgtagccagacataggactggaggacgagcgaaagatgctgaccgagtctggagatcctaaggaggaggaagaagaagagggggaattagtgtttctacatcaggatcccctaacaacagtgagagagcaatgccagcagttggagaaatgtgtaaaggcccaggagtggctggagctctgtgatgagtgtgtatcctctcaatcacatacagaagaggattgcacggaggagctctttgactttttgcatgcaacggaccattgcgtggcccacaaactctttaacaacttgaaataaatgtgtggacttattccccacaggcttcatcacctgggcatcaggatatttccttatggttttggatatgccatttgtttcttatttctgtaactgtaagttcacatgaacctcatggattttggcttagtctggtagcttctgtgtaattcgcagtgatttcatcttaataaagttctgtgatctgcaatctgcaaaaaaaaagaaatgactgcatattggcaattacacatagtttaattgaataaaacacattcagaaaggtgcatggtacataaacacacggcttaaaaaagtattattatttgagacggagtttcacttttgttgtccaggctggaatgcaatggc

SEQ ID NO: 93235 - DNA, 1025 bp, Homo sapiens
agcatttctccttcctggcatgggttcacctcagccccaattcagtggcagctctgttggttcagaggggtgaggtatccaagaggaggaagcttgtacaatcctgctagcaggggagggctgatggtagggtggagtttcaaaggaagcctctgacatctgacaaaggctgagtcagttatattgccccatctctgaatctggcttctcctgctcctctaccctacccatcctgccttccagacacaccaaagttctttttatccctgaccatgacaggcatggctgctgtgtgcagcttcataggttgtgcactgcacagttccaggaggtgctattcccatagacaaaggagtgaataacaactccaagaatcatgcacaattgtaccaggcagccccgagccaagcccttttatgacttccttcctttccacatattgcttcccctgccacaactgcccttgtttgcctttcctccccccatttctttatatggtgcaacatctaacacttagttctcaaattctgcccaaatataatcctggtgaacacaaacataacagaatgcatatggaagacctgacatacaggagtctcgaactggcacattgccagctcattaagcttggtagttttattatgcctgtggggtgttctaaaaggtaatgtaagtaaagtccattagaacagctaagatgaaaaatacacaatactaagtgttggtgaagatgtggagcaactggaactctcatacattgctagtgggagtgtaaactggatagctactttgggaaactagcggtatctactaaagtagaagagatacctagtcatgatctagcagttcctagaaatacatacacatgtactcctagaaatatgcatacatacataggcttcaaaaaaagtgcaaaaatgttcacagcagcactatttataatagccccaaactagaaacaactcaaatacccatcaaccttagaatagatgaataatatggtatattaataaaatggggatggg

SEQ ID NO: 93236 - DNA, 1509 bp, Homo sapiens
acgccggcgtgagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggacgggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggtaagacctgtgggaggacggtgtacggtctcggtagctgcataccgtttattttactccagacatcttgcttcccgtaatatacgcctttgtttcagtgattccgattccaaacgacacatccaagttactgtttgaatcggcatcgagcttactggggcggggtcttcccatgatttccatccggtcttttgctttcgagtctcccactatgctcagtgccttctgttacaaaatatgcatcatttaaccatgttccagaaccttatttcttcaggcgactggactggctttttccacatttgcgtggaattagtagatgtgtgatatttttaaggtatttatttcagtggttgcgattgaagcagtactagctatttgggaaaggcctgaatttatactttggggcaaagaaaagattccatatggtgataacttagagtaaacttgagggtttctgagaagaataattaaggtaaattagaagggaagagtgagttgccctcattcactaatccattgatgtgtcaaacaatcggaggctcttcgcgcttggggtgggactctggcatatttgcctcagtgcttttcgagacatcaacagaagcagtaatctgagggagatgatcagtttctgtcctcaaacccaacggagtgaagtcaagctctctcttctattttatttgactctagtatttacaggaaagtattttgccagtcatagccctatggacttataatgcactttcaccatgtttcagaattacttagtgtggaagtaagagctaaagagtgacctttttaatcgaatttcccgtttaggaaaggaaaagggaaggctctaggaaagtcccttttgaatctggttagaaa

SEQ ID NO: 93237 - DNA, 1407 bp, Homo sapiens
aatacctgcttcattctcacaaaagaaattatactgaaattaaattggacaagtgattttttaaatagatttttattttgcttaccttttttgggaggcaaattatcataatccttatttccagagtatcatactgttttcttggtctgtcataaatttcatgaaacttagagcttgttctctaacttgtgggttagagaatactagcacttagcgctagcacttccctagcactgtttgcttttaacactccacttttagctgtagctggctagggttaggtgatcagatgggtcagcaaatatttattgagcacctaatgctgggcactgtttttaggcactgggaataaatgatgaacacaacagaccccttgaggagcattccggtgagataatcataatagtgtggaagatgctacaatagtaagcacagggaggaagagtggctagtctaaatcgtgaggagtttgagtaggcttacgtggagatgatacctaaaatgaagtctgggccgggcgcggtggctcatgcctgtaatcccagcactttgggaggccttggcgggcggatcacaaggtcgggaggtcaagaccagtttggccaatatggtgaaaccccgtttttactaaaaatacaaaaattagctgggcgtagtggcaggcacctgtagtcccagctactcaggaggctgaggcaggagaatcacttgaacctgggaggcggaggttgcagtgagctgagattgtgccactgcactccagcctgggcaacaaagccagactccgtctcaaaataataataaataaatgaagtctgaaggactaataggaatagagtcagaggggtaggatagggcctttctggaaaagggagcatagaacaaatgtatagtaaggttgaggatttaattcatgtggtcaactttatttatttattttgagactgagcctcactctgtggcccaggctggagtgcagtggcgtgatctcggcccactgcaacctccgcctcaggggttcaagcaattctgcctcagcttcctgagtagcagagactacaggtgcccaccaccacacctggctaatttctgtatttttagtagagatggtttcaccatgttggtcaggctggtcttgacctcaagcaatccaccgccccagcctcccaaagtgctgggattacaggcgtgagccaccacgcctggctgtgtggtcaactttaacctatccttaggaacagtgtggagtaggaagcaaaacattaactctgtctactccaatctttttgtaaagggtgcatgcccccaactaaaactcaatcctgtaagataatggtataatctttttgtagcccttttacttgggaagatgtgtgatgattttggatcaagtctgctgggttggaa

SEQ ID NO: 93238 - DNA, 2139 bp, Homo sapiens
gtggctcactcctgtaatcccagctctttgggaggccgaggcaggcggatcacctgaggtcggaagttcgagaccagcctgatcaacatggagaaaccctgtctctactaaaaatacaaaaattatctgggcgtggtggcgcatgcttgtaatcccagttactcaggaggctgaggcaggagaatcgcttgaacccgggagacagaggttgtggtgagccgagatcgtgccattgcactccagcctgggcaacaagagtgaaactctgtctcaaaaaaaaaaaaaagtgtcaatcataatatctaccacatagggtagttgtgaggattttaggggttagtgagagtaaagcacttcacatggtgccaggaccaggcactttgtaggagcacagtgcatattagctatatatagaatatgtgactcttctgctgtggaggtgtggcagaacatgttattttatggattgaacatcctgcacaccgtggtacccaagtatttgttggtgctccactaaacaatttctttttttttttgagacggagtttcgttctttttgcccaggctggagtgcaatggtgtgatctcggctcactgcaacctccgcctcccaggcttaggtgattcttctgcctcagcctcccaagtagctgggattacaggcatatgccaccacacctggctaattttgtatttttaatagagacggggtttcaccatgttggccaggctggtctcgaacttctgacctcaggtgatctgcccgcctcagcgtctcaaagtgctgggattacaggcggaagccaccacactgccctcctttgtttgtttgttttttttttttttgagatggattttcgcttttgttgctcaggctggagtgtagtggcacaatctctgttcactgcaacctctgcctcccaggttcaagcgattctcctgcctcagcctcctgagtagctgggattacaggtgcgcaccaccacgcctggccaatttagtatttttagtagaggtggtgtttcatcatgttggtcaggctgctcttgaactcctgacctcaggtgatccacctgcctcagcctcccaaactgctgggattacaggcatgagccactgcgcccagcctagactctgacattttcatactttcaggtaaaaatgttttcacatataagatgttgaatagtgtaagttgagaaaataaatgattctgagtacagcttgaacacatacatgtattagctctgtgcacaggtttaaaataccattgggcggggcgcgatggctcacgcctataatcccagcgctttgggaggctgaggtgggtggatcacgaggtcaggagatcgagaccatcctgccaaacatggtgaaacttcgtctctactaaaaatacaaaaaattagctgtccgtggtggtgggcgcttgtagtcccagctgctcgggaggctgaggcaggggaatggcatgaacccagaaggtggcggagcttgcagtgagccgaggtcgcactactgcacttcagcctgggcaacagagcgagactctgtctcaaaaaaaaaaaaaaaaaaatctaccattgcgtttaaccagtgccgttcaaaagaaataatgtgagccacatatattacttttaatagccacttttttttttttttttttttaagatatagagtcttgttctgttgcctagactggagtgcagtggtgcagtcttggctcactgcaacctccgcctcctaggttcaagcaattctactgcctcagcctcccaggtacctgggattataggcgtgtgccaccatgcccaactaatttttgaattttttagtagagacagggttttaccatgttggccaggctggtcttgaactcctgacgtcaggtgatccgcccaccttggcctcccaaaatcctgggattacaggcatgagccactgtacctggccaaatagtcacattttaaaaagtaaaaaaattttttttctttttgagatggagtatcactgtgttgcccaggctggagtgtagtggcgcgatctgggctcactgcaacctccacttcccagattcaagcaattctccctgcctcagcctccctagtagctgggattacaggtacccactaccacgcc

SEQ ID NO: 93239 - DNA, 1051 bp, Homo sapiens
tggccaacatggtgaaaccctgtctctaccaaaaatacaaaattagctgggcgtggtggcgcatgcctgtaatctcagctactctagaggctgaggcaggagaaccgcttgaaccagggaggcggaggttgcggtgagccgagatcgtgccattgtaatccaacctgggcaacaggagcaaaactctgtctcaaaaaaaaagaaaagaaaaagagaaattgaaaggttgtttgaaaaataggcttaagagagttactgcttttggatgagaagatttcagtggttgatttgaccataaccatcttggtagtatgagctcaggaatgcgttacttattagtgatgtgggaattacatggatttgtccccaaagcacaagcttttagtgggctgcttctatactggatgtgctaccttttggtgtcattaatcctttctccaccacaggcttactcattttttaacagggaatatttttcactgggaattggagtctctcggctccatgtaagaaatcaagttggtaaaggctcttgtccctaagagaggtataatacatacattttgttgtcaggatgattttgctaagttttggaagagtaggttggttccactaacctgcatttaagaaatgattgattaggctgggtgctgtggctcacacctgtatttccaacactttgggaggctgaggcaggaggatagcttgagctcaggagttcgagaccagcctgggcaacttagcgagaccccatctctacaaaaaaaagcttttaaataaaaaattagctgggtgcggtggtgtacacctgtagtcccagctactcaggaggctgagatgggaggatcacttgagcccaggagtttgaagctgcagtgagctatgattgtaccatctcactccagcctggatgacagagtgagattctgtcttaaacaaaaaaccccaaaagaccatccagagtgcttgtctcggtagcatatatactaaaattggaaggatatggagaagattagtatggtccctgcgcaaggatgacacgcaaatttgt

SEQ ID NO: 93240 - DNA, 1202 bp, Homo sapiens
tctttcaactttttttttttttttttttgagacagagtctcgttctgtcgcccaggctggagtgcagtggcacaatctcggctcactgcaagctccgcctcccgggttcacgccattctcctgcctcagcctcctgagtagctgggactacaggcgcccgccaccacgcccagctaattttttgtatttttagtagaggcggggtttcactgtgttagccaggatggtctcgatctcctgacctcatgatccgcccgcctctgcctcccaaagtgctgggattacaggcgtgagccaccgcgcccggccgtctaacagtagaaggttgcccaggcagagctgtggtagcagttgtgaagaacgaaggagtaggagcttgttgagtgttgatttacaagtaagagaccattatttagcacaaaatataaattgtatgattagctgaagagatttgcctgggaaaactgtttattgagatggttaagtcataaaggaggagtttcatttttatttgatttgatttttgtagagacagggtcttgctgtgttgcccagactggatcaaattcctgggctcaagcagtcttcctgcctcagcctctaaagccaccaaggccagctttttaaaactttattttatatataaaaaaagagtttaaaggattacaaaggatgttgaggttaacaggacatctgaacccagaagactaaaagtcttgtaaaggtcatagaggtgggtccttcaaatagatgaataattgagggtttatgaaattagttcattaaatttggactgtaagaaaaggaatttgaggcccggtgcggtggctcacgcctgtaatcccagcactttgggaggccaaggccggtggatcacctgaggtcgggagttcgagaccagcctgaccaacatggagaaaccctgtttctactaaaaatacaaaaattagctgggcatggtggcgcatgcctgtagtcccagctactcgggaggctgaggcaggagaattgcttgaatctaggaggcagaggttgtggtgagccgagatcacgtcattgcactccagcctaggcaacaagagtgaaactccgtctcaaagaaaaaaaaaaaagaaaaggaatttgaaaagttgattaaaatgaaattttagtgaagaaaactcagtcttaagggaaatctgaaatgagaaaaacgtttttat

SEQ ID NO: 93241 - DNA, 1046 bp, Homo sapiens
ggcaggagaattgcttgaacccaggaggtggaggttggagtgagcagagattgcgctgctgcactccagcctgggcgatagagtgagactctgtctcaaaaaaaaaaaaaaaagagagagtgatggattgaattgaagtggttaagcagtggagagaatgcatttgtaaacatacctccttctctgttagcctcatttttatttctattaataggtacagatttttagaagtcttattacttcagggctgtgacagtgaagcagcaactgcaacaacaaattcttgccctgtatgcacctgtgccttacctttcccaaacatttttaggctttttcttctgttattcaactccatattctctagtcatatgtttctaaactttaaaaaaacctagtcttagaaacactcttcttgttatggaagatgagaatttaatactcttacaccaccagatattcctggcacctctttcttaatcatttcaattagtaataaatattttggttaactgctaagccaagtagtgtactataattgcattttctttttcggacaactttttgtttttttgtttttattgtagtttacagttcgttgttacatttgcctagatttcaaggcactgtctcttctttatctcatgtagaattgtcagatccttttgtttttcatataaattctaatactgtttcctccttcccactcccaggaaaaatcccccctggaacttttctgttctgaactggttgctctctaggcaattttgtctaccctttacttcacactgttgaatggatttcatttcttcctctttgttggtttggtaaagcaatttcttagtgctatcttagaaaggatgcatgggagctaaatattttgagatcttccatgtctgggaatgcctttcatttggttttggctggatataggttgaaagtatttttaaaagatactgtcattttgtcttctggattttagtgttattgagaagttgagagttgatcttttaaggtggcttagtttgtttctgcgcatacttttataa

SEQ ID NO: 93242 - DNA, 1056 bp, Homo sapiens
ctgttgcccaggctcaagtgcagtggcacaattaaaggctcactgcaacctctgcctcttgggttcaagggattcttccacctcagcctcctgagcagctgggactacagttgtgtgccactatgcctggctaattttttgtgtttttagtatttttgtatttttagtagaaacagggtttcaccatgtgcccaggctggtctcgaacgcctgggcttacaccatctgcccacctcagcctctcaaaagtgctgggattagaggcgtgagccaccatgcccagcccaaaacttggtcttttctgtatctatttttcctcctatcctggatcttgtattactcaggtttaaaattggatacatttgctcagtgttgcatacttggtgaatatctggaatcaaacaaacacagacaagtttaaaaggtgtgagcgtttttactgtgattaattttagtatagccaaatgtaaagccacagttacagtttacctttttttctgcattgtaggaatagacttcaagatcaaaacagttgaattacaaggaaagaagatcaagctacagatatggtaagtgatgctaatttactttatgtagcagaatgtcaggttccttaaggtttcacagtgaaattcttttttgtcacaggtttagattctgtgagacttttgtttttaaagcaggcagtcaggtgacctttttgtgcagtaaaaaccattgcatggacttaagtccatgagatctaataatcttttctacttaccgtgtgaactgaggcagattatatactcattattaggctttttatcttcatatgtaaagggagatagtaacacccgtctcaatggattgttacaaggattacatgaaataatatatgcaaagtttttagtgaaatgcattgcgaaaatgtttgttttctttaatatgtttttaactttttatgggcattatttttattagtttgtgttaggtttgcctgaagaagtacaaacctttgaatttgtatttgtctgaatcatagaatttagaattataatggcaatattttccagc

SEQ ID NO: 93243 - DNA, 1043 bp, Homo sapiens
cccgaccttatttttgcttttttaaaaaagatactaaaacatgtttgtaagctgatgagatgatccataaaagagcaaaatgatgatacaaatgagagggcatagttacaggagcaaaatacatcttacacctttggctttaagcattaaataatggaaaatactactatttacatttctgtcttattatttataagtgaggttatctttacaacttttggttaatgattctaaatgtaaatatgactgtactatggtatagttctctaatgttctaaaaatcctacctgcttttgtgttacattatggaactaaattattaaataaaatgaaattttaagagtttctatggtgtttgctagtgcttattcaataaacttgagttttatgtgtcacttcctactgttttccctttcagattttcatccagtatgggtaggttattaatttccttcaactaaaaagtttttatatatacttaggaaaaactattcttgttttgtcctttatgtgaaatgtagtaatatcaaaatgcttaatagaaattattggctgtttatttcagggatacagcaggccaggagcgatttcacaccatcacaacctcctactacagaggcgcaatgggtatcatgctagtatatgacatcaccaatggtaaaagttttgaaaacatcagcaaatggcttagaaacatagatgaggtaagacctagaacttgtataaacccttcatgaacacacatttgtgtgcttggttaggaagaataaatattccaactgatcttcaggatataatgtactgttgaagtcattattattgaagtatttctattttctaaaagttaatgttggccgggcatggtggctcatgcctgtaatcccagcactttgggaggctgaggtgggaggatcacctgaggtcaggagctaaagaccagcctggccaacatggtgaaaccccatcactactaaaaattataaaaatcagctgggtgtggtgatgtgcacctgtcgtcccagctactcaagagtccaaggcag

SEQ ID NO: 93244 - DNA, 1174 bp, Homo sapiens
aaagagagattcttttgatgttagattccatatgaatttttggatagatctttctatttctgcaaaaattgtcattgggatcttaaggggacaaccacttgtttttaactgatttttctgcatggacctccttgtgccatagcagcacagctatttgagagtttaaggctctataaaatgtttaattaaggcttctatagggtagtatgcattataaaatctgaaatgatccagcctggatttagattatgcaagtttctttgcttgtatcttctcttttggtaagaaagaacatacctagaaagtagacagcctcctttagggaggaaatagtatttgacatggatatgtcttgggaattgcgtttcttttgctaggtaatctaagaatttgtgtaggcttttagtatggagtagttttagggtgactgctttaaaacttcaaagctatagaaatgaccctctaaattgagagaataaagtcacttttaaagactgttaagccgtaattcatggtagtatgtaaaagtaaaattttatttcattttagcatgccaatgaagatgtggaaagaatgttactaggaaacaagtgtgatatggacgacaaaagagttgtacctaaaggaaaaggagaacaggtaaaaatctgaattaaactgatactctgctctgtctttgtaaaggtaatgctacttttgattatttttatagtaatagtgatcgaacacactaagctaattacatagtttttaaaatgcttgttggaaataatattttatcatttgagtgaattttttttcagtgcatatttaacatgtatgggagaatcaaatgtgcccatagtatttttagccttatttaaactacaaagagagaaaaatataagtcattaatcctcggtttttaaacttaggactttaaggaaatgtatcaattagtatggttctaaaatgtgacaatcaggagcctatggtgagcagaaattagaccctgaggagtcaggttgagcttctcataagtttgcccccagtgtgaagtatctgacttagaatatctgaaataaacttttggggtaaggagattacttttcttttgtttgttttatgaaagagcttgacttgctgaaatattctgtgttatatattctagttgggaccactgccttcagaataa

SEQ ID NO: 93245 - DNA, 3488 bp, Homo sapiens
tttttatacagatgggggtcttgctgtgttgcccaacgtggttttagctcctggcctcaagtgatcctctcaccttggcctctgaaagtgctgggattacaggcgtgaggcactgtgctcagccatctatatccatttttaacatgaattagataactacattttgctccactccttttcacttaatcagttgaggttgcctttttaaaactatgatacagtaataaaattggtctaaaaaggcagataacagaaaagggcagttttatttctgtgacgttacatatacctaacactggtttcatacaacttgctccacaatgccttttaagtactaaacatattcagaggtcagggctagaagataacaaaatctatttaagagttagagctgagaagatttcagaagctttataaaggcatgccaggaaatgtctacaatatttcacagcttggaggaagcaggcaaaaagaaaatcaaaacaaagcttccaaatctttactttgcacggaggggaaacctatctcctgtgattgtagttgtattttgttgtataaattgacataagaatattcctgttgaatcgtgattttatccatggcagtgttttttcatgagttattttccttgtgtgtttgttgcagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgagttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttccagctgtgtggtttggttttcatttatttatggaattggaagattacttctgaaaaaaatgtggaatcgcaaactcaaagagttgacaaaaatgggaaatcactgtcaacctatggaaaactggaaaggcaatttcaagaactgtctttgctgagaaactacattaaaaaatagaattatctctgggatcctaaagcggaatcatccttgtgccaaaataggagatgccacgatcctaatcacacctggcttacactagttggatgtgcctaaggccactacagctgaggtcacctgattcctcagggggaccaagctgggctcctca

SEQ ID NO: 93246 - DNA, 1061 bp, Homo sapiens
taagtcctgggatacatgtgcaggtttgttacataggtatacacgtgccatggtgctgtcttccattttctttgtgaccaccatacctgaacaggaggaccactcctgatgctggcatggtgctttccaagtggaaggccctcgcacgtgctccttggtctctgcccagcatctaggtgagaaccaggccacgtctggtgaaggccctcccctgctccagccttctctggcaagttcccagagagccgctggaaggacagattctccttggccccttcaccctcccagatctttattatcatttgtgagcagctgactgttgctgatgtcaaagagatactgattatcttctcggcaccaggccctgttctaggtgctcagtttcatgttaattagggcaagttactctccactttttccatgggaaagtttggttcacccaggcagcatcttctctgagggccagcaccaaccggcccacagagctccccatgcacccatcccgacttccattctgcatctgcggctctggctttcctccccttttcctcttcttctacctaaacatctctttctgttggcagctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgaga

SEQ ID NO: 93247 - DNA, 1981 bp, Homo sapiens
aaataaataaaaaaaaaaaaagattacaactacagaataacataaaattatatatttgcgataagcaaatataaaccatgtggtctcagacacactttggctgcttcccctgtcataggtagagaattaccagaactcctcttttgttttgccattctagtattcatgttatttactcctcttggcaaatttaactggtttaagagtgatttagtttacgtaaattgggcatttggaggcattctatggtagaaagaatgtgtacttgggagttaacatgtctttgaatgctagcaccctcccttatcaagctatttgaccacaggtccctctaagactaaacaacttgaaagtctccctcaaaatgggagtaatagaataactacctcacagagttggtgaaaaacacaggtgtgctctggcccatggacattcaataaacgttagtttccttttcttcccatctaactaggaatgtgttttttctagattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtaagcaaggggctgttgtacttgaatcctagtgtagtgaacagaaaacacagagattttttttttaaaggagctataggaaactcatgattgcttttataaaaaggactattcaaaggctgggcatggtggctcacgcctataatcccagtagtttgggaggctgaggtgggcggatcacgaggtaaggagttcgagaccagactggccgatatgatgaaaccccatctctactagaaaatacaaaaattagccgggcatggtggcacacacctgtagtcccagctatttgggaggctgaagcaggagaatcactggaacctgggaggcagaggttgcagtgagccgagatcacgccactgcactccagtctgggtgacagagcgagactccatctccaaaaaaaaaaaaaagactttttgttatcaaacgttaagtttttatgtgtgctcatgcacactgcatatgttataaaggtcaaatctaaattctaaaggaagaaaatgagggtgcgttcaccttattcatgtaggagctctgtcacccaaacatacagataacctcacagagtatagccagatgctttgagattttttggttagccgaaagccaaaaacaaacctcttcaggtctaaggctgcaaaggaaatagggaagacagttcgtccagatgcttgttctgtggaaatgctgctttggcccagctcccaaatgttctccataggcacttcttgagatgggctgacatgaacaaaacaagtacttgaagtggggagtaggaagagtaagccccgagaaggagtaatagcagtaattcagggatgaggtaggaccaaggcctaagctagtctacagttggataaacagaatgtgggttactgaaaggtgaacatgaaatgattctgacttggcaacatgctggatataatgagcagtgagctcattacaaaaaataagagtaccacagagcaaaactccgtctcaaaataaataaataaacaaacaaacaaacattatcttctcttattgcccatagagctaacaaaacccattccttggacaatcttccacaggcatgatctctagaccaccccgtttcggttgtcctctctagtatcttcctcatgtctccgtgttctactgctgtgtttacaactatcttttcacaattctgcaatctgggcagggctctgcagagacagtggtgcttaagtccattgatttcaaggctggggtcactcctgggctgcattccgcaggaagctcggttggggcacctcactgcttcccccacatctctcatagtccatcctcacttag

SEQ ID NO: 93248 - DNA, 1029 bp, Homo sapiens
gcctttcacaaaacctgtccctggcgtcaaaaaggttggggactgctggactaggagcaataggctatcccatatagcctagatgtgtagcaggctctgccatctgggtttgtgtaagtacactctgcgatgttcacacaacaacaaaatttcctaatggtacatttctcagaacatatccccctcattatgtgacacatgactatattaattaagaaaacctgtgcctggtcctaaactataagcagaatttgattaaccagaatatggagggaaaaacaattccgcatatggtatggtgtgagcaaaggcaaaagcaaagccaactaggacactgtaagtagacgtgcttgattggagagtccggggctttttaacctggggtccatataaaattgtgtgtgcatttttctcttgagagcttctctagctttcagtagattttttaggagatctacggcccaaaaagaggttagtaaattagaggaaaagtatgaaaaaaaggctaaaaaggtaaattctagaaattattaaatgccagcctaaggaatttcagtttattctgtgagcacattcctgctttataaataatctttagacccttatccatctcaagttgctactaagttacattttctaacattctaattttctttcatttgttcaaaggttgccatttcatgccaatacagaatagcaacaaaagacagaaaaacagtattaggtacccctgaagttttgctgggggccttaccaggagcaggaggcacacaaaggctgcccaaaatggtgagtctaacatcccctttgtgaagctatatgccctctttagatctgttttcttgtataaaatgcataatatgggcattcattgtagaattaaaaaaccaaataaaatatgagtgtacaggatcagtgacagactttattcctggtacttattttttcaattccacagatttttttttttttttttttttgagacaaaatcttgctctgtagcccaggctagagtgcagtggtgtgatc

SEQ ID NO: 93249 - DNA, 1100 bp, Homo sapiens
aactcaagtgatccgcccaccttggcctcccaaagtgcagggattacagggatgagccaccatgcctggcctatatgtcttatttgtatttcatttttttcttaacattatgcagattttttccatgccaataaatgtttgtagacctatttgtttatagcctacatatgattcaaactctgaggatgaccctgagtttctcctttgagaagacctatttttaaaggaaggggtgcttgtagtgggccaaagctgcctgaatagaaagctactgacttgctgggagaatgatatttcttactctcttctaacagtatatttctgccggataagtatatttcttataatcaaaatagcatttgatggtggtacgtacatccagtgcttcaaatttaaacccttacctgtatatatttccctttggcaggtaaatacactgagtaaagagctacattcagagttctcagaagttatgaatgaaatctgggctagtgatcaaatcagaagtgccgtccttatctcatcaaagccaggctgctttattgcaggtgctgatatcaagtaagttttaggaaacttgaagtcaccttttatcttggttaatagtgtgtttcttaggcctaataatttctccttttaaaagaaagtagaagtgctgggcacagtgacacaggcctgtaaaattgaaaatgtacgtatcaggctgggtgtggtggttcttgcctgtaatcccagcactttgggaggccgaggcaggtggatcacatgaggccaagagctcaagaccagcctggccaacatggtgaaaccctgtctccactaaaaatacaaaaattaggcatggtggcacacgcttgtaatctcagctactcaggaggctgtggcacgaaaatcccttgaacctgggaggcagaggttgcagtgagccgagatcacaccactgcactccagcctgggtgacagagtgagactgtcttaaaaaaaaaaagtatatacacacacacacacacacacacacacacacacacacacacagagtatatatatatatatatacacacacacacacacacacatcatgtgatctagagaaatctcac

SEQ ID NO: 93250 - DNA, 1027 bp, Homo sapiens
ccatgataaactttctttattaaggccaactgattagcaactttaatcccccctttgccgtgtaacctaacatattcacaggttctggggatgtatatccctttgtgggggccagtcttcctcttttagtatccaaataatcatctgacctaacaactgaaatggaaaaaatatggcagtagtcatatggcctagaatacattgtacagatttggggtttttgttgttgttattattgtaaattacagctttgttatatataaaaggtactacagaaattgtttcgcaaattaattttgaaatgtcttttcttacaggttatatatgccgcaattttacagggtcttctgctttgctgagtaagtttaatttctttttaatgtgtatgcttacattgctttttggatttatgttgcaataaatatgtttacaaataaatctttcttttctttttagccagaacccatattaactatggagtcaaaggggatgtggcagttgttcgaattaactctcccaattcaaaggtatctcatttaatttgcagtttttttctgctaaccgcattatgaatctagtcctgaatgggaaagatgtatcccatatttccccaaatctaccaatctggcagtaatcttacatgaatttacagttttgacagttatgttaaactttgacagattgccaagggagccagttttctaaagcagaggttcttgcgtaagaattcctcttgttgaccttaggtgccaccagcctcctggttatagtgtagaatgaggaggtgacttattagagaagaaccagagtacaagctttgtttataagactcaaaatttgcctacccatcttaaatatgaggttgttaatccattttcttcattacttgcctgacataagtcactattcatagtaagttggctgagtgaaatgtggatacttggctcttaagcttcctgagggatctgaatgactcaatgcaattcacatattggaaatcaagttctgttcgaattgaaacttcttt

SEQ ID NO: 93251 - DNA, 1052 bp, Homo sapiens
tttcttcacttaatgatacagcttaaaatggttccgaattggtgcataatcatttccttaccttttacagctgcatagtatttcacaggggtgttgtagcatggtttacttacccattttcctattttttggttattctaatttttgactattacagtaacaatatggattatgtcctgtgtgtgagtaatatccatgaagtcagttcatggaagtggaattgctggttcaaacattagtttcagttatagttttcatggataattaccaaattgccctccccatggactgtgccagttctcttggcagcagtatatgagaatatctatttgcacatactcttacctacacagagtatatatcaaacctttgaatctttgctactttgagagacaattatatctgtggttttaatttgaattcttcttatgagtgaaattgaacatcttttcatatacttaagaaccatttgtatttccttttctgtggtctgttcatattctgtgcctatttgtctgctagtgttttccttagtaatctgtaggaactcattgttagaaatttagtcttttttggaggggtgggggaaagttgttaatatattttacatattttttaacatatagggttattatatgttttacttttttattgttttgaaacaatacagtatcaaactttgaaaaagttgcaagtgcagtactacaaactttttttagtagcagttgagattaagttgctgacatgatgcttcaccatccctatttagtgtatattcccttcagatacaaacattccacaaagccttctacataatcatagtacagccttcagaatcgtgaaactaatactaatggttttattatcacgcctagcagtctctctgcttctttgaccctaaaggagaggagcacacactctagaggtagacttcctaggttcaaattccagctctgggcctggtgcggtagctcacgcctgtaatcccagcactttgggaggccaaggcgatggatcacctgaggtcaggagttcgacaccagcctggccaa

SEQ ID NO: 93252 - DNA, 1013 bp, Homo sapiens
cggtagctcacatctgtaatcccagcagtttgggaggctgaggcgggcagatcacctgaggtcaggagtttgagaccagtctggccaacatggtgaaaccccatctctacaaaaatacaaaaattagctgggcatgatggcaggtgcctgtaatcccagctactcaggaggttgaggcaggagaattgcttgaatccgggaggcagaggttgcagtgagccgagatcacgccattgcactccagcctgggtgacagagcgagactccatcttaaaaaaaaaaaaaaaaagtaaaagtcatcagactttatatattttaattagtagtttttgtttttaaactttatcttaaagctgtccagaccaaaacgaagaagacgttagccaaacccaatataaggaatgttgtggtggtggatggtgttcgcactccatttttgctgtctggcacttcgtaagtatgacatgatcatattatttttttccttcttttaagacactttcaaaagtagtctttgtaaatgtaacccagtaggtaataatattgttagtggactaatatttggatagcagtcccatgaaattaatatagaataagtcaagacagtggtgaaataatatggcaacatttgttttttatccttctcatgaataagtctagcgtagttttacttgaaacagctctattttgaaaacctagaggtccagatagcttgcttccaacagagctgtcctttccttttctggagacaagtacattgtccctgtttctcctcagaagtttgagtgctgaagatgtgggccatgggcattctgaagggcctatataatccactggtttggcctcctggaaattattaaaattggagttgatagggctggtccaaacccccagcatagcacaaccccaagtgtgtgggaccagaatggtcctagaccagctccagaattccctagatccaaattgctcttctccttggccttttgtgcttcttttctgtccccgagtgaagg

SEQ ID NO: 93253 - DNA, 1088 bp, Homo sapiens
tgtaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgaggtaaggcttgtgtttgcagggcatcccactgcagagatttagaattaggtatggcagtgtggactctgctatgctgtaataggtgtagattctgtagttacaggaaagggttaattacttgctcaagatggaaaaaaaagatagtggttagaaaactttaatttgtgagccctctttagagatcctctttagagatcctctgcttgtcttggacttgattgattaatggtagacaaatagattttaacttttccaaataacacagaacaatcctaggtgttagcataacaccggttaacagtgtacctgctccttggatatctcctttcccagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggtgaaatgaaatgcttcatgacacttattagggagttctgaattgctcctaaaactcaaaaacatcccgagtgatttttccataagtatgttggttctgtttccaaagtattcagcctttattcttaaatatggatgcaaattttgatttatgttgtaacaataggttaacattttttaatgtttctataagagtgtccttttaagatctgagcactaatctcagcactttgggaggctgaggcaggaggatcgcttgaggccaggagttcaagaccagcctggtcaacagcgtgagacttcatctctaattaaaaaaaaaaaaaagaaaaacagagtctccttttagatcttgctgatatattttagttcttacatacat

SEQ ID NO: 93254 - DNA, 1122 bp, Homo sapiens
aaaatttgataatatgataattataaaacactttccttctagtgaataggtaaggtttatatttcatttgtttttgtaatttttaaagcatatttctgtggagaagatatataaggcttgtggttccatagagttaaaaaaattcatttttttaataggaaaagatacagttaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtgtgttatgaatagagggttaaaaatatagttattcattttaatgtgaaagtggagtcattaaaaaaaaaatagaatcacggttttaaggcccgagaagtcacctaatccagccaccattctgccacaaaagctcttcctttcaggcacttaaccagtcaaaaacttctattgcttatggtgggccctggaaatgaaaagaatagacaattgcaatatagtgagatgctgtgatggctgtaaggcttaggtcgaacccctgacccagatggggggacagtcagagagtcttcttggaagaggtaacacttgagcagcaaatcttgaaggaagagtaaaagccaactcaggaaggattttaaaaggcatttcaggccgggtgcggtggctcacgcctgtaatcccagcactttgggaggttgaggcaggcagatcacctgaggtcaggagttcgagaccagcctgagcaacatggagaaaccccgtctctactaaaaatacaaaattagccagatgtggtggcacatgcctgttaatcccggctactcgggaggctgaggcaagagaattgcttgaaccctggaggcgtggaggttgcggtgagccaagatcgcaccattgcactccagcctgcacaagagcgaaactcccatctcaaaaaaaaaaaaaaaaaaaaaaaaaaaaggcattttggacaaagggaatagcaaatgcaaaatcaaggaagtatgagagcaaggggttctttggggaaaagtta

SEQ ID NO: 93255 - DNA, 1139 bp, Homo sapiens
tgtttattatgagcagttctttctttttttttttttttttttttgagacagagtctggctttgtcacccaggctggaatgcagtggcacgatctcagctcactgcaacctccgcctcccaggttcaagcaattctcctgcctcagcctcagcctcccaagtagctgggactacaggtgtgtgccaccacacctggctaagtttttctatttttagtagagatggggtttcaccgcgttagccaggatggtctcaatcacctgcctcatgatctgcccgcctcagcctcccaaagtgctgggattacaggcatacaggcatgagccaccacgcttggccatgagcatttatttctaaagttacctcttctgttgattcattttgattattatgatacttttgaacagccttctctaccctcatcctccaaaaatgagtcagcgtgtgtatgtttgaattatgatttaatgatggatacagtgaagtaagtgttgttatatagaatcactgtataagtctaatgagttaatagattcaggtacagatatataagatggctggagaaagacctccagacaggctgaagaattttaacattgtgctggttaacatttcagactgatggtgcatctgcaatgttaatcatggcggaggaaaaggctctggccatgggttataagccgaaggcatatttgaggtaaagtaaatgttcaaacaaatcatctctgatttctttattttattaccaaagctcacctctctatttttttacctagggattttatgtatgtgtctcaggatccaaaagatcaactattacttgggtaggtagcagtttgtatccttggactataatcacaagtatttgattgcctatgttttattatactggttaataaatgattaacactggtttattatttatttgtttattacactggtttgagagtatattaagccctgagttcataattggtttatgtggtggtttttttaaaaaaaataatagtaatctggccgggcacggtggctcacgcctgtaatcccagcactttgggaggccgaggtgggcagaccacgaggtcaggagattgagaccatcctggctaacacggtgaagccctatctctactaaaaata

SEQ ID NO: 93256 - DNA, 1004 bp, Homo sapiens
ttgaggtcaggagttcgagaccagcctggccaacatggtgaaaccttgtctctactaaaattataaaaactagcctagtgtggtggtgtgcgcctgtaattccagctactcaggaggctgaggcaggggaatcgcttgaacccgggaggtggaggttgcagtgagccgagatggcgccattgcactccagcctggtgacagagagagactctgtctcaaaaataaagtaaatgaaataaatcttacgtttaaaagccctttttcatggattttcctcagagactttgcagaaaccaaggggtcagttatttatcagttggaacattttggactttatgatcacaaatgctttttaatctgtgtaacttcatctacagaaaaccatggtccattaagactagagcgatccctctatctcttcatgccaggcttctaccagggagataacctgtacacattactcacgagcatagtgcgtaatccacatagggtaatgtctgcagatttgagtatgtgttccctaattctttatctagcatgtagagtataaataacacaatactggatgcttttatggatgaacaaggaataatacctagcacctttcttctagaagtttatagtatgaagagagaagataagatgcatctgagaaactagattaaacttgacattgtttgatcaagagccacgtgagcaataccaacatggttggagacagaggagaaatccatcgtggtgaatctagagcagggtttctcaactttggcactaacattttgggccaaacaattctttgttttggggggctgtgtgttgtagggtgtttagcatggcctctacccatcggatagcagtagcaacaagctcctccccacctctgccccaggtacacacggttggtataaccaaaagtatctccaggtgttgccaaatctgatctagagcaagaaaaaacatggaacatgaaaacagtgtgtttaaaataaagccagagagggctg

SEQ ID NO: 93257 - DNA, 1024 bp, Homo sapiens
tcaaaaagcaaataaagaaattaaaataaataaaaaataaaataagcaagccagagaggagtagtctaccttattatgaattctttcaggacaacccccaagtcagtcaaaccttcctatccctgctctttttttgtctgcttgtgccttttcaatgtacttaacatgccaggtgtggtagctcatgcctgtaatcctagcactttgggaggctgaggtgggcagattgcttgagctcaggagttcgagaccatcctggacaacatggcaaaaccccatctctactaaaaatacaaaaactagctgggcgtggtggtgggtgcctgtagtcccagctactcgggaggctgaggtggaagtatcacctgagcccgggaggttgaggctgcagtgagccgtgttcaggccactgcactccagcctgggtgacagagggaggccctgtttcaaaaaaaacagaaaaaccaagtacttaacagtttgttttgaactccagtgtatacttgattgaggacaaagaccatgtggcaaatctttaaacctgcagtgttcaacttggcactttgtaaataatagtttcttttatttacttttttgttttttagagggtgtctaaaaattctatgctaggatttagactcatctaaactaaggacatagctagtacatagcactgtgcatagtgctggataaaagatattctacttctggccgggcacagtggctcatgcctgtaatccagcactttgggaggccgaggcaggcagatcacgaggtcaggatatcgagaccatcctggctaacacggtgaaaccccatctctactaaaaatacaaaaaattagccggacgtggtggcgggcgcctgtagtcccagctactcgggaggctgaggcaggagaatggcgtgaacccgggaggcggagcttgcagtgagctgagatcgcgtcactgtactccagcctgggcaacggcgaggcacggtctccaaaataataaataaaaaaaataaaaaaagaaagata

SEQ ID NO: 93258 - DNA, 1072 bp, Homo sapiens
aatgtgaaaaggaattttcagagaaaccaagtcaaggactggtggtggtgaaacttcttgctttcttggaaagcaagataaggtgctatgctttctgctctctgacatttccaccgtctcccagccatctagcaatggctaccctagaaaaacctgtttcctaccctttggtgtgggctgggtatagaaagaggaggcttctctccagcactttgccaggaggccctttgccacaccgtcctcaatccaccctgcttacgctgcccctgagaaagcctagttctcacctggcagtgtcgcttcctcctttgctgtgttccaagatgcagccttcatttgtggcctaggaaggggtgggaaggcccaattgcagggcagttattagtattgtcaactctcccttgaagaggttgtatctgttttactttctcacatgcactcctgcctgtgctgcaggaatcctagaaattttgctctcagctacagtaactcccatgagtactgatcccacacttttccttcaaatgctaactggaggcagatttttagatggagaaaccagagaaaagagagtcagcaggagtccaggtgataatcaggaacccaggaccctgatcctgactgctctgaccaggctgctcattccactggtggggagctggaaccggaaaactgttcattctaaaaaacaaccccaatcttctctcagcttctggctgtgcccatgtcctctgaggagggccatggaatgccttctgacatgctcttggatgcacagctgaggatctgaaggcagcaactcaccagggagatggtggagctgggggcttgggcgcggcagaagcgtttgcgcaaagcttcttgtatctgcgggagaggtaaatgctctgcttatgccagccacggccccggcctgcgggctgcaagtgaggcagggggttaggtgggcagacttaccttcctgtccatgaggcaaccaaacaataggatgaagacgccctgagaagagggacatggggataagctggtcaaggaggaagggatccacccgaatcaacatgctccttctgtc

SEQ ID NO: 93259 - DNA, 1067 bp, Homo sapiens
agtgtctaggattacaggcacgcaccaccacacccggctaatttttgtatttttagtagagacaggtttcgccatgttggccagggtggtcttgaacttcggacctcaggtgatccgcctgccttggcctcccaaagtgctgggattacaggcatgagccactacacctggcctgttcacccttgtgattgcattactgactaggagctgtggctcgctgtgctgcccagaattttgagagaatatcatagcactttctaccgaatgcgtgttgcctttgcaccatcgtaaagttgaaaaattacgagtgaaactgtcataaatcagactgtactaccaggttaagaggggagaaaggcattatggaacaagagagcaatggagtgtaaagtgatgaaggcctcggtattttctgggaaccacaagaagttagataaggtctttagacataatggtggagtggcaggagatgagactggagagggaggtggggtgctgtcagaggggaatgatttgatgtaaaggacttctggatttgatcctgtagatcactgtgtggttcaaggactgttggcatcagaatcacttcgggagggtctttagcaaattcctggctctctttgggagatacagattggatagattgcggttatttccatctttaacaaatacctcaggccaggtgcagtgccttaggccttaattccagcactttgggaggccaaagcaagtggattgcttgagcccagtagtttgagaccagctgggacaatatggtgaaacccagtttcaccaaaaatacaaaaattagccgggtgttatggcgcatacctgtgtcccagctactctggaggctgaggtgggaggattgctgaagcctgggaagtcaaggctgcagtgagctgagatcacgccactgcactctggtctaggtgacagagtgagaccctgtctcagagaagaaaaaaaagccaaatatcttaagtggttcttaggcacattatagtgctataggttttggggagccactgtttaaaattgaaatctagacaggatcacatttcaat

SEQ ID NO: 93260 - DNA, 1022 bp, Homo sapiens
cctgtgatccttgatttgaagatacaagattggcagaacatggtgactgactagctggaggtggtgtagagggccacataaaagacggggaggagtctaggatgactcaggttctggtaggatgactgggtggatagaagtggtagtcactgaggcagggttttatgaaacagcatactgttttatatatataattttttaaaaaaatacaatagtgttttgcacaggtcacttctcttggatgggaccacatgaaagtgtggcttatggacttggaattaaaacaaagaaaacttgtaaagaaatctcatttgtgaatgagttgtcctctattagaggacatttctgtaaaaatttcaaagatacgaacacttttccttttagagcctcaatagaacatgagaaattcttgatattttgattttcatttattatgactacaagctgactacaatacaatatgttaattatggcattgcctggatccattacagttaattgaagcataacttatctttaattgtacctttgtcaccttgactagatttggggaactgccctctgttccctgtaagtacattaataaggcttgaaatgtattctagttgtcttagatagtgatttatatatgtctggcagaaagaattatttctgcagttggcagagacaagaaggatgggtggaaaactgcagaaggggagagatttagtggtaagaagatggctactacatttttaggtgctatttggaggaaacatcttgaattggatcttttactgccttctgaaataacagttcactgatgatggcttgtttctctaactgctgtagtgcttaaatattaagaaattctttgctaaataagagtttgcctactgcatacgggaaactcggggaaaggtgtgccattcaaagacacccgtgggaaccaaggcacagagactggaaagaccctggtatgttagaagcacaaggaagtggcgggtgtgtaagtgaccaggccgagccttgggagctcagtg

SEQ ID NO: 93261 - DNA, 1111 bp, Homo sapiens
tttgagatactaattatggcaatgggactgaattggagatagcacttcttcatcattgccataaagaaacttaattgtgtgggggtgtgggaggctattttgatttttttttttaacatatcgtagaatcttaaaattgagagaaatttcttttattcaaactgttgcccagtgggagaatgccttctatagcatccttattcagttatcttccagcctcttctgacacacactctgaggttacatgggtttttgggcagggccaggggtccagttgggcccctaagcattgagaacttctgaacttagataatgtaagtgtgttggttcaggtacttgaatgcttttcaaatgttggaaagactagttttggaagtgctttgctaatgaaatttttctttttttctctcttatttttttaaattgacgtccagtgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtgagtaatctacagcaaaatgggttcaatttggggcttataaatggcaccaataaatgcctccgagtagaaaggaggcaatggaaaattttaaaaagaaagttgcttattatagtagctgtaagggttttgggatattctctaaattttggataatatccagatgtttaatttcagatattgtttctctaatgagtatgttactgtaataacaaatgattttaaagctggataattattgtgaggaattagttattactgtaagtgggtatgtataagccatcttcttggtgagtagaattgtaaactgagcctttagttatatgggatcagataatcacatttgttaattatctatttcttcacttgcttctttagctttaggggcatttttattgttcattaacaaaatttggaaagaaatgtaattggttgtgtagtgctttttccctcccactgcccagtttgctaagcagttgtggtgagggagatta

SEQ ID NO: 93262 - DNA, 2425 bp, Homo sapiens
aggcctctccaaattcatagatctagttttgtactatttcatcgggattaggaatgattacttagaaatgtttagcaagctgaatatagagtctaactataaatatgattacttgatctagatgctacaggtcaactaatcctatagtttttcagatttggatgtgaatttgagtgctctggagggttctcaagactagattttagttctaagtcctaactttcccatgttagttctagtacttccatttagctgtctagttctatagctatcctaatccagaaaaaccttttcagtatttctcatgatttttgccgtgtcaataaattgttatctctagggggtaaattctgtgtgcttttaaaaaacaataaggtacatatttgtcactgtctcatgttctgatttttcataggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaacatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaa

SEQ ID NO: 93263 - DNA, 1050 bp, Homo sapiens
ctcttctgaaaccactttctctttgtacagatgattattattattattattattattattattattattattattattattgagacaggatcttgctccatctcccaggctggtgtgcagtggtgcaatcatggctcactgtagccttgaccttctgggctcaagcgatcctcccacctcagcctcccaagtagctgggaccacaggcgtgcaccaccacatctggctaatttttatatttttttgtagagacagagttttgccatactacccgggctggtctcctgagctgaagcacctgcctcagcctcccaaagtgctgagattataggtgtgagccactgtgcgcagccctctttgtacagtttcatgtcctaacattgacagattctggtgagaggagtctagagagagtgtttggcaccttctgctcctgacacagtttgtggccagacttttacatgctcttttctaggagttaaaaacaaaggatgaccagtatgtgaaggatttgaagaaacagtcagatgacatctgcctgcttctggagcggatggaagaacaggtgaagaatgtgatgaaaacctttcgtgaggagctctataacattgaggtaacagggtgtgaaaagacctggtttctgctcttggagggcccctgggaggaggtctaggtctgtcctaataatctaaggagggccctacatgacttctctgtccgctgatttctgtttctgctctcaggttttattaatttatttactcattcattcatatgacaagtacatatcaagtgtctactatatgctgggcactgttccaggggcctgggggtgcagctgtgaacaaaacaaagttcctggtggaaactgtatgctagtaggaagcagctagacaataaacaagttactaaatatattattttacaggtggtaataagtgttttgaaggaaaataagacgagcaagaggttggggaataaaaaagggggattagcactccataagcataaagcctgtgtgaggcatttacttgtttctttaaggcaatt

SEQ ID NO: 93264 - DNA, 1028 bp, Homo sapiens
catgcttgttaccggctccatcaacacgctctcggcaaagtgagtctgggccctgccgggcgtgcgggccctggcgaccccggcgctcgttctacgccttcccccttcttggccctgccctcctggcttcccctgctttcccacttgctccggtcagttcgcgcgcgttatgaccacccaagggatgcgaggcccggggaaatgcggagcggggctgcgccccggacggggggatccgagccccggctttgatttgctgtacagcctccgctcctgtttccacgtcttttaacaggagggttggccgattcctttccacggcccttccagtgctggcgtccaagcctgagcacctccctccacgagctgggagagacccctggacttgtgcacatgagccgcagtagtggctgtgcaggccgagtgacccagtgagcgtggaggcctcaagcggcagacagggaggtgccccacggcccctcaaggatgaggggttagagctgtgctttgaagcttaggtgggatttcggaatgtgtctgagactgtaagtcaaggaaagtctacggaaaggccagatcaaagtcgattgtaaccagcatcaaatgcccaggttagattttctctcataatcagaaaagtgcttttgagctggggaatgacatgttgaaagtgatatgattgactcaatgacatgaggagtggtttggtgcaggaaaaaccactccaaggctgctgcatagcagatgaggggaactaggaggtggcagtgagaagagaaaggaagggacaactggtggcagagaccaggtgtgaatggccacaggcctgacccacatgagcaagaaacaaggatcactccagggtttctgcctgggagaagaaaagtgccattaactcagacagagagggcaagtggccagttcagctctgatgtatgggggtgagaggggggacagttcccaggaggttagggactaaggacccaggcagtcatgagactgagggacagggcctagcctcccctctg

SEQ ID NO: 93265 - DNA, 1002 bp, Homo sapiens
aatccgatcactttgggagattgatacgggtggatcacttgaggtcaggagttcgagaccatcctggccaacatggtgaaactccgtctctacaaaaaatataaaaattagctgggcatggtggtgggtgcccgtaatcccagctacttgggaggttaaggcaggagaatcacttgaacctggaaagcagaggttgcagtgagccaagatcgcgctgctacactccagcctgggtgacagagggaggctccgtttcaaaaaaaaaaacaagaacaaaaacaaaagacaacaaacaacaaacgttgtgaagaactgacagcaaagtgctgcccaccttaggggtcactgctgtcatccccaggcaaactggggctggatttttgttctagcctgtgaggctggggtcttttctgattctgcgccaggagtcgaaacctgtctccaatccaggatgagaagcctggctttctgccccaaggtacctgcaggcctgagcatctcaggctgggcaaggcagcccatgctgctgacacccaatcccttgggctgtcagcctgccccaggccctcagatacaaagagataccatttccccagccgggagcgctgccagccaggcctgtctaggcagacctacccgtggagaaagcgaagacaacccctgtgggaggtggggagctcagcaccagccctacagtcagctccccaagaagcgccccagccttggggaaggacaggccccgaggggtttcccctatggaccaacttgttctaccagcagggggccctcagactcaggtgggaagtaggactcatggaaatgtggcctcagcttccatacctgccccctacagacaaaaataataataaaataaataataatccttgcctgaagcttctgatcaaccttcatggcctggcaatagctcccttgtccctcctagaggaaacttggctcctggcctggggattcccatctctctgacttcacttgctctgggca

SEQ ID NO: 93266 - DNA, 1677 bp, Homo sapiens
gtaccaccacgcccggctaatttttgtatttttagtagagacggggtttcaccatgttggccaggcggtctcgaactccagacgtcaagtgatccacccacctcagcctcccaaagtgtcgggattacaggcgtgagccactgcgcccagctatatagaaatgctttctactacattgttataagtgggtctgactactgtaatgttcatgagtgatgagtgtaaatgatacctcacgatatatacaatgactgtaatgtgatcatgagagtatctgtgatttctgtgcattacagaggcacagacacagtgacttgaggaaatgccaagttaaaactccttgaggtgaagactgacccctttgagagggagccccactctggggccgggtcacccaggtctgggcctcttgacattgagaggtgtgagcctcttcactagcaccagggtaggatgctgacagggtctgaccttccctctctctcctacagatgggcggacaatttcatggccgagggctgtggagggagcaaggagcacagcttccagcatcccttcctccaggtatctggccctgtccctcctacctcctgtctcccgggcctcagaccaggcgccacccccggccatgaggccaggctgtttcctgacttaggagtggaggtgtctcctgctcccagaagagccatccacttctctctttccctccccagagcagaatccaaggtttagaatagggcaaagagcaccatcctctgcgaaagtcctggcaagtggtcatgtcctcaccacatccaagtcaggacacgtggaaaacatcagccctagtgacaaaagtcagctctctatccactgggagcccagaccccaattgggacagggcagacaccataaatggaagacactgttcgttgaactgagaatcaggagactcaaatgtcagccccagctctaccagcaacttgctttgtggccttacataagtctttgagcctctcttgggtctaggcttctccacctgcgatttgactaggggttggcctagatggatggttttcagacagggctctgcacagccttagggttcatcaggatgtatgggggctttggggcagacctaggaggctgtctctagcctccatggcagctctgcatttgtctattttacatattggggttctgggtaagctcttgtttgacaaaagtttgcattaaaaaaaatagttaaagatgatccccgagatcccttccagctctgaagtcctcgggttttcatccctgcaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtgggtgagtaaccaggccaggctgagaagggctcaggggaagctgtggctgaaggggctactggtgaaacagccctatcccacccacctccacttcatcccaccattcccccagacttcacacgcacaggcacacaggcaggactgatcgagcgcttactatgagcttggcatgtctatcaccaaagaccccttagtgacagatggccttcgccttgggaagct

SEQ ID NO: 93267 - DNA, 2262 bp, Homo sapiens
tagaaagctgtgtttttccaaacttgtgaaaataatgtagtcagttgcagctggcagttctttttttaaatgaatagaatttttaaatatcagagcattgtatactgtaagggtaatgtttttatgagtgtgtgtgtgtgtgtgtgtccatgaacctgtgcacacgtgtactgggtcacaatataaaatgtatttcttactcttgatccagtcaaaaaaaccctgagtaaaagtggagaagggacagctagaacccatctaataggccacaagctcctgatgagagactgagggacgtgaaaggagggagctggcatgaggaccactgggagggaatgacccgagatcagaggaggctaagccggtgggctgtgctgggggtctgggggaaggtggagagtgtaactgtttcctctactccccaggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttctttttttttttttgagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagctt

SEQ ID NO: 93268 - DNA, 1018 bp, Homo sapiens
gcggcgcgggcccatgacacgccgcagagggtgctggcgcccggtcccacggctcctgctcgggctgccgggtccgggagcgaaaggctggcttctggggagcccagagaacgctgtgccgcgagcctcacatgagccggtgcttggcagaagtccgcgccgctcgcgttcaaatcgctcgctccgcccacttcacggccggcgttttttaaaacccgaatccagcgactcccagtggctgactctggaacgccccttacgtagagcgactgcaggtagggccaatgagagtatgcaccgagacacaaatatagcggcgatgataggaggacaggggagactgatggtaaaatcaaccaatagacaactaaagagatggggcgggaaattctcctgccccctgcttgccaatctggttgctggtctttgcgggaccgtactgacgtcctcaggtgccctccagtcaaaacaccgaagctcagtttggaacgtggatggtgtgtttgtagaacgtgctttctagaaaagtcgctttcctcaaacattttatgctttgccttagcaacgcagagatggcttttaaagatgaggaaacagacccatagagaatgtgacaaccccgtgtcgtatctgcgactctcccaggaactatccacagatatactcagaatccagttcaactgcataaactttgctgacgcttggggtcgcggggacggcgggatcggcggggctttgagaataaggtccgggcagggcaggcctcggcactatagcaacgcaatcgtcccaaaaaaatgctctcttccctttgttggggataataaaaattcaagtcatgtcccggtatgtagaataaggggaattttaattttctaaattttatttcttgcattttctaaatgttctacagtgaacatgtaatcaggaaaaatgttataaaattagtgatttcatggaacccttgtgcattgctggtgggagtgtaaaatgctgcggctgctgtgaaaaatagtat

SEQ ID NO: 93269 - DNA, 1058 bp, Homo sapiens
tttaaaagccatctctgcgttgctaaggcaaagcataaaatgtttgaggaaagcgacttttctagaaagcacgttctacaaacacaccatccacgttccaaactgagcttcggtgttttgactggagggcacctgaggacgtcagtacggtcccgcaaagaccagcaaccagattggcaagcagggggcaggagaatttcccgccccatctctttagttgtctattggttgattttaccatcagtctcccctgtcctcctatcatcgccgctatatttgtgtctcggtgcatactctcattggccctacctgcagtcgctctacgtaaggggcgttccagagtcagccactgggagtcgctggattcgggttttaaaaaacgccggccgtgaagtgggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggtaaccggccgcggccccatctcgaagaggagaaaaccgaggctcgcaggcggagcccggatctcccgagtcccgatcccgtggcacttccctgttgggggacaacgcggttccgccgtccggcatccgctccgggcacgggcggtgccagccctgcgaggggctggagcaggcggttccgaaagcgggaagggaccggcttagccacttggctcctaacgccgtcttcttgttaggactagtggttacccagcgcccaccgcccaccgccaaccaggcattgcctcccactgttcgtgcgttatctcagcttcatattgtgcccattttacagctaatgagaaagccgaggcacaggccagagagcttgagcagagtcacacaacttg

SEQ ID NO: 93270 - DNA, 1221 bp, Homo sapiens
ttatccgtcaacatgttatttttgtattttgtttgttcaacttatcagatgttcactcatcttgatccttggttgtaattatggagcaactgtgctgttttttctttaactttattttcactaacttattttctaatatttcttttgttctatcttgttttggtttactttaataactctgtaatacttaatttgactgcttggctcagataccttttagtgttcttgttttctaataggaacactttaaggctatgcattttcctctagtactattttggctgtatctcataagttttgggatatgggctttttattgttattcatttccaaatagtctaatttcaattaagtttcctcttcaacacaggttagttagaagaaactggtttttgattcatgagtttttaatttccaattagagaatttggcttttttgattcctacttttgggaatgtttttaaaattattttcttttttgttcttgttggaaccaggatttgagccaaaggctctgtctccacagcccaggtgcctgacactgacactgagttaggccacaccttacacaggtctcagcttggccactaatgagggctggccaaccatcttcacctcgctgggcctcaggatgatcaagacaagggaattgtactagtctctcagattctttccagctgtaaaaaacaaaccaacaaaaaatctaaaaccaaaataactgagcttccaatctaggtgggaaagatctaagacttgtacaaagtcctgcaaagcccagaggagggcggtcacccatctgtttggaaggatcaggattcgggaaagacttcatggaagagttagcatttaaaatcaactgcagaggatcattcactcattcatttaacaaatgtttatttagcacctatctgctattttctaattgctgaagatagcagcaaaattactatatatcaggttggtgcaaaagtattgtggtttttgccataactgcaatgacttttgcagcaacctaataaaacagacaaaaatccctgctctgtggagggtaggcacatagatatagtctagcaatttgacagcttacctgactcagccaagctgcgaggcaccacctattttccactgaacttacctttcttttgctcaggcgcttcctcccatcaacacagtcggcggagacaaggttggctaaaggagatccgaaagcttcagaagag

SEQ ID NO: 93271 - DNA, 1030 bp, Homo sapiens
agtttttgactgtataaataggaactctctcgtttgtccaccttagatcccttttcctatcctgggagattgcctctcatcacccaattactggtgatttccccatcaccagtaagagatccgccagttcctaagctcccaggagtcaacacctgctcctaattgggtcctaagattaagagccaggaaaaaataatggaaaggaagattcactggaactcatggagagcatcattgtcccttgaatctctcttctgttactccctactcctactcctccccttccccactccttcacaggcaagagaaatatgtgttaaattcactcgtggtgtggacttcaattggcaagcccaggccctattggccctacaagaggtaagaaggcaccaaggcacaattgggtgagggctgagtgggagaaagaggcagcctagaattctccagtgctgactggagtgtcacatgctgaatctgacctctggaaaagaacaatgaggtaacctctgagggtttggaggctggattctgcgtggtgatagcagaattccctggcaaagttcagtctcattctgtgaatagtttcctacaatcctttgagccctcagagattaagtttagcaggtttccaaaaaaaagcagcccgtggcccttcatctgtgtccgtctttttctctttctgtctccaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccagggggtaagctcatcctctttcacaggactggggctggaatttctcaagtaatttcctttctccatccatagtcccttgtcacctcgccttccctttgttctctagtaaaggttgatctagttttgactgcctgggacaatgtggtttgtgcccttttgtgca

SEQ ID NO: 93272 - DNA, 1071 bp, Homo sapiens
gttgccatcgtggctcactgcaactcctgccttggcctcccaaagtgttgagattacaagaatcagatgacctcattttgattaagagaaaactttctaataaactttctaataaaagagaacactttctaataaaaactttctcttttttgattaagagaaagttttcttacttttgaaaatggcttgttagtaagtgtgcttccttaatttcagggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaatggacttactgttacagcatagagattatactgtactttttgtgtgttaaaaataagttctttatttgtttgcaaac

SEQ ID NO: 93273 - DNA, 1040 bp, Homo sapiens
cggtgggcttacccctcccgggctaggacatcctcctctcccccttctgtttctgcgtgaggcgcacaaaagggcggggagccgggtgagcctggggcccggccgcaggggacgcggcgggaggtgtggtttggggttgggaggtggccatcggggctaagccggggcgctcttggggtcctctttgtacgcccgcgaagcgccgtgccgggccttgctcatagtaagcgtttaatgcgtgctcgcggggttgcaaagccctggggtgaggaggcggctcggccgaggggtttcgcgcctagcacgcagtgggccgctttcctagccgggcgcggtgcagtggaccgctggagggctgggcgggggcgcctctggccgggggccagtcctgccggtcccaggatctgcgctgtccccggtcccacacaccacccagatacacaccctccgtccttctcgcctccgagctgggatctgcccagcctggacccgacccggcggtctgttccaccgcccggctaacggagcggacgcctgcagaggactcgcccgccgcctccgagcctcccgcctgagccacaaaggcctcctgcggctgcccagcccggagcgggcgccgagccgggtccctcggctggagcccagcgcgggagcccgccttgcagcatcgatctcagcgggcaccgacgtcgacgccccgggcctggggacggggctgtagtctgagctggagagaagccgggagagggcgaggggaggcctcggttgagaaaagatggggatggggaaggctggggagctgggttaggacaggtagtgggtctcggggagcagggagtgggaactagggtttgaggaggaaagagaaggggcgggggcgggtccgaagaacgagggaaggagctcggtgcaggtggcgcccggcgaggctggttctgctgaagaatggggaggggaggagggatgcaggcgggtggaggccgcctgggtttgaggagggaggacgggagcgaggagaagacccgcgctgtgcgggggag

SEQ ID NO: 93274 - DNA, 1046 bp, Homo sapiens
tcttgaagaagtctcagtcactttctgggtgtagattgtgcaactgtcagtaaagtgacagagaatgactaacgtgaaccatcctggccattaggatgcagcagagatcttcactgatgagtgttggactggatttgggaagaagacgctaggcagagggatgagtgtgaagctgcaggaagggccaggcacttggagagggacctacttggctggcctgtgagagcagggaggcttgggcagcaggggagagggggacagacgcccaaggtggccggggtcaactaagcacatccgtactcccctgtttccacctcttcctgactcttcgcctttggggtctatgtgctgaggggagtccaaggctgctggtctaaagaagggggcccaagagggtcagaaatgaggagaccttgtcttcatctacatccgttcacagaccccctcgttgccctgagcctccagaccaccctcagcaatttttctttcctaattaaaatcagtgacaatacaatgatgagttttgaaaatacatttagtgtttctgtatatttaaataagaaaactgtgtgcataaatgcaatgtgtttttttcctccttctgattttgtattaaaataacatctcttgttccttctttctttggaaacctttgttcacatccttcatgctccaaatagccaacaaatagcacagaaagcatggtctttcctcctaactgtagagtcctctgttctttgttaagatgtggagatagggttttgtgttcttttttttttttttttttttttttttaagacgaagtcttgctctgtcacccaggctggagtgcagtggcgcgatctcagctcactgcaacctccgcctcccaggttcaagcaattctcctgcctcagcctcccgagtagctgggattacaggcatgcaccaccacgcccagctaattttttgtgtagagacagggtttcaccatattgaccaggacggtcttgatctcctgacctcgtgatccttccgtcttggcctcccaaggtgctagtattaca

SEQ ID NO: 93275 - DNA, 1097 bp, Homo sapiens
gaggccctttgcacacaggcttgggctcagggagtcagtatctggcgtggagtcctgggcctgccctcagcaacagaggagttggagcttagagtcagggcttgtccactgtcaggcatcccaacctggaggctcagtatgttggactctacacctgccttctgggtttggttcttggcctgggctggtggtggctgggggtgggaaagaggctaccagggactaggaaccaaggagatctggccagcctttcagggaatagatgggggataaattgtatgtccttataaaaataatttgggtgtctgtcatcagttccaattccacctctcctagcaagagcaggtaaacatgaaaaagaggaaatgctggcattccagatgaattagacgggcaggcaacccaaattctattactcccatttacttgctttcaagagatgtagacgtattcatctcttttatcggtaggtatgcagcaggtgctccacagtcaagcatcaatctcagaggaaaggcccatttcctctttttctttaggtgaatgaatttatctgcactttttcagactcaaccatcaggaaaagccttttgaaccccaaataatcatttgcttcatgtttccattcattcatcaaaggaaggtagcagccaagtaggccaggttacagagggtgttctgctcccattttgtagccatttgagaagatgctgccttgtccagggccctggtgaacagaatggaggaagggggccattgactacccctcctggaggtagccccatcacttgcactcttcagtgaagatgatgccctcactgggtgcgtcccagtgcacggtggagtgggggtgcctctcactgagatgggggccactggaggacgaacctggtggagatagagcatgataagcttggttttagatgggatgggttagaagggccagcaagatatcaaagtagagagatccaattggctgtagatgtccagattaatggttttggggtttgtttttgtttttgttttttgagacagagttttgctcgtcacccaggctggagcgcaatggtatgatcttggctcactgcagcctccat

SEQ ID NO: 93276 - DNA, 1051 bp, Homo sapiens
ggagtgaaaattggaagtaaacttaatagtctatgcagctctagaattccatacttctgattctttctttctctttctttctttttccttccttccttccctttcttttctttctttctttctttctttctttctttctttctttctttctttctttctttctgtctttctttctgtctttctttctttctttcatctctgtctcccaggctggagtgcagtagtagtgcaatctgggcccactgcaatctctgcctcccaggttcaagtgattctccttcctcagcctcccgagtagctgggattacaggtgcgtggcaccatgcccagctaatttttgtatttttggtagggacgggggtttcactatattatccaggatggtctcaaatttctgacctcaggtgatccacccacctcgacctcccaaagtgctgggattacaggtgtgagcgagccaccgtgctcagccacgatttattctttctaatggcatttaactgtctggattttttcccattctgcctgagatgacagacacatgtttttgaattctgttgtttgcatagataaaataactggatgatcaaagtttttggcgaaacatatgggcatatgggatatagccagaagtctttaaaggaggtgacatttattttaaggcccagttgttacttacattgctcatttctgtctagtgtgatgtcttagtttaggctgctttaacaaaactaccgtagactgggtggtttaaacaacagaaatttattcctcacagttctgaaggctgggaagtccaagatcaagttgaagctgagggttgctgttgagggctctcttcccggcttacagatggacgccttcttgctatgccctcacatgtcagagagagagatatctctctcctgtctcttcttctaaggacactattcccattcatgagggttcacaaaggcctcccaaaggccccacctccaaatactgtcacacaggagattaggcttcgacatatgaatgggacacaaacattccattcattgcatgtagtgag

SEQ ID NO: 93277 - DNA, 1031 bp, Homo sapiens
ccgctggctgtaggggaaagttcctcctcttctctgctcacttaccctgaccatggaatttgggctttgataggagggatgggaaactggaaacagtgagaagggactttgaccttgaccatgctcaccttcttgtaggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggtaatgctcctgtttgccaaaggtggcttcctctttggcttttttattctgcttctagggctgctccagactagactcatgtgagccaggtgctcccagtgtattgctggcaggagaagggtgtgtcagggccactgtggcaactacaatagggatttccggcttaacgtcacagatttccatgattatagaaaaggaggcgtttaggctggttttgctaatcagatcatttacccaagtacccaggctgagaactgattttatttgtatatctttatgtcatgtaatacaaacctagaggaagagaataagctggtgtttgttattaagtaggggagtgggtttgtctgatgggcttctttatgtatgataaactgaattaaattcccaaagactgaaagacaaatttgcttcttctagaggatgagacagcttctattacctctcctagcttgcttgttatttttaaaaacaaccagaaaattgctggtggtgggctctcttttcagagtgagttaccatggacaatatttaacagttactgagctggacctgagctactgtaagttcctgaatgccaagtacaaaaattcagaagaaaaattaggaggaaactacattctgcaaa

SEQ ID NO: 93278 - DNA, 1041 bp, Homo sapiens
tctgggtttataatagaacagtaatcccaaggaaaatctcacccgaacgattagccaagaaagaaggagagatcaagttgcatctttttgttcttgtcagacagatagcggggccctgaaccctgcacacaacaccccacccccgccccgccccaccccagctagcgtctgcttgttgatttggcagcagcagcagctggactaggaaaacaaaacagttgaaagcctggcctttccgagaacatctgggcctccattgtacttgacctccagggatttctctccagtacttctttagcccacgcctcgctggccccagcctctgaaagaggctgtggcaggctctgcctggctcccctgctcacagcctggtcacttgaccctcctccctgccccaggcagcacccccacaacaccccaccacctgcaggccccgccctccccaggcccagaactagggtttccagacggtgccaggaccacctgctggctaacaatacagacctcattccaaaaaggaggttatctccgtggggtggcagggggagagggagtgaggagggagagtcagtgacaccaactgtgttcagaaggaccagaattttagtctggttgtggggtctcatattattattattctgcttaagtagatgttgcacttagtctctttcatatgtatctagtattacagagtaaagaatgttcttacaggctcttgagctccacccaccaatggctctccagggccaggtgaaaatatcagaatcaggtttttaaaactacaagcattcataagcaaatcaggtatgtggcaaaataaaaataaatataggtaccagcccctcactaagatattgatagcgaggacagacacgtgcaactgaacaagcttcctatgtgccttttctgcctccctatccctacaaacatattttaaggaccgctgtctaggccagtgattttcaccctttggaagcaaattacatcagaactgtcagagacgtgtgaaccagagcagctccatcttaaataggggctggg

SEQ ID NO: 93279 - DNA, 1047 bp, Homo sapiens
tgagtggggaggatcatctgagcccaggaaagttgaggctgcagtgagctgtgattgcaccactgcaccccagcctgggtgacagagtgagaccctgtctcaaaacaaaaacaaaaacaggagtttgaggttgcatgagtagcccacatcccagggccagttggaccagaaggcaggtttctcagcctttcaccaccctgttcaaggcctcctgagacctcgggactgaacaatcacccctttcagcctgtggcctcttggttggctgtatgcaaatatttctcttgctattctgtggccccaaattttgctggaccagatgagggtgtctcagaatggatttgcatcaggcaggcagctgagcgaggtctctgcctgcccaagacagtagctttatgaaatgctgctcctccctgcaggaataactgatgtcagcgccttagagctaaacagtttttactatgtataaatggtgtttgtaaggattagatgagatgatgcatgacaaatgcttcacatagtccctgtcacagaatacatatacaataaatgctagtccccaggctgggactacctgcttccaccccaggctcttttcttccagttccttgagaaaagatccaccgactttggcttcacaatgaaattgctccactgtgcaccgagtgcccatgctacctgtgtccctgggcttggccagcaggcaccctggcaggccttctctgggaatcggccctcacctcccagctcgttttccatgctcgttcttcctgctgccctaccacccctccggcctagctgtgggggctgggattggcatagctgggctcctctctccactttcttctgtgactcacctgtaggctgtaaagagccctgtgaaggcttcatgaagtgacttcccctcccctgccacctggaggacatccctctaccccctccatcggtacttagtctgcttgtagagggtatattagttttctgctgtgtaactaattgcctcaagttcagcaatttaaaacacccatttattaactcacagttctg

SEQ ID NO: 93280 - DNA, 1002 bp, Homo sapiens
gcctgcttgtggctgcacgtggcttacagcagagatcaagtgcatcccagctcccccgacagcctcccatcctgggccagacatgtccagggatggcagtgtggcctgactcctctctgcaaatgtgctcctaaacttcacactccctaaactccctcactaccaccacctccacccacacaagttgacaaactttgccgatgtgatggaatcagattaatcaaagtccccacagtttggtcctaatcagacctgcctcagcccgaacctcagcctgttctctgtcttccaactgtgcccccgactttgctacaccatttcctaccttggagcatcctggcctggtcaagtcatgcctatccaccactcacagccttcctatcctaacatgacctttccttccactgggctgcttttgcacttgctgctctccatccgcatcgaggaatactatctcttgctgccttgtagtctcatagtattttgaagtcatttctgttaaaactgaacttttctcctttcctgtttcccagctggactctaagctccttaagatgcttacatttcttcttctggagcatctgatacacataatagagggcacatagtctgcgcattagtgctacctacaaattatgcttcttgttcctcatgaatatttactgggctcctactatgtgcaggcactgggctaggtgccttatatgctgtatgtcatttaattctcatagtaactccatgagggaggtattactatctccgttttacaaatggagaaacggagctcaaggagattaagtaacttgctgaagatcttacaactaataagtgacggagctggaatttaaacgtagatctgcctgcctgaatgtctgattcttgtcaggatactatagtgagagcaaagtaaggtcaggaagtgggaccatgccctggatgatgtggtaaaggctgtagacccagaaggtaggagtggaaagtaaaaggaagtttaggagtgca

SEQ ID NO: 93281 - DNA, 1081 bp, Homo sapiens
tggtacatattcaaaaagccaactctatgtatgtcttgcctaagaggaaacaagtgcttgaacatcagtgtgtggtgtgggcttgcgagcctgcagctgggggagagtttgctgatccagtgaaactcttgtttcgaggccttggggtaacagcggtaataattattccagatacttatgtgcatgcccctcccagctcatagatgctctcacatccattgccacctgaccctctggggacccctgagaagtaaggtgcaggtcagggggcacgtggctgctcctagattacaaccaacacgtgggaaagtcaagaccacctcctatgcttccaactccttcctgaactattttcagttcctgtccttagacccaggcaaaaggggcctcttcccagggctctggactttagggtcctcttcgggccctccaacaacttgtacccctgccccataggtctggggattgtgtctacccagaccccactcacccattcctaaactacactctgggtccctagaattccctgagaaacagccctgagcattccagagcctacaaaaccccgaatctctcctcctgggggacagaccaccaatgtgtgcataccaggctcaaggacagcatttttgcagaaggtggacagagcttaggtctgcaggctgcaggatcaattcaggataggcgcgtgtgggctgggggcaggcacagaggctgaggccaactatccctgaagtgtagctcagaattttaaggaacttgaggattctaagggccaggcccttttggcctttatgaagatgtatttgacagagtaggaggatagagtatattctgtgtaatggttttttagcttgatctaacttttgagtgtttagagaatcagcacatgatcctccttttctcctcttgccctgggacccacagtatgaggactggtcctggctcttttatctcactgtgctgtttccaggttcctcttttcctatccaagcctgcagaggtactgtgggagtgcaaaggaaagcaatctagagccacagaaaaatgaaacaatttagtgtgtaaagctcaatataca

SEQ ID NO: 93282 - DNA, 1089 bp, Homo sapiens
caccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctcacttggactctgttgtgtttcttcaaagaggaggg

SEQ ID NO: 93283 - DNA, 1037 bp, Homo sapiens
tgaattacagaggtgcaaagggtacgattttttaaataagctttttatacaacgttcttcatggtgatctaaccaactttcaattagagtaaaagtttggtattgacgaagaatcattttttataagaaggaggtctgagcatgtttaatggcagaagggaaaaggagttatccaaagaaaatagtacacagacaagagagaaataaagcaaaaaggaatgatctttaggatcccagggaaaggttcctttgaagagaagagggcatggctctttctacccctgacttttagggtgaagtccaggatagattactggggttcctcctaagaaaagacctttctttctttagtaaaatagagccaaggccacttgctgaggtgggggagggagagggttggtggggaattgagttcttgaaggtctgaattacccacagtgagaaataagtctgggcatatgagagatgaataaaggtcttattgtgaatgctgcattggacctatgaattcataatgggctgagtctttaaagtcctctggccagagaagcagcagtgagtggggacgggcaccaggaatgggtgttgcttggcatgttcagggcaaggtttctgaggagtcaaaacttaagatgcagtgaagtagctggccctaaggccggaggtagaggaagggccacaagttgaagacaggcgctggttgtcagccagaatgaggaggcagaggaattacaggggccagtgggaacggaaaacaggtttagaatatgagggatgagcagtaaggaggccactgacagaggaagattttcatattaaaatttggcagaggcttcttttacttttgttcatctttgtataatgtttacgtttctaacacagacgtgtaaccactaacatttcttaaaggaatatttgaaatctcaggagtcgagctgtgccttccgggtgtggctggattgctgagatggatgaaggagaaatgaagatggagctggatcatggagcctaccttgaaaaggtgctgggcctctaag

SEQ ID NO: 93284 - DNA, 1108 bp, Homo sapiens
atgtgagctaggcaagatgaggttctccctgtaagttttcgaggtgagagcgtgggggagggtcttctacagcactcacctttggtccttctcaggcagactaagctggatgggcctttggtttgggccagtaagggtattccgtgcagccatcaatcatagcactggtgcctgtggagacaccggccactggagaagatccagaggatgaatcacagcagtagacatggtatggggattagaggtaatggggcatgcttgtttgaatggagagtgagagggctgtgggagatgctatggaagatggaaatggtgcttgtggagtgttggttggagggagagtgggaagctgaggagccaccgtgtgaaagagtttccacctagaggtaagaactcaggagggagtgccccggtaatagctacccttgaagtcagacggaattacttgaagcggtttggcttcacatcaagaccatcaaaagccaagttcccattctgctcctgcctatctctctagctctggaaaaaatgatttcttcctcagaagtaaataaaatttcctccttgtatatcagtgtaatgtgggaataaaaaaataaaaaatttcctccttgaagaggatgaaaaagcattaattattaatgtttattttcatatttacagatgaaagacatgctgagttcaaagaggtagagttgcgactgaggaagagaattaactctcagcattaaaattatccactagaaaatatttatgcctgttttgaaaagtctggctgggcgcggtggctcacgcttttaatcccagcactttgggaggctgaggcaggtggatcacctgaggtcaggagttcaagaccagcctggccaacatagtgaaaccctgtttctactaaaaatacaaaaaaatagctgggcatggtggcaggcacctgtaatcccagctactcgggaggctgagacaggagaattgcttgaacctgggaggcggaggttgcagtgagccgagatcgcgccattgcactccagcctgggaaacaagagcaaaattccatctcaaaaaacaaaaaaagaaagaaagaaaaagtttctaggggttgaatacaaag

SEQ ID NO: 93285 - DNA, 1025 bp, Homo sapiens
tcagagccctaccaccagtgttgggcattggggctaggctggagctgggctctgagcccagagctggtggtggtttccaggcctgtgggagggtgacagtgaggctgtgctgccgctatcacctccggagagagcggtgcatgggaggtggaaagcactggacctggactgtggctcagttgagggacacatggcatgtacttttaccacacaagtttatttaaataaaagtgaacacatatgcaggctggtgcccgaggggcagggggtggggagggcaggtgggaagcagacagacaatggggtccaggcagagtttgtgtggtgaaccaggctgctggagggagtggctgggggcctcagggcagcgctgggattcagtgctggggcagggggccttgggtgggtgagcctggtgccaggaggtcatttccatccctcacatgcccccctccctttccctgaccccctgggcctacagcactacctcctcagccccctctccctctcctgacatcagccttccccttagctactgagaagccaaaagacaaaataaattagaatgggtgagtcctaccccagcccccagccatggggaagggaagccaagccaggcacactgcgccggagcccgtgctgtcagctctggaaaagaacaggtaaagtgcaaggagaatccagtaagtaaaaatataccaatgactttgtcaaatacacagctgctggctgtcaggagcaggtggctggctggggcgggtggcagcagcaccctgggaagtgttgggcgacacagcagagagacaacggaaataaatagggtgggtgtggacaggggtcccaccaactgggccagcaccacccaggacgggcttctgcctgctttccggccccatgcccccaagcccccctcgcctggctccccagtgctgcagcactgacacaaagcacccggccgaccgtgttaggaaaggactataatgtgggagtggagcagggagggaggcacggggaagctgtgcagt

SEQ ID NO: 93286 - DNA, 1044 bp, Homo sapiens
tctctactaaaaatacaaaaattagctgggcttggcagcgggagcctgtagtccctgctactcgggacgctgaggcacgagagtcgcttgaacctgggtggcggaagttacagtgagctgagatcgcgctactgcactccagtctgggcgacagagcgcggccctggcaatcaatcaatcaattgatcaataaaggaaagaaaaacagaaacagttctaccaagtctctcaatgccgtggccttcacatcgacgctcaatgaacgttctcagaagggaatctcctctcctcccggcctcttcgcctgggcgggggccgcaggctgccgcggaagcctcttcccgatgctcttcgctcaggagagcccggcccaggagagggactacaagtcccaggctgccttgcggcgggcgccgggcgccgggcgcgcggtcctgcgaggagacgtggcagagtgcggcgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccgtgagtacccgccctgccccgccgcctaccccaggcctgtccggcagggtcgcagcgagcggctcccagaacctgggcgcgagctcgcaggcacatccccgagcgccacgcttgcgttgtctctttggagcctcacgggaggcagacagctccagggaaggttgcggtcctcacctcccagatgagtaaactgaggcccagtgaagttggataccttggccagggtcatgtgtcagaggggctaggattccggtcctcagactctcagttcactgcacacactctcccagctgcccagggccctagctggtctctctgggcaggtgtctgagctttgaagaggtactgtggatcattatacacggtgccccctct

SEQ ID NO: 93287 - DNA, 1455 bp, Homo sapiens
gacaggctcttccctggagatgaattaggtggcagtgtggggaaagggaccactgataggtgaggccttggggactcaagggtggcctgcctttctctacctatcttcaccccagctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctgtgagtgtgcctagacatgagacgcagaaagaatgggggcttgagatttagagaagatgagaggagggggaggtggatgggcagctgagatcctatgggatttgaaacactttaagggttgagaggagttcaggaaaagatggaaaccccaggggaacagaatgcctgcacttagaatagaaaggaaatggaaaatttatagggaaacatggattggtaagaggaaagccttgaagacccaggaacaccagggaggagatggagaaactggttatgattctctgtcctatggaaatactgatctttcattttctgtcttgtcctctgttttcctctttttttttttttttttttgagttagagtctccctctgtcgcccaggctggtgtgcagtggtgtgatctcagctcactgcaacctctgtctcctgcctcagcctcccaagcagctgggattacaggcgtctgccaccacgcctggctaatttttgtatttttagtagagatggggtttcactacgttggccaggctggtcttgaactcctgacctcaggtgatccgcccaccttggcctcccaaagtgctgggattacaggcgtgagccaccgcgcctggccctctgttttcctcttgaacatgtggagggcctgagaggatagggcctgagatcagcattttcagctgtcctgttccattcttaaagatgtaggtacagcagaattgcagcattccatgttcttatgcttaaaaatggaatcccttcttcctactgccacctagttcaaccattttcccacccctaccccatttctttactccctcactcacaactcgccatggtggggggttgggggattgtccctggcagctggatgtggcagacctgcagaaggaactggacaagagccagagtgtgttctctggaaacccatccatatggttgaaggacctggccagctatctcaactacaagctacaagctcctctaagtgaacccacgctgagccagcatactcatggtaagtccttccagcttcctcaagctcagacaagttcaaataaattcaaaaagggtggtataacagatcccagtgccccacactgtcctgatttccatgggtgatttgggctggtctcaaa

SEQ ID NO: 93288 - DNA, 1195 bp, Homo sapiens
tggccaccctgggatgagggttgtgggtctaagctttcatccccgaaagttgacacagctactcacgtgcatactcaaaaatgttccactttccttccagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagcattcttgtctgcatcctcatatagaaattcccctagttatggttcagaataacaaaatcctgggcccttgccctcctgaagactgtagccgtggctgtaattaagctcc

SEQ ID NO: 93289 - DNA, 1002 bp, Homo sapiens
ccaaagtggcccatcggctctcgagcagggtttgcgcgtcgcggtcgcaaagcccctgtgagtgcaggtaccgcggcacaagcgctgccccggagctccaggaggcggcggcgggctcggcgttcgcggtccaggagaaaccaccgcggggtgttgggaacattttgttaaaaagccgggaagctcagggccggtgtggcctccgttctggcctgagaacccggactttgggcagcttcttttccttgcctttgggtctccggctttctcagctctgtgaggtcccatgggtctcctgccctggcaggttccttcagctggagaaagcgggggtcatggctggatgaggttgcggtaagcattagagggctatcagcagcatcttatcgcagcggagccttcgatagctcagttggtagagcggaggactgtagtggatagggcgtggcaatccttaggtcgctggttcgattccggctcgaaggacttcgtctgtaatttttaacctcaatttaattcaattatcccataaggggaaaggcttggaggcctcctgtgacttagcattcgtactgccgtcagtccatagggaacaccgtagtatgtagtatacggtaacgctctttctgcgttcaatgtacatgtggtaacgtgttttagaatgttttctgcttaagcacacgattatatgcttgatttttagaatcttgcacatggatgccactgtattgtactctgctaaataaatgtcctgaactgtggttgatccactggtcagtgaacagtgcagtgaacctgtaaggcaaagggaaagaactaagcagcaggcgggggattagctcaaatggtagagcgctcgcttagcatgcgagaggtagcgggatcgatgcccgcatcctccactcagcttttgcgtccgtcacactacagaacacaaaacgggagggattcccggcgcagtgggctacgtgtttcattttagagacacaagactgttaagcg

SEQ ID NO: 93290 - DNA, 2045 bp, Homo sapiens
ccacgtgagtctgtgctgtaggaaaacaaggactgaagcaggttctagaggactgggccagtgaaggagacactagtgtagatgaaaaggagaccgtaggagactgacttatcaaatgagaggctgaagctatgttaggaaagaaagaattgaagacagggcctctctttgatctgctgtcacccttaccatagaaccctaaggagcttcctcagggtagctgcctccacccagatgggcctgcagtcatcctagtttggttcctttctgggagtgccactagatatgatctcatgctttctcaggaagatgagatgggcttgcctttattagggtgcaagaggactgggaacacagaagccagaaggctgacagaatttcactgagatgcagggcatgaggggaaatgggaacagtccagacaggctggggaagccacttaccggtagtgtccccggaccacaccatcggggttcaacatgggaatcagcttaaagacgaagaggcgacggagggtttgggcccggggatcatcaggtcggaggatgaagtccagaaagccattgaagacaaagctagatggagtctcccctgggtgtactctactgcttaagaagaatatctgaggtagagaggagagcagacattaagtcagttaccctgtagttctactttgacagtatatggggggtgtcatggatgaggcaggaatagccgctggatttccagctggctgaatctgcaagtggagcaggggccatcacccttgccgcacgctgcgggcggaggccatgtccaagatgcctagagataacatagtctttagctataaacagtacctggtgctagagaaaagccaaagaactacctttatgctatttccactcaccctcttgcctgcgaaacggaatggtcgaggggtgctggtatcaggaaatagctgctctagacggggctctcgatcttctcgaagcccatggcaggaagtgatcgtcagcagatctacacgaagtccatccagagaatagcaaaggagctcccgatggtaatagatggtatccagggggctacagggaaaaaaaaattaagccaggagaagtccctaaagtcctagtaagaggtaggccttgtcaccagcccaggatctgtaaaatctggtccttcaccctaacctttggggccttatagtccctcacaatgttaaatgaggctaaggatttgagtgggtttacattgccagaatgaagagtacaggacagggtgaacttgttgttccccagtttgtggcttcctagaatagattacttaatgtagtcggagttgttctccgtgggggcagataaaaaaggtatactgagtcacataatgctggctaaactctggataattaatgggagctgggctagtaagaggtctgaactgggcaggtgaaagagtggagggcaggtgtcgatatgctgagatcagggtcatacagaaacatagttttcaaaggtacccaaagtcctgtctgtacattctgtacagaaaaaagacggatgaaagtatggttcagagctctaagagcaaattccagaagtagtggaggtgctgtctgatccaggactgtgtggcaggagtaagaatggggctggcacctgctatgggtagggtggttctccggaaagcgctggtctagctggtttagcagttcctggcagtcactgtaggagaaggggtagcagaaggcgaagaaggtggtggccccacggccctccacgaaacgatgaacaaaggataacacaaactgcgtctctgtcatctgaagagcagaggaggaagagggaggggcaacatgccattgtcagaactgagctcctactgggaccaccaggaactgacctcacacccttatcacctttaccaacttccctccctgtgacactttctatatgaaaagtggctccttctaggcttcctgaggcaggggctcatcttggactctagctaacactggagaaaaagctgatacttaaacctgttgtcccacctgcttcatacttgta

SEQ ID NO: 93291 - DNA, 1050 bp, Homo sapiens
gataatccacaggttgggtggaagctgagatatagttgatgaaatagcttccctaaagaaaacaccgtagctgggtgtggtggtgcatgcttgtaatcccagctactgaggaggctgaggcaggagaatcgcttgaacctgggaggcagaggttgtggcgagccgagatcgtgccattgcactccagcctgggcaacaagagcgaaactccgtctcaaaaaaaaaacaaaaaacaacacccagttcagggtgtttgagagggagggaaccaccttagtcttcttaaaagagaacctcacaattagcattattgtctttagtctaggactctaccttggggggactctctgggtatatggtacagtaccaaggtcagctgctagttgctatggattattagcactttcatttgtgttcacttttttccaagtgattgcctcctttgaccacctaagttgtcctctatggttctgtcctggtatctgttcaggcgggacactgataaaggtctttatgtcttagctacacacttgaatgcaactacaacactggacgctcagtaaacagcatccctgctgcctgccatgacaatgggcgtgccagcccccctcccccgccggctttcccctccagatacactgtggaactatttgagcaggtatgaatacatggtgtaagtgggaaaagggagaaaccttacagtctggaaaggccttcactcttagtgcctgactctaaggtcctttgaagagatattcatcactatggccgtctcaccactatgattattttcctcagttaacaggagcataactacaactgtaatagtattgaaaggatgaacaggcactatatctgaccccacatcacagagaatcccctagcacctctgagtcagattctttgcctctgggcttgtctttctcattctattggatttattagtttctgggctcaaaagcaccctgactgtagtggtcttgatgattcccattatcctaatagaaagagctggccaggtgcggtggctcatgcctataatcccagcac

SEQ ID NO: 93292 - DNA, 1091 bp, Homo sapiens
aattagccagacgtggtggcgtttgcctgtagtcccagctattccggaggctgaggcaggagaatcacttgaacctgggaggcagaggttgcagtgagccaagatcgcaccactgcactccagcctgggcaacagagcaagactcggtctcaaaaaaaaaaaaaaaaaaaaaaaattagctggatgtggtggcatgcacctgtaatcccagctactcgggaggctaaagcaggggaatcgcttgaacccagggggtggaaggttgcagtgagctgagatcacaccacttcactccggcctgggtgaaagagtgaaactctgtctcaaaaaaagaaggaaaggaaaagaaacagaagaaaaactttaagcagatttaccatgggaaactaggccactggagcatgagaagatacaagttggaacagctgtgcaatcttggagaaaccactcttaaatagcctcagtttacttgttggaaaaatggaaacaacatccatcccatagcgtctttgtgaggattaaatgaaatttatatatatgatattatcttgttcactgttaaatgctatgtaaacataaggcattattattatttttcaaacacagtgcacaagtgtcctttcctgatgaagatagactctcaaacaatggggcctggaagcagataatcaagttgcctgtcagggatagaatatctcaatggtcacagctggtaaggaccattgccctctcctccatggcttctctcactagcagtcagatttacacagccactgacacagcacatgtctggtctgtaccaacagctagggtgcaagctgggaaaagctaacaaggatgagtatgctggaagaccagcaaagctcttagccccagctgacaagcctccatactctgggcaagacttctgtagtgcagaggccagtacagtattgatttgtggtttagcgtatttccagaagtggcactataacaatctctccccctccgcaatccaggttactcccgttaattttctcttctttttccctaaaggcccatctgtttctggtatataattttgacccagaatcttatcaggcagggtctca

SEQ ID NO: 93293 - DNA, 1063 bp, Homo sapiens
tacaggcgtgagccaccacgcccggccgagacaagcattcatttggttcccaacttcttgctttttattcattcaacaaatacttgctgttcacttactaagtggcaggcagaggactagatgctaagggcataagtagatgtgttaggagacacttcctgaagcttttgtttgcagtggaaaaagtagccttaaagccctcttagttcctctgtcttctaccatcactgaatcctgcccccttttctaatacttatctctcttttccagatgctggtattggctctggtcatctcaccccgtttcctgtccaatatgtacagttcacagacagtgtcttacacagtcttacgtttattcccatttgtagaaacacacagttgttgccattgtctcagttaagctcataatcattgttctcaagacatttcagctactgctctcttcacctaatatccttggtgacgggcttggccttttgcatacccacctaggtacacaagctttttgtcctctccacccaccagctctgttcctgctcctggctgtcatttctcactttgggaatgtttctgtcaaactatgtcttacctatttttcaaattatttcttaactgaacattctttggctaattactcttgtgtttatccaccacagtagttccccaaaccctcaggatgtttacagtgtttgtgcgctctcatgttgtatttactgtcctgtttcccctattaagtttcaagtcaatcaaccaggaattacttagtactgactgtgcatattttctattggtagggggaagtaacagagaaatagaatacatgtccttcacctcagggggctcaatgcagtgttgtgcattggaagcggggcagggaggatgtcaataaaatagtgattaaaaagtgcctagccggacgccatggctcatgcctgtaatcccagcactttgggaggccgaggcgggtggattgcctgaggttgggagttcaagaccagcctgaccgacatggagaaaccccgtctctactaaaaatacaaaaaaaattagcgggtgtggtg

SEQ ID NO: 93294 - DNA, 1393 bp, Homo sapiens
acacacaggaccttggcacaagtcaagtaactgctgctgtaaacagtgagaccttagaacacccattctgactcattcaaggggagatcagtctcccctcagacctcttagacctttgcccagtactatcctaccacccccaaaatggaacatctggctggttgccataagataccatttcataacctctggaagcagagctgatcacatcactcttgcactcttgcttgttctttctcacttgcttttaccctttcctggggtagggtgaaggtttgtcccttaatatggtttcagcatgcctgtgtgtgtagatatttctcaaattatctaaactatttcctctatcaagttcatgatttctgcctactgtgcactgtcagctggacatcatcctgacatccattttaatcacagaattacttggctctgggccctagactatctctgtcattggtggtagctaatgttttaggttatttgactatggccacgagtcttgacttctgttatcctattggcaacctgtgccaacaactctcactagccccctaacatctggttgtttttgacttttttttttttttttgagacagtctcgctctgtcacccaggctggagtgcagtggcgtgatcacagctcactccaaccttcgtgtccctggctcaagtgatcctccagcctcagcctccctagtagctgggcctacaggtgcacaccaccacacctggctgatttttgtatttctttttttagtagagatggggtttcaccaagttgcccagcctagtctcaagctcccggactcaagtgatccagccgcctcagcctcccaaggcacatgagccaccgtgcctggcgtttttgactcttgaccaccgtcttaacctataattggtacccagcatatctcctcataatagagtagcttccatcctgagatctctccctttcttctttattcatacaagtatcgattttttttttccattcaattttttttttttccattttggtttggaaccttttttttttttttttttttttgagacagtctcactctgtcgcccaggctggagtgcagtggccgatctcagctcactgcaatctccgcttcccgagttcaggtgattctcctgcctcagcctctggagtagctgggattacaggcgctcaccaccacgcctggctaattttttgtatttttagtagaaacggggtttctccacgttggtcaggctggtctcgaactcccgaactcagtgatccgcctgcctcagcctcccaaagtggtgggattacaggtgtgagccaccgtgcctgacctggtttggacctttcaaaagtattcttgtcactgcctgctaattcccagtgtggctgggaagatga

SEQ ID NO: 93295 - DNA, 2017 bp, Homo sapiens
tcggagttggtggcagggctgttcctagcagcagcaaccaaatgtgttacctggggaatccgggacccctcctggcggaaactctcctcggacaggtctgggcagaaagagaggagaagctaagggcaggggcagggaaagccaaagctagcaggctaaggttggggtatatctggcagggacacaggttgaaagcaagcaaatgacctggctgatggggatggtggagggcaggaaggggactggacagacaggcactcaggcaccagagaagctctctgatgtggccaagggtagatgcagtaaagcagtgctgagcattttccctcccactacccagaggaacagtgccttgctgggttctgccagagtagctatgctggagacccaaaaatattacctgcaatcgagtcttgatgcagggcatccgagctccagtccctagcagacctttcccgattaccatgacagcctctggtttgtctccagaggacaagagtgagcaactgctccctagggaacagaggaaactgatcagggtaggggtcacagagaagaggaggtaacttccaaaggatcagggtttcttaaccttggcacgttgacaatttgggttggataattctttatcgtggggagtagtcttgtgcattgtaggatgtttcgcagcatccctagcctctaaacaatttatgctgtttcctcatctcccccctcctcagtgtaacaaccaaaaatgtctccagatgttgcctgatgtcacctggcagcaaaatcacccctggttgaggctctagtctggtggtccaaggggtggagcagcaactccaggctagaatcggaacgcacccaagcttaactcctgtgtcagtttatactgccgcaatcatatgtttagcatttgaggatcaagtcagctctacccaggactggtgggttcagtgctacccattgaggagagttgacaggttgggagtaggggtctttgaatgaggtagaacatgttggactagagtcttaaaatcattcccatccctttctttatatagctgggtctataatttaaaggagaagagatggctttgtgtgaatgatacggctacacacagcatttagcagtgttgacaggagaaagtaccgtcatgcttttttcattctcctgttttgtctagtgttgcccagctcctggagtcagggaatttgcataagtagcattttgcaggtagacaaaagtcttcaggttcctcaactgataaaatgagattaagtgtgtagagcagtgcctggcacatagtaaatgttcagtaaatgttaactattgttttattacacagacacattaataaattccagcttcctatacaaaggcaccagtgttagaggtttaggataccaagaggataagtgatgcccctggtctcccaactaggcttaaagaacctggcctggccatggaggaggctggcaaacccagatttcagtggcagtgggtacagacctggtatgttgaatgaatcaggcagtagacaggagcccagcttgtgtgaggaggctgggccagaactagtaggagctggggatggagcgaggctgcctgcaggacgatggttcaggggctgctgctgccgtctcctgtcctggcttcggggctctgagtggaagagatacaagcagataaaagggcaaataagtggggcactatgaggcagccttcactgacctgctggcttccgtggtcaaaagatgccagttttcaagcttgtcatcagacccacatccctctcctgaagtaactattaatataagatgggtagaaagacctactatttattacagttatccattctccaccagccttcatcctgctagtttttttttttttttttttttttaaaggtttccactctgtcatccaggctgaagaagtgcacaatggcacgatcatggctcaccgagcctcagcctcctaggctcaggtgatcctcccacctagcctcctgagcagctggcactatag

SEQ ID NO: 93296 - DNA, 2960 bp, Homo sapiens
cccctgtccccgccgtccgggccagggagagggcactgagggcaggacccaaaggaagcacctggttgggccgggccgggaagcgaagggtgggcagcagtactgagggccggggccggaagggggttggagtatcccgccggccccgccgctgcaccctcgccccagcccactcctcggctccggggaggcggccaccacggcttcgctagccgcgtcccgagccacgccagctgcagccagctgtgcggtgccgggcccaggcgcgcgtccgcagccccgccccaccccctacggctggacctcccaccgcagccgcgcccgaggccccgccccagccgcggccgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggtcagaggcacgcaggggccgtcccacgggccagccccgccgtggccgtggccgtggctggcccgtggggcgaggacgggttcttgcgagggcgaggagtgcgccagcccgcagctcagcccctctcttctccgcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccaggtaacggcccggggctgtagcgcccagtccccagagctgagtggcgaggccgcgccagggctagcagggttcgaaacttacaatcagaaagtgtcgggccaagcatgatacagtccagaactgggcccctttgtctgcacagagtagagagagagcgcgctgtcctctccccgtaacctgttccctgctagaatgggagtgggttgcctaaccctcacagtctccagtaggtagatgcccaagttgggagtatagttgtaaggaggcactgacaccggtaggaacgaaggtaccgagggaaccatccaagtatgaggatttgggctcttaaatagccctcattttccccaggttgtttaggccttatttgggcagattttttttggtgaggggggtgacagatgtagaattctgtttccatgttctgaggccaggggttggctgctgacccaaactatagagaaggaagggggggctttggagccagccttaagtgtgggtcacaagtataaagggaacatggatgggcgttacttcctgaaggattccccagaggaaagctgcagcattttccttacctcaggtctttccccctcttttctagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaatcttgtgctgcggagggagggaaggggtggcaggtccctgttttgttctgtctcaaggtgatactctgtaatgccttggacagcgtggctggcattccaaggacttaacggctgtcacatggaatcagcggcctggaggggaactagcatatttcccactgttaccccatcttggggctatatcctgggcttgaacataaaggcattatcagacccggggagaaacagtcagtgggggagatttagggacaaaacaaacctcaggttggcccaagggacccctgctgtaacaattccaggatggggagtcagatagactacaggatataggagaaaaggcaggggcagagcggggccgtgggggcctggcctgaggcagcctgcaacagaaaagagagaggaatcagggctgtgaaaactctcctcctcttctgttctgctaaccaggggctgggaagtgaaagaagtggagcgagatgaagatgggtaaggatgggcaagttggttactgcacagtggtttgacgctggaaccagccagctcctagaccttaggccctgactaaaagttgttttcttttgctttggattgaagacttggccatggtgggggaaaaaaaaatcagggactagattcttaatggaagtacatttagtctttgtgctcaaaaggagtagggaagcagaaaattattctgaatgacagaaatgggaatgaggggacagaagtgaggggtggtgtgagggactggacccaagtgctcaccctggtgtagcagagcaggatcccagctccagctcactgctctccctggtccggggggtaggggatgtggggcctgaagagcctttcatccctctgcgagtcggcggtgagccccggcccaacctgggcctagcctgtgtggacagggtttgcgctaagaggctggattcttccatgagttttttgcttttagtttgcttctagagtttccatgcataagagtgttgtagtatagggatcagtagaggtactgggacattgaattctagctgagagggtgaggcaagataatagccagagaagtcctggattcagtccatgactatgcactccaagtctataactaggggtggcaaacggatccagcatttaaccgccatggctacaccatgactaaggtctgggtgagtagagaaacactgtgtagaaagatagtggagggttggtagacctctctcagagccctctatgctttagcccctgccagagcagtgtacacttcacccatccagtcagcctctgcctatactcagctttacctagcatgg

SEQ ID NO: 93297 - DNA, 1050 bp, Homo sapiens
tgctacctctgctgcctgctgacggcagctgcaggggccgccagctaccctcctcgaggtttcagcctctacacaggttccagtggggccctcagccccggggggccccaggcccagattgccccccggccagccagccgccacaggtaagagtctggatcccagcccgaggcttgggtggtgaggaaggggtcagaatgccacctctgcctggctctctgctgtgtccgctaatgcagggcagagggggagtgagaagcccatccatcaggtggctcctcacatgcccaccttcccacggggccttttccaggaccccctgaacacatatgttccttgggtcacctagggggtccgctcccacatgccccagggaagctgccctgaggggagcgggccaggccttcctgccagctgccctctgtatcctagccccagagcctcagggagaacttttgtccccttctagggctcccttgaccccatccagtaatccataattctgacaccactccagctctgttccctccagccctccagccagacacagatcagaggccggagtgaatggggccaggagtatagaactgcaatccccaagaggggcaggctcatcaatggcttattctctacttaaccccaagctggcctgcccgtcttctcctggaggggtggggtggaagccagtgttcagatcacccacagggcccgggctggctatgcgcacacagcatgccaatctggggactgagacaggcccagaaagggacacacatgattgtgtacattcagaggctccccgggaccccaccaccatgaggattgactgctctgtggttttccattctgcgcgtctccccatcttgaaaagtctttatctgctcctgctacacaggaaagcgtgggggatagggagggtggcgatgccaaagcccttgctctcactgatccccaagggttctgcatctttggagccttcttcagcccctctggtagcccctgggccctcctccagggcatgtatctttggtccttggacccagagggggt

SEQ ID NO: 93298 - DNA, 2229 bp, Homo sapiens
aaagtataggtcaattttatgtcatggagcaaactgggtctatataaaactgggcagtgccaccaggctcagccagagacctgtcccttggctcccagcatggaaggagaggggtctgtgacccatgttgtcctgccactcactgggctgttttcttggatctctaacttgtgtctactaggtgtggcctcatctggcctctacctaaccagttgttttatttgggttttcatttaaagtctaaggtagccagctgcaaaaacagagtctgagggagttaaggatttggttccaaggagaccagaagagcctccccactacagggtttttggaattttgggggcaactccctttgggtctggggagaaaactgccaggagattggaggcagaaggttggcaggctgggccctgagggaggctctctgcaaggctggtcctccccttcctcctccaggccagactctgaagtgcagcatcagctcctgcccaaccccttccagccaggccaggagcagctcgggtgagtagggtgggccgggggtgctttcagggagaagaccaggcccagggctgcagactcacctctcccgggctgattctccacttttctgacagacttctgcagagctacctaaagggactaggaaggacagaagtgcaactggagcatctgagccgggagcagggtgaggggctgggctgatggggccagggacgggaggctctgggcagccagatctgggactgacctcggctgccccattgactcctgccttctccacctcccccggcacctcttctaatccagcttctcttctctttagttctcctctacctctttgccctccatgactatgaccagagtggacagctggatggcctggagctgctgtccatgttgacagctgctctggcccctggagctgccaactctcctaccaccaacccggtaagctctgctggatggagatccccgcataaaggagacccagcactttggggctttggtctttctcatcataactcttttggtgagtcctctgtaaaaggagggctcagagcttgcacggcagggatgcaagggtgtgttagggagggtcagaactcctgggaacatctctgtccctggagaccccacagtgactctgcttccacaggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagaggaacggggttggggaccgaaaggacagggatgccgcctgcccagtgtttctgggcctcacggtgctccggcagcagagcgcatggtgctagccatggccggctgcagaggacccagtgaggaaagctcagtctatccctgggccccaaaccctcaccggttccccctcacctggtgttcagacaccccatgctctcctgcagctcaggg

SEQ ID NO: 93299 - DNA, 1556 bp, Homo sapiens
attgctgccttggctaggtagggggtccctgagggagcttggaaaggagtcctgcctgggtccctacggaccggtattggggtatgagggttgctgcacaagcctccaggacaatgagctctttattgtttgttgcagtgaatccggcaccttcctaggcctgggcacagtcactggctctgttgccatctacatagctttctctctccaggtaatgggtggaggttggcatggccctgtgggtggactgtaggcctgtctctaccctgagtttgcaggaaggagtctggcccatcctatcgagggaaatcctgggggtggggaacatgctttccagaaagagagttcccagctaggcctttcctcactggtattccttctgcccacagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcgtgagtcattggggcagggcaggcaggcaccaccccacgtttaatgaccagaaacgtgccccccggaggctgggctctttgtgccactcctcctttgaagggttctggttttcaggctgggaagcccttttgcccgctgacctcctccctttccctcctgcagggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaatggtactcttgtcagctgtttctgtcctcagaaggtaagagagccctgaggtcaggcagcccctctgggtcctggaagatggctttggcgt

SEQ ID NO: 93300 - DNA, 1192 bp, Homo sapiens
aggctggtctggaacctgcccaaacctgggggccggatgaggggctattcagctcctagggcctgcccaaccctcctcagaggtttgtgcaccacctgcaccctggtcagacctggggtaacactcaacaagttcctccccagctctcccatccccagtcttttccctctcccccaccacagctgggctatgcctctttcagccaccacccaaagtcttcacacctgcaggcctggtagcggtaaggtgtgctggaaaaggtgggtccattttcttgccagtgcagctgtgtcaccagctgatccttctgccacacagaggccttaaggtcccggcccacggttaccaactagttaggaataaagattccaaggatggacagttaggggatccacttactgggcaagcagcataagcacctcctctctcctttctccatcctcctcccacccccagcccctcaccttgccatcaggccctaaagccaggtcttcaatctccccttcgtgggctttgaactccagaaccttctccaggctgggcacctgtagccaaacaaccaccatggttaactcaggtgtccagcaagtacactgtgactgatgcccacgccaccccttctaatggcccctcaatgcaagcttcattcacaagtttcccagatgccacgttcaacttctcacaattttgatcctgttgctactgacattcaccctccctaaccctgcaaacccacaccttccagacacggacgtagccatctgttcctccagtggcaagcagggtattatcgtggttgaagcacacaactttctgcagtggatcggagctaaagtctgtctgcaccgcctgcaaattctctaccctgagttctagcccctcgtgctgggtttccgctccacatttcttctctgctggggctgctcccttcctttgtcgaggcccctgctccttggaacctgtaacacaaacacttggccaggttccaggcttctacagtaaggagtactggcccctctctccatggcaggtgcccatacaacttctagcttgctaccaaaaccctacttccagacccacttctttagagacaccaagagtgaccttactcgttcaaccctttccccaagggggtagagagggagctcctcaccggccttctctgccttgttgccctgctgttgatgtgcct

SEQ ID NO: 93301 - DNA, 1029 bp, Homo sapiens
catcaacagcagggcaacaaggcagagaaggccggtgaggagctccctctctacccccttggggaaagggttgaacgagtaaggtcactcttggtgtctctaaagaagtgggtctggaagtagggttttggtagcaagctagaagttgtatgggcacctgccatggagagaggggccagtactccttactgtagaagcctggaacctggccaagtgtttgtgttacaggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgtgggtttgcagggttagggagggtgaatgtcagtagcaacaggatcaaaattgtgagaagttgaacgtggcatctgggaaacttgtgaatgaagcttgcattgaggggccattagaaggggtggcgtgggcatcagtcacagtgtacttgctggacacctgagttaaccatggtggttgtttggctacaggtgcccagcctggagaaggttctggagttcaaagcccacgaaggggagattgaagacctggctttagggcctgatggcaaggtgaggggctgggggtgggaggaggatggagaaaggagagaggaggtgcttatgctgcttgcccagtaagtggatcccctaactgtccatccttggaatctttattcctaactagttggtaaccgtgggccgggaccttaaggcctctgtgtggcagaaggatcagctggtgacacagctgcactggcaagaaaatggacccaccttttccagcacaccttaccgctaccaggcctgcaggtgtgaagactttgggtggtggctgaaagaggcatagcccagctgtggtgggggagagggaaaaga

SEQ ID NO: 93302 - DNA, 1055 bp, Homo sapiens
tgcctcaggctcccgagtagctgggattacaggcgcacgccaccacgccctttgtatttttggtagagacggggtttctccatgttggtcaggctggtctcgaactcctgatccgcccgcctaggactcacaaagtgctgggattacaggcgcgagtcggatttctttattaaaggttgaccttcatcaacctccattggctccacctcctccgcccgcgccccgcgccccgcacaaaaatggcgaagtcggtgctgggcgactctgcctccgcgccaggggtggagaaccgaagccccgccccgggaaacgcggccccgcggccggctagtgctgacgcgtgtcggcgctcctgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtggtgagagcgcagggccactggggctgggtcttgctgcgggctggcggcgattccagggtggccggggggtcgcggggcgggccacactccagcttcgggccctgcccacttctgttgggaagacccgcttgcctgacgcccaggggcgaatttcagtcgagaactcagcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagc

SEQ ID NO: 93303 - DNA, 1036 bp, Homo sapiens
tttctcactgtacatccacctttttactttctccttacttatttgatctcccctgaggttcgagaatgggggacaagggacatcaggctggattctgctacaggcagaggtccctggaagacagcaggggctgctgtggcagattcgcgattccttcagcccgccttctcctaactagctcttggaggatgtgatgcaactcaggaacaccatggtccttgccttcagagacctcatgtctagcatggggacagacgcgtgagtaacccatgggaggcaggctagcatcaggtgaggggtagccttcaaagtccaactgacggcttggattttcatcccaccccaccacttaacggatgtttgacattgggcaagttatttcacctcccagtataccagttcccacacatctaaactgagtctctttttttcttaaaaggttgctctgagaaataaataagatgcttagcacagtgcctggcacacagtaatctatgaatatcgaacttctgggaaagtagccaggctgtgattgtaccaatcaaacagggacccatgggctctgggcctgcgggatttgaagtcttcacgaatgaaaggcggagacctgaaggatgggcagtacctcctggcagagctggaggaaggtattctggggcgtggaaaggtaaatttaaacacagagtggaaatcggaggcatatttggggcatggcaaatcgcgctctgtggctggaaggtcacgttcattggcaaggggaggaaaggcctttcagggatgtatgcaggcagccttctggcacagacgaaggaggttcaagtcctctccatggacgtgagctccaaagcggaagtcacaggtccaccataggaccactgttgaggttaggcatggccggaaaggagctcccttccccactatcctcctgccttcttcagcatgggcctcctcccaaggcttggccactcccagcatccagcacccccacctctcagctgggttaggaggcaggcggaggcttttcgcgggggctgtg

SEQ ID NO: 93304 - DNA, 1038 bp, Homo sapiens
tctgtgtttgcaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccgggtccactgtggagcagccatctatctacctgactcctgagccaggctgccgtggtgtcatttctgtcatccgtgctctgtttccttttggagtttcttctccacattatctttgttcctggggaataaaaactaccattggacctagaatttgggctcctgtactgtcttcacctgctctt

SEQ ID NO: 93305 - DNA, 1561 bp, Homo sapiens
agcttccctgcagagccggccctgggaagacccctctctgaggactgctgtgtacctccgctctgcttgcagttcgtcctgtactttgtgatggatctcctgaagggcctgccaggcctgccagggctcttcattgcctgcctcttcagcggctctctcaggtacccactttaacgatttccctcaggcctggtgcacctgacccctatttggtacaaggtgatgggtggagcggggtgatagtgggtggggaatccctctaagtttctcactgtgcctgccccatctgtgtgcatgacaagggatagctcatctttgtaggccacagcacaacagagatacccctgttttggttaagagttcttttatggtaccagaaattgatctactcgaatgaaacccatatccacattcaaaaaaggactgtgtccttgccttccaggcccgctctgaggtggcatcaagtccaactatgaggaggtttcttggtggtacctgtcatctccccgctttaggacaccatttcctccatagagtcccatagagctgacaattttgcctcgctcaactcctcatcctcttcctctttttcagcactatatcctctgcttttaattcattggcaactgttacgatggaagacctgattcgaccttggttccctgagttctctgaagcccgggccatcatgctttccagaggccttggtggggttatgcttcctcatctcttcagtctgggtctttctaagcttcatcctgaccattgtcatcagtttgctgtaaaacacccactttatccggggctcagcacttgcctaatgaagcacacaaccttccctgcatgcatggttgtttccatctcagggcatgtcctagggaggtctctgagtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggtaataactatagagggtaggaagcaattttaagggagagaaggaattgattgaaacaggaagttgagaagggcagctatattgaggggaatgaccggggggcaggcgtaagagattcccctttgatggaccgtctttactgtgaacagacttgcaagcagccagaggacgcagggtcattcctgggatgttgtaggctgagagagagctaaggatcagcctcagagaactcaaaacacatccctctccatcagccccctagcagcctttcctgccctctggagttcttttttttttttttttttttttgagacagagtctcattctgttgctcaggctggagtgcagtggcgcgatctcagttgactgcaacctccacctcccacattcaagtgattctcctgtctcagcctcctaagtagctgagggactac

SEQ ID NO: 93306 - DNA, 1010 bp, Homo sapiens
tctgaggattgtggtgtattcttgggggattaacatttcttgtgcaggagttagaaaatcaactttcaactttcccatgttttcagttccttctttccaactccctcccgcacagagtgccaagagtactttaggctgaaaggctaatccatctaggaatgctgttgaatatgagctccctcttccctgttctggagcctctagggctgagttggagtttgggggccatagggtgatagggccatttggaacacagccattggttccctgaaggggccagaacaaatgactgctgagcttcaccccacccccaattcctgatctctcacctcagctactcatagagccagatcctcagctctgcagctccaggcaactctgcctcagaacagggattgcttctccaggtaggtgtctgtccccagcaggatacgaccactctctttggctggtccctttgcctctcagctccgtgactgggttgcttctctccagaatggagaatcgtcattctgaaaccctgactccagcatggtgccctctcacctttcccctctcacttttgaatccagccgctcttcctgcgtctgctgttgactgtgatgttgcaggtagaggggctgagaggtgggtggcagcacttatctagtggtgttggggagaaccttaagaaaggggttggcctggggacgcctgaaatggagtctgtggctgccacagaggcagtctcactgatgatcagttagaagggtgacactggggatcacaggaggcgagggccgaggccaggggcagtaggggaagccctgctgccattagtctccatgctgtgtttcctgctgggctgtggcgccaggctgggctctgctggcttagtgtattgtagtgactgggtctgtgccttcaagtggggctgggaaattctgctaagaaacttaggctagagtttatttttcttttggtactcgggtggagacctaagaaggttgttgaatttcacagctgtgcat

SEQ ID NO: 93307 - DNA, 1030 bp, Homo sapiens
tcagtaaacatggcggcacggcgagcggggcgggcagggggcgggcagggggcggggcccccgcgggctcccggccagggctctcggccgggctctggctacccacgtgtggagaccgggcaggtgggcctggagagcgtgagccggtgccgagaggcaccggggagcggcgtctgagccggggcggggacaagggggcggggaggggcggagcgagccggcctccggcgtgggtctgagatcttaagtgcgagcggtaaggtggtggtctccgccgcgtagagggaagcgggaaaccgagaaagaacgagggtgagggtgatgagggaagggcaaacctcaaactccagcgggaggacacgagcctggatcgccccgggcacctagtcctcttcacctcaatgctgatagcgcatagcgtcccggagcctggcgaggaggtaggagcgggatagacgcttccctaactcattttctttgccttcccaggaaaagggagcgatgttgatctcaggaagcacaaagggaccttcctagctctgactgaaccacggaggtaagggagtgcgttgctgccccagggtgggccagcgccctgactgaagggcgccaggggatccctgctcccggcgcgacagtgttggttagggccagccagaaagctccttaaagccgacccaagtgatcatctcgagtagccgagccaggcttcccttccacattacccccatggtgtctgcctggaagttcctgaaaggtttacgtttagctggctggcaaattttctaaggtgttagtagctattagcattttaaggagggcccccaaagcctttcacaccttgaggaattataggccccaggacagattttgagggaatctttttggaacagttagtcctgcagtggtctcattgccttttgtaggagtcaatgcgatccactgcagtgtgtgaccaaagtgagttcaggtttttatttttatttttatttttattttgagacggagtctcgctctgtcgcccaggctg

SEQ ID NO: 93308 - DNA, 1053 bp, Homo sapiens
tgtaatctctctacgcacgaacgccatatatcgtgcggtggtagggctgtacttttgtaatgcttgatgagttctttacgtacctgcggtcgttttacaccgcgccaaactagggctgtcagattgagaagtctctgcagaaagcataataaataagttcgaatagtgatcttcagagatgaggaccttccctgtgcgatatctggtactgaaagtgtcgggagctgattcggcgcaggactctggaggaagagatggcatctcctagcctagcctgttacaagggtgggacacgagccgtttatccatttatcggccccgtgttagaggaattctggaaacgtgtactggcagttaattcttgatcgccgtttgttcttttcttggcttttctttctggagttctaatgtttctttctcttctgcagatatgcacccaatgtccagggagcgtgcaaaatttgtcaaaagtggccttttattgtaaaacgacacgagagctaatgctgcatgcccgttgctgcctgaatcagaagggcaccatcttggggtgaggggaagacatccctagatgctggatacaggccattccttagcctggctgcttttatacccttatattatttaaagaatccacctattatggtttcagctgtaatcatcacgcagatgtctaccaaaactagatctctttagtgtcttttttaacctttccacactccaggtacatacgggtacctctagcttcctattaagcatttcctactgagtgcaccctaacttcaaactcaaaatgttatgttttgcttccattctcttctttccttcatctacctaaatacttctctgtattaagcttttagaaaaccaacattttccattatcactctcttgctttaatactatatttagtattaaattttgtctcaggacaaaattcaaaccattaagtaccatactagtcccaacccacttttccaacattatttccaattacttgtccgctcaaacctccataatggtctgcaccagccagatttgcctgccctcaaa

SEQ ID NO: 93309 - DNA, 2045 bp, Homo sapiens
tcctaggttcaagtgatcctcccccgcttggcctcctaaagtgctgggattacaggagtgagtcactacacccagcctaaggtacattaatttaaatttaagtagttacatgtggcaagtggcgattctattggataatgcagaattaaaatgtctaccacagctcctagtgtgtgactctgaacacagctgtgttcaattattagctgaaaagggggttgtgtagtcaaatacaaactgtgccgtggctgaagaaaaagaggaacacacagttatattgattactttatttcctcaggctggatctccagaactgttctctggaggaccctggtccaaactttcatcaggcacataccactgtcatcatgtaagtagttaggtacctcccacccaaaaggctaatataatgtaggttgatgcgaaagtgctaacattgtgtactttgcagagacctgcaagcaaaccccctcaaaggtgacttggccaacaccttccgtggctttactcagctccagactctgtgagtaagggtatgggaagagaatcaaagagggatgatgctgtgagtttagcaactttgcatgttatgaccacatttctctataggatactgccacaacatgtcaactgtcctggaggaattaatgcctggaatactatcacctcttatatagacaaccaaatctgtcaagggcaaaagaacctttgcaataacactggggacccaggtatgctgtcttacctccaaacttctgggaattgtcttttctcccttgtattttccactttagatcagaaagacaaagttgcttaagcgcctttcattcagagttctggggctataacccctttgaaagaaaagatcttaagatatactctattatttgtctcacgtgtgtccgtgtaaagagaccaccaaacaggctttgtgtgagcaacaaggctgtttatttcacctgggtgcaggtgggctgagtccaaaaagagagtcagcaaagggtggtgggattatcattagttcttacaggttttggggtaggcagtggagttaggagtgctgttttgcgggcaggggatggatcttacaaagtacattctcaagggtggggagaattacaaagaaccttcttaagcgtgggagagattacaaggaaacttcttaagggtaagggagattacaaagtatattgatcagttagggtggggcagaaacaaatcacaatggtggaatgtcatcagttaaggctattttcatttcttttgtggatcttcagttgcttcagaccatctggatgtatacgtgcaggtcacaggggatatgatagcttagcttgggctcagaggcctgacattattgttactgtttttatctgtaattttctttcttcttcctttatcctagcaatgattgagagaatctaagttgaaacagataattgagaaatatgcctaatgaaatggataaagtgatgttctctatttctctctggcctccagaaatgtgtcctgagaatggatcttgtgtacctgatggtccaggtcttttgcagtgtgtttgtgctgatggtttccatggatacaagtgtatgcgccaggtgaggaattaggccgtctaactagggatacaaggaatgcatagagcaagtcttctcagaaaggagagccacaagaccaggagctgatacaaatttcctataggtggaaaactatagaattgccctagacaaagtgataggtatattaggaaagaactaggtgttaggatgtggccctccgtgtaacgttgtatgggggtgttttttggtctgttgttcacagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgcc

SEQ ID NO: 93310 - DNA, 1392 bp, Homo sapiens
agatgaaaaattgcactcccttggtgtagacaaataccagttcccattggtgttgttgcctataataaacacttttttctttttttttcctctctttctttttaaggaaaggcgccctgcctttacgtgtttcttgcttggggtgggagggactgctttagggcagccggttttttcaggtttcccccggttttgcagtgcggagaccacgggggcccactccccgtggctccgcggaccccgccccttacgtgcccggccccgcccctcacgccgcctgtgtccgcgccgccgcagtctctgctgctgccgccaagcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtgggtaagcaagcccggttaggctgcagaccttatcccactctgtgatgcgcctctcctcccaaccttccccgtccagaccccgccattttcccgccagcgtacccccttcccccattcggtgcccatgggccccagcgccataaacccctcgcgaccaaggcagcctccactggggcgtgctcatcgcgcggggagtgttccgaagggtgccctaccggagcccagccctgcttctttcttgcagtgtttcaaaccggcatggtcggctaccccgaggccctcaccgatccctcctacaaggcacagatcttagtgctcacctatcctctgatcggcaactatggcatccccccagatgaaatggatgagttcggtctctgcaaggtagccacacccagtgctttctctacattccttttcaagtcagtaattgttaactattagtgaagtaggagacgttgacaccctgctgggcatcctgcagaaaacatacccactgaagtagtaaagtcaaggactaagatcactagtaactgtagttaggggttgttaagtgccttgggaggcacagagtgttggaggcctcaggaaaaagctaccgcctttgttaagggcatcaaggctccaggtatagctgaaagcattctgtatgtagtgaaggcatggatcaaggaaaagtaaaagaggtgtaagggaacagccttgtccaacttgttaggcatgcagaagtcaggagaaaaaagcctgcagataagttaaatccggtgggcatggagggacctgaagccaaagcagagtcagcttagtttggtaaaggatccattgaaggtttt

SEQ ID NO: 93311 - DNA, 1018 bp, Homo sapiens
ttgaggctgtagtgaaccgtgtatttgtgccactgtactctgcactccagcctggataacagcaagaccctgtctcaaaaaaaaaaaaaaggaatggctaggtgcgatggctcactcctgtaatcccagcactttgggaggctgaggtgggcagatcacaaggtcaggagatctgagaccatcctggctaacatggtgaaaccccgtctctactaaaaatacaaaaaattagccgggtgtggtggcgggcgcctgtagtcccagctactcgggaggctaaagcaagagaattgcttgaatccgggaggcagaggttgcagtgagcttagatgtcgccactgcattgcagcctgggtgacagagtgagactctgtctcaaaaaaaataaataataaataaataaaaaggaaaatgtcattttcagtgatcatcggggcaccctgggcctgtgggttgtgtttcgtataggagagagcgttgttggtaaatggaaatacctatgcaaaagcaccaaaagtttggtatattgaaggccattcaatgtggctgaatatagggtctgtggccacacaatcgggaaaatgctgcaaagaaataacttggcctgaggcttctcacaatctctttccatctacagtggtttgaatcctcgggcatccacgtagcagcactggtagtgggagagtgctgtcctactcccagccactggagtgccacccgcaccctgcatgagtggctgcagcagcatggcatccctggcttgcaaggtatggtggcaagcaggggcatatttgggcagagcacagcatgcctggatggaaagaatcaaggtttctgtaatctgctgggacctgactctaagattgtgatagttggaaggtttagattggagttgggctgggagaaagaattgaactatcactcagaaagaaaatttccaacacaggaaggaactcccaccttccataatcatcagcttagggctaatcttatttcatcaccaccactggattatttt

SEQ ID NO: 93312 - DNA, 1353 bp, Homo sapiens
aacagggttcacacattgcatttggttgataagtctcttaatctgtggaccttgtaacctatttgaaaacaggtcatttttcctgtatctagtatcccatagtctgcacttacttggttacactcctgtagtgttacttagcgtattctttttttccctttatattattttctataaatggatagatttagagttgttcaattcagatgtgatatttttggcaggaatacttcatggtagtatacttctgtcacaatggcccaggattttgatgcacatagaacagctgtgtgtgactggggctctggaatggaagtgcttctggaagtctaacctcacagatgactgagttgtaggaatgtgatccctaagactgtgctattttgacaggagtagacactcgggagctgaccaagaagttgcgggaacaggggtctctgctggggaagctggtccagaatggaacagaaccttcatccctgccattcttggaccccaatgcccgccccctggtaccagaggtctccattaaggtacagaggtagagtgggagagtgttgcaagctctagcacagtagttatattctgcccacaattggggggtgaacacaggagagaatcaaaggaggctttgaaggtaggagttggtgcaggcatatcttatacccactgagcacagctgccaactgttgccctttattcgtctatttctcagactccacgggtattcaatacagggggtgcccctcggatccttgctttggactgtggcctcaagtataatcagatccgatgcctctgccagcgtggggctgaggtcactgtggtaccctgggaccatgcactagacagccaaggtgagtagctggggcctgttcagggcctcagacaagcagcttgggtggaagatctatcccttggtccaattgctaaaagtcagtaggagttgcagtgaagaagatagacattgggacttaacactctcatgggctgggggggctgcaggtgtgtctcctgtaattgaaatactgattttgatgtcatcttttctgcccactccagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgaggtgggacttgtggggagcagaaggggcccatacttgtggcatgaggggtggggtgtctcaggaatgagaagagagttggtgtttattcgtgttgaaataggagcgggggggttgcaggt

SEQ ID NO: 93313 - DNA, 2901 bp, Homo sapiens
agtgaagagagggtgagcagggcctgtgactcggcatgcttctacctccagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcaggtgagcctggttgactgggtctgtgaaaatttgaagccctgtgggccttgatgatggaaaagtaaagcacggcagtggatccgagtcccctgtcccactacccacctcgaggctgccagtgtcatgccagggaccatgatggttttcatgatgcaatctcttcaatagtgtccagtttcacccagagcaccaagctggcccttcagatatggaactgcttttcgatatctttctggaaactgtgaaagaggccacagctgggaaccctgggggccagacaggtaagatcctgagtagaactgggttgtggacctaagaacagggttggctccaggatgggcataaggtggacatgccctgggcaactcctagatgtctaggaggttaagggtattggggatgggtggcaaccaacccaagataccgtttaagcttctgttgaaaggaactccagggtcctgggttctggtcctccctctgctcctcctgaggtgcataatttgctctggactcttctgaaagcgagggagctaatccagttgacctcttgggtccagctcagctctaacattctacgaccttctttgcttccacagttagagagcggctgactgagcgcctctgtccccctgggattcccactcccggctctggacttccaccaccacgaaaggttctgatcctgggctcagggggcctctccattggccaagctggagaatttgactactcgggctctcaggtgaggcatgttcctccccacccttctgggcgtgtgaccctcaagaatggaaagggtcttaaggagaagggctaaggttgcagggaggaaatgaaccagatttggggaatgtagagaaagatgtagtaagaaatagaagtcaattattaggggccaagagtacagggagggaaagaagaggagaatgctactctaaggctgtttgcaattttgcttcttcagcagaggctgagatgccattcttgtccttttaggcaattaaggccctgaaggaggaaaacatccagacgttgctgatcaaccccaatattgccacagtgcagacctcccaggggctggccgacaaggtctattttcttcccataacacctcattatgtaacccaggtatgactggggcaaggctggaatgaaaagaggactgggcaggggggcccagtggtcactgtgggttattaaactttgattgcctctctacccacaaggttctgatgcctgtaactcccctctccatcctcaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggttggaggggtgtttgggtaaaggaagaatggtggtgttttttttggtagtgttattttcttttttttttttttttttttgagacggagtttcgctcttgttgcgcaggctggagtacagtggcgtgatctcggctcatcataacctccacctcccagattcaagcgactctcctgcctcagcttcctgagtagctgggattactggcatgcgccaccatgcccagctaattttgtatttttagtagagacggggtttctccatgttggtcaggctgatctcgaactcctgacctcaggtgatccacccccccgaccctcggcctcccaaattgctggggttacaggcgtgagccactatgcccagccatgttattttctttatatctttttttatgtgggacaggcacaccttggacagtaggaaataacctgtttgttcatctcttccactcattgcaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgagtgaatgggggaagggtgggcgtcgtgtcaggcaggatgagcttttggaagagcagaggcccaggccaaggtctttgagagttgtatgtccctcagacccaggttaggtgcagccccagaggtaacaggaccctggggtgcagccttctgcctctcctgactctgcttggcagtgacctccatggcaccccccttcacaggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcaggtaagctctaggccctggaactgatagtctagttgttaccccctcttcttgtataatttttggcccttgaggttgaggtcttttgggcttaca

SEQ ID NO: 93314 - DNA, 1016 bp, Homo sapiens
ggttacttttctctcctttctgagacctctcctagacagggtcttctaggccagtgactttattctccttctttgcagtattacatcattgaagtgaatgccaggctctctcgcagctctgccctggccagtaaggccacaggttatccactggcttatgtggcagccaagctagcattgggcatccctttgcctgagctcaggtacgaggatgagggagatatcacagtggggaagtgggtcgggggctgaggaaaatattgatgggacagggaatatgaaaaggacattggcctggatttgtgggaatggaaagagctatccggaagctcaccctttatgcttccttcactgtccttctggcatcccacctgctggaccccaggaactctgtgacagggggtacagcagcctttgaacccagcgtggattattgtgtggtgaagattcctcgatgggaccttagcaagttcctgcgagtcagcacaaagattgggagctgcatgaagagcgttggtgagactcatgccctgggcacccccatggggccccaccatgaccaagaatcttaaatgtcaagagttccctggcatggccttttacgtcctatgggagcaggtgcttgagacatttcaaactaagattatagtccttgtcaggagttggggaggcatctggaaatctgtgttggaatacagaatctctgggataggtgcaagccatcagactatctcatctcatttttgcagtatctcctcctctggcactttgtgctttggtcactaaatgacctttttttttagtatgatgtttacatcagagcagggcatcataaacctttttggtaacaaggaaatttattagtgaatgatgaatggccgtaacgttacccagcagtggcagagcatgttagaattgagttagtatgtttctttgtggtatccctttagttgccgaagaccgtcctctaacacatttcaaccaaaacaaaaatatacgtgtaccagacacagcgc

SEQ ID NO: 93315 - DNA, 1026 bp, Homo sapiens
ggaaaagagctataagttaagatttctttttgtttgtttgtttgttttgttttgtttgagacggagtctcgctttgttccccgggctggagtgcaatggtgtgatcgctgctcactgcaagctccacctcccgggttcacgccattttcctgcctcagcctctggagtagctggggctacaggcgcccgccaccactcccggctaatttttttgtatttttagtagagacggggtttcaccatgttagccaggatggtctcgatctcctgacctcgtgatccttccgcctcagcctcccaaagtgctgggattacaggcgtgagccactgcgcccggccattaagatttcttagttgtgaaacaccatgaatcccaccatcatgtgacttgccttgagaatctcccagagtcttgactataaaccataagcattatgggcagtgccttcttcccaccccttccacctccacaccttcattccttccattctgttcttccaggtgaagtcatgggcattgggcgttcatttgaggaggccttccagaaggccctgcgcatggtggatgagaactgtgtgggctttgatcacacagtgaaaccagtcagcgatatggtaagtagctcccctcccctggcaatacccctaaaatagaccctgcttctcatcgcccccagaccatgagcttgttaccagtaacactagcagcagtcatcattggacatttgctttgtttccactttgctgagaattttgagatgtctcattagcacgcaagggtgtattactagacttgtttttacagatgaggaaactgagacataggttatagaaattactcaaagccacatagccaatgagaggtagacccaggattggtatccaggtttttgcagttacacagcctgtgctctggtgtacagtttccccttcctgagacaagagcagctacttacgctcaggcttttagatgggctggcagtagcttccgtctgtctaccccctttctatcaggagttggagactc

SEQ ID NO: 93316 - DNA, 3830 bp, Homo sapiens
gaggaaggagagtgtgggagagctttagaggcttctgaccttggttccaaggatatttcctctcatctgtgccctggggtctcaaccctctatcagtctgtaccctactctctgggcctgtgtttcagaccctttttctattttagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaaggtcagagagttcattttctttccactttccttgctattctgttcatctctagcaattgcttggcactaatcctggcatttcctattaattgccgtcccttactttggtcatagagctttggggtgggggtccttttaggccatctctcatgccccacacggtatatgaatctcttccccaacactttgtacctccttccctcccaaggcaggggtcctgtacagctctttcagaggaagctgtgctggcagtctctgaagtaggggctttggcttagtttctccacgattttctccacgattttcctcccacctgactgctaagtacccttcccctccctcttgcagatgggatataagaccatcatggtgaactataacccagagacagtcagcaccgactatgacatgtgtgatcgactctactttgatgagatctcttttgaggtgagggagatggaggcttcctggtagcttgagtggccagggtcgagtagaacagctggctgacctaagattctttgaaacttggtggcggctgagggaagcagtgagcaggaaggctcagattcctgccctcttttgctgccaccacttgtttctccccctgcaacgtaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgaggtgggctgggacctggtgggttacccggaggctggatgatgcttgggggaaagtgtgaacaactcagctaagctccctgcctcctgtagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggtgggaggctgcagacagtgaagtctctgagggcatgctgccagccctggaggagacttccttctctggtccagcagaatcataggcaccagggctgggaacagtgggctatgtggggctcgttaaaggaagagacaatcctagagtaagtgagagaagaaagtggccctatgtcccactgtctgtgtccccccgctaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggtaataaggctaaaggaaagaactaaagggccacagctcttgcatgttctgtgctggccacagtgccatgaagccctgcactgtctcctgccttcatccaagtaggcagggaagctggagggaaagggctgtagctagagctcatggtgttggggcttatgacagtcagtgaccctgaaccctgctcagtctgatcccccagagctgaggacggagaggaagagtctaggcctatagatagtgtcagcaaggccaacctgcagaaggcctgaccagtcttctctgccccaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtaaggaatatcgaaacccttggggttagcagaaaaatagcgggagagagttcactcaccacacagagttgtcagtatgtaaaccaggcactgactgcaaggcattgccggatcgtgggggtaatgaggtggtcattgtcccttaagagcttactttatggtaatgggagggaagagaagttggatccccaaaaaagctttggtatagaacagtccgtggtaaaactacatattcgacctgtaaacagaatgctgcaggagttcaagagacaggaggtgctgcttccaaaaggggtgatctgggaaggcttgagcgaaggggtgctatttgaattgagttttgaaggatggttaaggttttttatttgcaagggcacatcctaagcagaagctgagggatgaccccaagtacgtttggaaagcaggagggcacacagagagggcaggctgaccctgccattcagatgggatcaagcacagggtactgtgtccgtctctgctggtgagggaggaggtcctctcacaccttggccctctctcttccctcccgcccctttaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataaggtatcagaatccaggagggcttcccgagggccgtggctccctgggccagggctgaccttgaaatggaagacaggaagaaaacaatttcatccttctgtttggtttcagaacaaaagcgagctgctcccaactgtgcggctactggagagcctgggctacagcctctatgccagtctcggcacagctgacttctacactgagcatggcgtcaaggtgcaggaactctggcaacctaccccactgctgcccttccccaagggggtgaaaatactgcaccaaagaattatctgggctgggcacggtggcatatacctgtagtcccagatactcaggaggctaaggcaggagaatctcttgagcccaggaggtagaggctgcagtgagctgcgagtgtgcagtgagtgcaccactgcactccagcttgggaaacagtgagatgctgtctcaaaaaaaaaaaaaacaaagaattatctcctattcccctgcttttattattaccattatactagtaagctatattccatgcagaaagcagaatacacaggaagcaaagagaaaagtctcttaaaatctctgtaccactgttctgatatttttccttccaggattttctctgtgtacatgtgtgtgagctcatactgcacctagtccttggtaacccatcttacttagtgtagatatctttcctgccaagaaatacactt

SEQ ID NO: 93317 - DNA, 2467 bp, Homo sapiens
tggcaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggtaactgagacccatgtgctgggagggagactgccagtgttgatgggaagaagaaagagggaggagtgagtatggaacagccatgctagtaataaagctttgtggctacagagggagagatggtgggtatagagtgtgcagagcctggtttatgggaaaaccacatctctccctacaactcccaggatcacccttcccttaaagctgactgctttccacttgcaggccctaggccagatcgggccagcccctcctttgaaggtgcatgttgactgtatgacctcccaaaagcttgtgcgactgccgggtaagtctttggggagaacttggcttctgaacactggcagcccctggcatagagacctgcagtgtggtgaaggatggctggggggcccactctttgtcctggactgcacagactgtgaagaccccagaatgtttctcactctttcattccttaatccacagtgtccacagtggccttgtctgaggaattttttttttttttttttttttgagacagagtcttactccatcgcccaggttggagtgcagtggtgtgtgatatcggctcactgcaacctccgcctcccaggttcaagcgattttcctgcctcagcctcccaagtagctgggattacaggtgtgtgctaccacaccaggctaatttttgtgtttttagtagagacggggtttcaccatgttggtcaggttggtctcgaactcctgatctcaggtgatctgcccacctcggcctcccaaagtgctaggattacaggcgtgagccaccatgtccagctcacccttcctatttctgaatcttcctgtaatcttgctgcttccattttctcccaggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaaggtgagccactgcactcttcctggtattggagacccatatgcccctaccagccacccttgcttccctgagcccttttccttctgccccgccctatgggcccaggccactggtgccaggctagcctgtgtgggcatgggtgccagtgagccttacctctgtgtatcctctccagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggaggtagggagtgtgcatgtggcaggaggccaccacccagtgtctcctggcttgtgggcccctgcctaagtgggctggtagcagtgaggattcaggggagctcctggggactctgggctctgatgagcacagtcagagattctgcacactccttcatcagttctttctgctcccagcatttcgagacatggccctcccacctccccattgtggctcacgcagagcagcaaaccgtggctgctgtcctcatggtggctcagctcactcagcgctcagtgcacatatgtcacgtggcacggaaggaggaggtaagagtacacctgagatcctgctgtccctgttgctttcccagtaacaccaaaggtcagggtagtccttaggggcaggagacagcaggaggagagtctggagacagcaggaggagggtctcgagccagcacccttgcaggtctacatcatcattttttgagcagggatgttggccattgggactttgtgtagggcaaggcatatgggtggtgcctcttctggatcttcccattgttccccagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatggtgagagaatccagcatgtacctcctctgcccagtggggcttgtgggacagccctagcaagaaaatgggaagcaggccaggcctcaggactctactaggacagggtcttgat

SEQ ID NO: 93318 - DNA, 1003 bp, Homo sapiens
aaagaatacatgggtaaaagtgtgggctccagaagatggcagcagtcctgttgcccttgtttctagttcccagaaaaaatgagcattgggagtggtagtgagcataaggaggttgttggaagtgcagtcctggggtgtgagtgacttcctagacatggaggtgattggtcctgagggtaatggctttctttctcccagctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtgtggggatgaggcccagagcaggaggggggctctccagccctaggatatgttctctggggatcctttccctagcataacccatgtcctctgggcaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggtacgcaagtagcccctgcctgatctcagtagtgccctcttctgcaccacgttcatttcttcccttcccagcacatctacactgtcccactatgtgcaccactgccctggaccaggggttgggggcacagctcccccaaggtgctttttgtccttgctgacatctacccctttaggacctgagttctctctgctccctcctgagtgccctgccttctgcctgcaggttctggtacccccgggctatggacaggatgtacggaagtggccacagggggctgttcctcagctcccaccctcagcccctgccactagtgagatgaccacggtatccacactactgggctagggggctgggaggtgttagtctcagggc

SEQ ID NO: 93319 - DNA, 1067 bp, Homo sapiens
ctcagccataaatgtatatctgtcctcttgtcctgtttgcagctgaggagccaaaggagaagtcctctcggaaggtagccgagccaggtgagactccaccctgacacacactcacctcggggacctctgatctggccttggtaggaggaaccctctgaccagccttttctgccccatccctcactgcagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcaggtgcctggggcagggaggatgggaccacccagagctttgaggatttggaaagctggggctaggacctttctagctaacttgggctctttcttagatgtctcacctgttcaatgtggcacacacactgcgtatgatggtgcagaaggagcggagcctcgacatcctgaaggtcaggatcagggccgggggtagggtccaggccatcgcctgcccttgggccgcatcagcgcagggccgcgcagtggtcagagtgggtcttcctccccctgccatcccgtccccttatgctagtccatccctctgctgctgtagatcttcccccacgttttccctccccaaagcaggatttagctggctggggaggccctgagcatgagaccatcgccccactagtggggtcttctggtctgggctgctgcaatcatgggagagagctagggtgtgtcctcctttcccagctcgttcagacacttaatgatgggtggttttctggaggcagagcctttagctcagagtgacaccagtggtggaaacgtcaaggctctgacaggtcacaggggaggtttgggtgcagaagggtcctcacagcacccctcaagtgtcagttggggtggtggtgcctagctggggtttccccagggtggacacgcatacgtacaccttccatcttgctctttccctaggggaaggtcatggcctccatgttct

SEQ ID NO: 93320 - DNA, 1039 bp, Homo sapiens
acggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggaggtgaggccagcctgggtactgagatggggttaagaaggctggacccaggggcatgagaacccttctgcccacgttttctgtgttttgggccagatgagtgaggggaccccagaagagggggactggcagttggggggcctctgagctgcaaaagacaggattttccccttttttccagctggccgccaagcactgccggaggccagtgatcaatgctggggatggggtcggagagcaccccacccaggccctgctggacatcttcaccatccgtgaggagctgggaactgtcaatggcatgacggtgagggtggtggcagggtttggatccctgccaggggacgatctagagagggaggcaggaagtggttaccccggtacaggacagctgcatcaaggaggccttcattctgctccagaggcttttaaaagcttggaaatgatgtcggggggcactcagtctgggatccctgtggtgactggattcctctcctagatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggtgagaccctcacagccctgcctggaagccatggagatgtgggttgggcagtcagagcccagcgctgcatccaccatggctctcctcaccctccaggaggaattcgagagcattgaggaggcgctgcctgacactgatgtgctctacatgactcgaatccagaaggaacgatttggctctacccaggagtacgaagctgtgagtgctgggct

SEQ ID NO: 93321 - DNA, 1038 bp, Homo sapiens
gcacatgatagtgcaaactgctctgacaccattcaggaatcacctacttcatccagagagtaacagcgtattctagagatgagaaaaggagaaggacctcgttttttgagaacttagtgtgaacaggaacttgatgcgtattctcatttctcacaccagccttccacccatttcacagatgtggacactggctcagagaagtggtgggggccggtggctcacccctgtaatctcagcattttgggaggctgaggcaggcggatcacctgaggtcaggagtttgagaccagcctggccaacatggtgaaaccctgtcgactaaaaatataaaaatcagctgtgtttggtggtgtgcgcctgtaatcccagctacttgggaggctgaggcaggagaatcgcttgaacccaggaggtggaggttgcagtgaggcaagatggcaccattacactccagcctgggcaacagtgacactcttatctccaaaaaaaaaaaaaaaggtggtagcttgctgggccactcaccttgagactcatacgcaggacttcttgacttaacaacccacctttctgttaaaaggaaaggtcatttctggctttaagggcatccaaaaaccagtgggaaagacaagccacaaatctaagcagtcctgtagggaaccagtttccagaagaggtcagcacagatacggagtcggagaaccctgtgccgtggggtgtgagctgtgtcgtgaggaaggacgaagagtctcctttacagtacagttcgagaggaatggaaattgtgtctgcggtacagtgaggagacactgaacgcagcaggagattcctactgagtattgtgagggttgagagtctgacggaccagaacagggggcttggatgtcaattccaacaaaaatattaatttacaaccacaggtactatttgaaggagggtattaagtataatgctaagtcctagagtgtggaggcctccagtcctgctaatgttaaccctttccagtctttccaaacccagattcctgcctgacaaggtctc

SEQ ID NO: 93322 - DNA, 1053 bp, Homo sapiens
tttttttttgagacggagtcttgctctgttgcccaggctggagtgcagtggcgcgatcttggctcaccgcaagctccgcctcccgggttcacgccattctcctgcctcagcctctccgagtagctgggactacaggcacctgccaccacgcccggctaattttttgtatttttagtagagatggggtttcaccgtggtctcgatctcctgacctcgtgatccgcccgcctcagcctcccaaagtgctgggattacaagcatgagccaccgcgcccggccaggctggtctattcctgggctcaagtgatcctcctgcatcagcctcctaaagtgctgggattacagccatgagccaccatgcccaacccacctataggctttaaaagggtagttggcaattcccagtgtaaaattgcaaagtgtctgtagttctgcagtaatatcccctgggacaatgagggggcattggctggtggaggtgaggagcagagaatgagggccaggatgggatgagtgcttaatggaagactcgtctggcaacagtgcctagaagagagaaaggagccatttcaccatcaggacgccaattaggaagttgttgcagtaaatacagatcatgggtgaagaggttctagattcagagataggaatagatgttataacactgaggagagaggagagtgaagaatgactgcacagtgtgggacctcaagactggaagaaagaagactgatgaaggtagaccagatagccagtttggggtaggggagggctgattccatttgggcatgatacctagctgccgtgggccatctatatggagatgtcatggaggtaatggagctggggagttggagcaagcacaatagagacaggtggcatttatatgtgacaacacaagtgccatgagagcagggactttactcactgatgtatcccaaacaccagaacagggttgagcacatagtaggtgctcagtaaatgtgttgaccgaagcatcaacataaaggtaattgaagcttttaaaatatgcatatttgttcaccaagagaa

SEQ ID NO: 93323 - DNA, 1460 bp, Homo sapiens
gttgcagtgagctgagattgcgccactgcactccagcctgggcgacagagggagactctgtcttaaaaaaaaaaaaaaaaattagactctgtgctttgattttagatctagtgcttcaggccttcccaccatgttgataaaatcccagcccaaagcaaggacgttgagcattttcaatagcccatgcatatttctgtgagccttcctcataatagaaatatctttattatcagattatttttactataaaagcaatatatacttgttttaagggtacaacaaaggaaaagtatataaagtagaaagtgaatgtttcccctgtaatcttactttccgagaaaactgctaatcctagtatggggtcagtatttctacataataacaaaaatggggtcatcttataggtgagatcgtgttacctgtgtttatgactcaaccatgcagcctagactcatctttccatgtcaagaccatagatttcattcctttttaaaggtgaggcttttggactcatcagaggtagccccctccctgatgtccagctgggagccttagcccaggctgggtgagacgccactgcccacgtcagggtgtgggaggctggcgaagcgaagggctggcagtccatcacgcccggcggcaaggccgccccagctgctcgccatgctttgctggttcctgatactttctcattttacgtctcattgattataggccccaggtgacaggatgggggtggggaagagtgaggaaatcgaggagagggaaggagggtggggaacaggaggactcgattttcaccctatgaaatgctttaagccacagcctgtcctatctgtgcgatgctgggtccctttgcaggggaatgctcagggcaggtgaatgccttcaccaagcatccagtccatcttctgcccatagaaggaggagactcagggagggaaaaagacttccccagggtcagccagcacatgcccaggctctcattcccactccaggcccctttgaagctcttgcctagttgagtttctcagcaaatctttcctcagcccttccagcagcctgctgccgctggcactcccgtcctggggctctggggtcagaccctctggttctgctctgcctttactattattctagtcacagttaacctctctgcgtctcagctttctcaattataaaatagtgattacgtgatatcatgggtgtgaatgtgcctggtatatagaaggtgtatataagagttagcttttgggttgaacccaggatgcaggggagagatttcaggagaagagagtggcccggcaccctgacagcagggacaggaagcagcaatcattgagcttattttgtgcaaggcactgtggtgcggacagtatcctgtgcacctgacagatggagaagcaggctcacctgcccatggtcgtgcagctggttccactcggttctgagttctggcc

SEQ ID NO: 93324 - DNA, 1098 bp, Homo sapiens
aggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcatctttcagcctgtgtgctgactcctcaggagggggaagtcaaataggtcacttgagaacaacagaatccctcctgtcccttcccagcctctggagtgacctcccacagacctcctgtcccttcccagcccctccaccctcagatggagggtaaaagccaccagtctctttactccccttcccctggctcacagcatgcctgggtccttggctcagggacagtcccatgtgccctgggcttggttgcaggagaatgctggaaggtaaggagccaaggaatccctgggagtcagtcgttctcagaggtccctgcatgccagtgggcctcaggctggctgg

SEQ ID NO: 93325 - DNA, 1114 bp, Homo sapiens
cagcccactccttcccaggtcccaaagcttccttcctcctccctccagctcctccctcccacctcccaggactctcccagacatgagtcatgttccctgtcccctcttcagggttttgaggggcctctcaggtcatgtttgttcaagatacccctagatcttcctctgaaaggtccctggttgttgggcttaggggtctctttctctgcagcctcaatacaaggcagccgaccccatcagcaccttcctcttctccatctgtgcccttggatccaccgctcccaccctccgagacgttcttcgaatcctcatggaaggtgagtcgggcaccacagctccccatccctgtggccctctctgactttactctcgcagtgggccatcacttttttctttgaagatagtacgggaagaaggcttggctcatggggtctgctgctggaacaaggatttgggcatagggtgaattgtaggggtcaaaaggagagtgcatacaggataggggaggtggaatccagtggtgggggtgctgcttctgggcaggagtagccctagcagtaaggcatgactggtgctggttgcaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcggtgagtcacactggccccagctagttactacctggaacataccccaccccaaacatgggaccatagcttgagttactggaattgtttcagtcttttttgatctgtctctgtttctctgtgtctctctctctcacatagacacatacacacacacacacatgcacgtgcgctcgtgcatgttggagacaaggagtctccatccactggatgcagtgttctgggggcagtttcaccctctttgaagtagcacagggaaccaacaaccctttaaaagatcattagtacctacaggtctagtgatggggcacagttaggtaaattacagcacctccaccctgaggtatcacataactgttaaaaatgatgcttgtgaagactgtacagcaactatgaaa

SEQ ID NO: 93326 - DNA, 1053 bp, Homo sapiens
ctcttcaggtgtccttttgattttggttcagcccctgctacgtcacccctcttccccgctcaatatcggttgttggttgggggtttcggagggccagggagaggaaacagcctttccttgtctctaaacagcatgtagccaccccacatgcccacacccccacacaccaacagccaggcttccttagtgcccaaattatgcagaacaaaagggagcagcctgttgatgggtggccaccttgatgactggctgtgctgtgccttacaaggccagggaatgaatgttgcccactgcccccaaagccacccagcctctgcgcttcagactcacatctccaactccagtccatcttcactcatatgaccattagtcaccgaatcctgcagcattttctgaaaggcatttcctaacctacctgcccctccagggaagctctggcctggtttgttctagacccctccatttcctctcttctcctctcttcctcccatcagcaaggtcatctcagtgctcaggagatatttgttcaagcagtcagtgtatctccctttatgttcctttgagcccatcactttcctcctcagccctcccctgacacttcacgcttagactccaagccacaaacctcgtctttgtcattctacatgtctggaacacccttctccaactaggtctcatctccttaaacatacctttctctgtgaagttctccgagcccgctgtgagggagtgctcccttccctgcaccccaaagtgctttgttcataaccctcctagcatcaacctgtccttatgtagtaagccatttgttacaatctgtctttcccaccagaccaggcttcattatgtgtgctctgcctggtgcacctcattgaatgaatgaggatcggtttcacagcctccttcaccacgccatctcctctggaaacacatccagaatcatacacgcccagattctaagtcttggatggggctttggaaattcaagaaattaatctaccagtatttcagttctctgtacaagcaccaaatgttccccctacctccctcaaa

SEQ ID NO: 93327 - DNA, 1004 bp, Homo sapiens
tgtccgttcaggctggggccgccctggtctttcaaacccagcagtgagcttggacagacccagaggtgtttactccaggtaataggagctctagacaaaatcaggctcttttcctggcttagacctctccctgcttacaacacctctaggatgtgggatatctagaggtctgtgtagctggaggatgctgggaaatgtgaggagaagatgtttcctccttaaaattggaatctttctgatcacctgaattctcctgctagccacaaatcccactcactcttatcttatccttgtccttctgtcatcgtttacctgcctaatccctgaaggtagtgagtttcctgtcactggaagtgcacttctcggtacccttacttgtagaagttctcacagatgctgcttctcctctggctcagatcatgtctactgtgaaggaagcagcacaccggctgtccaaaagtgagatgagcctctatgcagtgctggatcttaagaagggcgcctcacctgaagacttcaaaaaatcctacaggttcagacctcagccctttattgatccttggaatttcccccttaaacctttttctttctgtatctcttttgctatctgactctttttttttttttttttttttgagaggaagtctcgtcctgtcacagagcagagacagagactattgagagtgcagtggcacgatcttggcttactgcaacctctgcctcccaggttcaagcaattctctcacctcagcctcctgagaagctgggactacaggcgtgcaccaccacgcctggctaatttttgtatttttagtagagacagggtttcgccatgttggccaggctggtctcaaactcctgacctcaggtgatctacctgcctcggcctcccaaagtgctgggattacaggtgtgaaccactgtgcctggcctacgacccgtttgtttgtttgtttgtttgtttgtttgttttgagacagtctcgctctgttgcccaagctgta

SEQ ID NO: 93328 - DNA, 1140 bp, Homo sapiens
ggcctctggattcccttctgtggctcactcttgaaatagctctgctttctctcctgtccctttaacaacttgtctcgtcccagatagcagtcttcggacagtctctactttctgctctgcaccctcgccaggctcacgtagttttagctatccctctctctctgtaaaattctccttttgtttcccaaatgactctctcttgttcactctgtgggtagcactgtttgtcccttactccccagagagcagattaattttactgtgggggttgggagacaaggggcatctgcatgacattccaattcccaatttagctcatgtaaggcgagccacagctgtcatggagtgagtgaccctgactcactcaggaatgggtgactcccttgagcaagggcaggggtgagtgccactgcttacagtgaaaggtgggtcagcaaaggtgctgccctctcactctgaaggctcctctcagcccgggacccctgttctggcttgggcccttcttccaggacagtgacacagaatctaaatctgcctgtgtgagaggcacccatacatagctcagggtgggaggaaagatcttgccagacttagagtcagtagcggttgcctcctccacaggctcagccagtgaccctggtcctcctcctcaagactgtgtgattcagaacagcagctccagggactacatcaagcctcttgtccaacacctctggctcatttttgttcttccctggccttttcttatatcaccctaggaaaagaagctcaagaggctagaaatgactgttgtgccaaggcctggacctacctatgagcatgcccccgaggaaatgtgggattctggtccgtgaacacatccctggagccactccaaggactcaaatttgttaggaaattgggagaaggtgagctgggcagaaaggacctgaatgccagggacctattttgggcacccagggaatcaatctccagggaaattttagagcactgacaaagtcataatcacaaggctccgggaagcctctgacccagctccacagttgtccaggactcctactctccaagccaggcttgccccacttgtgagcactggtcttctttttctcctacaagtcttctccacttgatcttaggcaa

SEQ ID NO: 93329 - DNA, 1010 bp, Homo sapiens
ctgtcctcagcgtccgtcagcctgtatgactcacctggctacgtgtgtggtgactcatgctggacagtgtggctatgatgggaactgacacgctgggccctttgcccaggctcagattccctcagggcccataactgccagatggaagattcccccttgtggtcatcaagaatagggagggaaagagtccttatatttccctacctgaggcatctgcagctgacaagggcaggagctagagctccaaggaggcctaggtgccgacatgtggctggagttctgggctcttggtgctggagcccttcagctccacagcctcagtcttcctgaggctatgctgacgtcccagctcagccctgaagcaaaatgtagcctcccagcacttttcccagactttttcagaccatccagacttttcctttcctgctgttcactgtatttggatcaaactacaaataaaaggtggaagtggctttagttcactgagccatttttggaccccagcacagtagttcctaaggtcccatgggatagctcatcacactggaaaacagtacagagatttcagacttagaagaccaggatttgaatcttaaaaccatagcacctagtaggtgcattaatcaggacaagtcagtaagcttctttgagccttagtttcctcttttaaaacttgagtttagggactgggcgcggtggctcacacctgtaatcccagcactttgggacgccgaggtgggcagatcacgaggtcaggagatcgagaccaacctggctaacacggtgaaaccccgtctctactaaaaatacaaaattagccgggtatggtggcgcatgcctgtaatcccagctacttgggaggctgaggcaggagaatcacttgaacccatgaggcagaggttgcggtgagccaagattgtgccattgcactccagcctgggcaacaagagcgaaactccatctcaaaaaaaaaaatcaacaaaaaaaaaatcttgagtttagttatatga

SEQ ID NO: 93330 - DNA, 1030 bp, Homo sapiens
ccagggcagactgatttggaagccagaggcttgccccactgcaccaccctcacttcctgtttctattcggctctcttgaagggttggctgtctttcatcctacactgtccccagtctgttttggagggtggtccccaaggctgtttttaaggggtatgcgtagttggccaagctgtgcagtagggttttaggatttcaaagtcctcaaaaagctgaacagtcagccctgaaggataaaggcattgccccaggaggcctcaacttggaaaacattttaccgtatgcaaagcactttcatatacgttatggcatagggcccccacaaaggtgtgtgagctaggagggttacttgagtccacattagatcacacctaataagtgctgaatcaagactcttaccccagtttttcttggtattttttattgtgaaacatacaaaagaatgattaagatgtgtatgtacagtttaaatggcattaaaactgaacactcctgtgtcagtaatcagctttgagacctcttgagtgcctctccgtaattcacccaaaatttcctgagttttgtttatatcgttcatttgcttttgttatcatttactgcctaaatatgtatctccaaggttagtatattggtatctgatcactccatcctgatccatttggagtgatcagataccagtcactccaaatgcagtgattgagtactaacctcacagaggtaatgcagtgacctacctgcatttgttaccatcttcattttgcaagttagctaatgtaagaggatggcatgaagataagtaagtcttagagggggaatgtcagaaggccttagaacattggggtgcaaagagtgatcacattaagatgaggtcttgcccatgtttagagaaggggaacaggattctagtgatgactggccttctgagaagaggactattggaagggattgggggctactgaaggccagagtggaacagggatcctgtgaccagaacagccctgcatcggcacagaaacttaactgcatgaat

SEQ ID NO: 93331 - DNA, 1032 bp, Homo sapiens
aagcacttgatccattttaggcacttcgcatgtgtcacttgtatgaggtaggtattgccattttacttaatgataaaagagttggagagggtaagctgtctgtaaaaggtcaaggtcatataactagtaagtggtggtgctggggatttgaactcagtctaacttcagaatataactttacagcctaccacatttggtctcctattacatttacttttgtcagttcactcctctagcatgctgttttgcaaatagcattttagttaaatgtttgtgacattgacttctcttgcttccttactctgtttctccaggatttgtggcaggagtctccctgccttaatcataaaggaattgagtaaattgggggtggagctgggcaggtggagagcctgaaagagtgtgcctcctgacgtgtgggctccctggagataagtaaagcctgccagcctgacaagtccattgccagggatattgtagacatttccaacgctctagaaaggatattgctctatattcacagactcttagaatgttagagctggaaggggattaagaaatcacctagcttactggttttcaaacatgcagttgtgggccccgttaaaaatgggtcttttgagaagtatatacttggaaaaaaaagttggagaagcagctgtagtaatgctgcccctctcatccccacacacaaacatctgaaaaatccctagaactgaggagccgagtttggaaagtcaatagtgtaacctccctcattttacagatgcagagccttaacatcaagtctagtcatgaccaaggctgcacagcccgttagtttgggagccaatacctaatgtcttctgaggttctaattccaatgctttctgtggaagaatcatacatacgcagtatttcttaagtggctgtttgcggcaaagcactgaaatagttgctatgaggacgacaaatatgaacgaccccagttttacccactcatgagctcacagttgaggccagtgaagaacctagagacaaaacacgcactta

SEQ ID NO: 93332 - DNA, 1619 bp, Homo sapiens
actcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcctttaagaagaagcgatcaagaagtttagtcctggccaggtgtggtggctcacgcctgtaatcccaacactttgggaggccaaggcaggcggattacttgaggtcagaagttcaagaccagcctggccaatgtatggtgaaaccccgtctctaccaaaaatgtaaa

SEQ ID NO: 93333 - DNA, 2426 bp, Homo sapiens
atgttgatcaggctggtctcaaactcctgacctcaggtgatccaccacctgcattggcctcccacagtgttgagattacaggcatgagccaccgtgtgccccacctatgctttttaaaagtcccttgacgtttatttatagggagtagagagaggtgcattctactctctgcactaggtgtgttcaccctatcatttttcaactgtagattccagacaaagctattacttttttgttgatgagaattagggttaaaataccaggttgagtctttaagccctggagggagtgttggatagctaatcaggatccccacatcctttcatagtggtttggatctgagggtagaagacaaaggtcctaggagcccagagaaagaaattagagcaaggaagagagaacttgcttttaatgctcacacattctgtccttatttcaggcatggtggttttctggaaccttcccactaactcacccctgcagcggatacggctctctgatggctccttaaagctctaccccttccagtgtttcctagcccatgaccaggctgtgcgtacccttcaatggtgcaaagctaacaggtatggaataggaggtatgtggagggggaaggtgaagactgggacaggctgacttccggatttgtttggatttgaccttctcccgtctttttacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcgtacggcaagatggagataggacctctagggacaggccctaagggttggaatgcaaagcatgccagattgttgtggggagaggagggtagagagttggttcactgaggtggtttaaattctggaagaggttaagaagaagaaatgaatctaaagaaaaggaaggtttaaatttatttctcttttaacagttatggactctgtgggattcattatattgacgctggttaccttggtttcaaggcctacttcactgctcctcgaaaaggcaccgtttgggtgagcccccctttcttttgcagtcttcattacaaaggaaaatggctcatttatgcactattagtagtcagaggcagtagttttgggtagaaggagaagatagggatgttgtaactctatcatcagggctgtcggttatggtaaactcatttttgtttgtgtgtctgtctctcagactgtgcagctgttaccagttcatagctctgaatgaatatatgaatgaatgaaatctgtctctttctattagagtctttcaggatccgactggcttgggacaatagctgcaggagatatatccggggagctcattgctgctatattaccagatatggcactgaatccaataaatgtcaagcgacctgtagagcgaagatttgtacgtatacgaacatctaacagcagctgttggatcctaacccacatgccctcccaaattctggtagagtacaaactagtgtcaggtctcccggccctgatatcccagaaaatcttagcacagagttgtatataatcttccctaccgtactgcatctgagcatatatttaaagatactacttttttccatctttaagcctttcctgcccaaaccactttcctctgcttttattctgtcttgagtattatagaacctaatttcatggtctcctttccagcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttggtaagctgaggccaggagaatgggtgtggtattagaaaaggtagaaaactttagtctttgtatagtacgcaagcctgagttcagcacaaagatgtaaaactaaggagcctcggccaggtgcagtggctcatgcctgtaatcccagcagtttggggggattaggcgggcagatcacaaggtcaagagatcaagaccatcctggccaacatggcgaaactccgtctctactaaaaatacaaaaattagctgggcgtggtggcgcgtgcctgtagtcccagctattcaggaggctgaggcaggagaatcacttgaacccaggaggtggagattgcagtgagccaaggtcacaccactgcactccagcctggcaacgcagcaagactccgtctcaaaaaaaaaaaaaaaaaaaaaagggccaggcgtagtggctcacacctgtaatcctagcactttgggaggctgaggtgggcggatcacctgaggtcaggagttcaagacca

SEQ ID NO: 93334 - DNA, 1024 bp, Homo sapiens
attacctttcattaattcctttcttcatcccatctttgatttttctctagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctggtgaggtggggttggacactgccatgggagggtggttgaggacagcaggatggggtctggacaggatagggggaagggcttggattgggctgagacaaggggagcttacctctggcagccctgcgtcccttcttcctacccaccatccccacatgctctctctctccagtcctggcaacagggcccactttgtctatgggattgcttgtgacaacggctgcatctgggacctcaagttctgccccagtggagcatgggaacttccaggcacccctcggaaggtacttcccagtcaactgtgggatggccctaggactcaaagccaggacaaagaggccctgggaattcttagagttgaaggaacgaaggttggagtgtagtggatggagtttttccagcaacttcatacagtatttcagggactagaacctcaaaggttttctgtgagtcagctgaaggcagcaagcctcagcataccttttaccctttaggctcctctcctgccccggttgggtctcttggctctggcctgctcagacgggaaagtactgctattcagtctaccccatccggaggccctgctggctcagcaacccccaggtgagtagcacagcaaggagaatggggctgctgtagtggtggtcacagcatagcagggcctgtctgtctccctggaaactcctctgggccagtctctcttagcacaaagccttactcagccacacacacaccctgcattgtgactc

SEQ ID NO: 93335 - DNA, 3187 bp, Homo sapiens
ccattacactccagcctgggcaacgagagtgaaactccgtctttaaaaaaaaaaaaaaatggaagctttatttgtttacttgtttattgtctgcttcaccaaaatgtaagttccatgagggcagggaccttgtctgtcttgtttattgtcatatcaccagtttccttttttgtttttaatttttttattttattttattttgctagagaaggggtcttgctgtgttgcccaggctagcctcaaactcctaagctcaagctgccttcctgcctcagcctccctaagtgctgggattacaggtgtgagccaccgcacctggctcatattaccagtttccagaacagtcctgacatatagaaggtgcttagtaaatattgttgaataagtgaataatcagggaacttggttatgagtgtgagaatgagggagaaaagatggggaaataaaaatctgagctagtacaaatagtttttgtcctctactcatttgtgtgtctctgtatgcaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccaggtatgtaccttgtcctcttatctttttattccccatgccaagcttaagatgaaagagcagattgagctcataggatcttacaaacctgggtacagtgtaatcttttccatagaggtttgagttctggtcccatctcacagacccatattcttctccacagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtgtaaggattgtggggcatagcttggtggaggggggttgggtgaagggatcagggtggggcagatgttggagagagaagactgatgaggtattaggtaagcaggggtggtgtctggattctagggacttgagcagtcctttaggctcttaccgcagcactattaatggtatgtattgctaacttggtttatctaagaattattgtctgtactttatgtcctatgccatttttcacaaactttacccagctctttattgttttactgtccagtatatgtcagtatatatattctgttccattctttctcttgccctctgtgttctttgactgtggtaggatgaaaaatgtattgaacttggagtgagaagacctgggttcagattccacatttgttatctcagtcatctcggccaagtcacataacttagatttctggtttttcatcttccaagggggaaggggaaattaatagagttaattggttaatcatggggttattgggaggctccattgagataaaaatcaaccatgtctggaaacgtgggttctcagtcatatgtgagaatggctctgactctgtccgttcccacagggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcaggggtaacctcaatggacaagaaagtgaatggggacatagtaggattttaggggaccagcaaggtactgagaaaggaaggacagctttgacctggtaactataatagacaaaacaggttaaagaaaaaagggtccatttccaaaacatttggcatattagggagagcgcagaagaaggggtatggtaaacaagattattcattcatatattgagtatctgttctctgttaggaaacacaacaaacgtaaataagacagtgtatcctgcctcacaagttcacagtgcaatcagcactaccccaggagtgaacaaaatgatttaggcatataaaggaaagggtaattaactgcctaggcttcacagaggaatgatagttgaattgcttcttgaaggataagtagaagtttgccagagaggatggttttcccataaattgattatggctggagcatagagcctggagtaaagttgtaggcgagattaaactggagaatatgaaaggacatagacctataggaaccaacaaaggctgtttttgtttatggttttttttggtggtaaaatgtatataacataaaatttgccattttaaccatttaaaaatacacaattgaggctgggcgtggtggcttatgcctgtaatcccagcactttgggaggccaaggcaggtggatcacccgaggtcaggagtttgagaccagactgaccaatatagtgaaaccccgtctctcctaaaaatacaaaaattagccaggcatggtggcacgcacctgtagtcccagctacttgggaggctgagacaggagaatcacttaaaccaggcagggagaggttgcagtgagctgagatcatgccactgcactccagcctgggtgagacagtgagactccatctcaaaaacaaaacaaaacaaaacaaaacacacaattcagttgtacacaaactgtacaacaaacatttttaagtagaaaaataacatcagttgggaaaataggtcaaactatagttgacagaagacagctttgccagatgcggtggctcacgcctgtaa

SEQ ID NO: 93336 - DNA, 1003 bp, Homo sapiens
ggtgatacatgcctatagtcctagctacttgggaggctgaggcaggaggattgcttgagctctggaggacaaggctgcagtgagctgtgatcacaccactgcaccactccagtctgggtgatagaacaagagcgtgtctcaaaaaaaaaaaaaaaaaaaaaagtggcggggcacagtggctcaagtctgtaatcctagcactttgcggggccaaggtgggcagatcacctgaggtcaggagtccaagaccagcctggtcaacatggtgaaaccccatctctactaaaaatacaaaaatttagctgggtgtggtggcgggcacctgttgtcccagctactcggaaggccgaggcaggagaattgcttgaacctgggaggcagaggttgcagtgagccgacatcacgccactgcactccagcctgggcaacgatagtgaaactccatctcaaaaaaaaaaaaaaaggaaaagctttcttaacataataggatgttccttaattgtcccatagtctacccaccacccccatccaggtgaaatattgatagcagggcaccagagaactctttgactcattcttttttttaaagacagagtctcactctgtcacccaggctggagtacggtggcatgatctcggctcgctgcaacctccaccccacgggttcaattgattctcttgcctccgcctcctgagtagctgggattacaggcgcctgccaccatgcccagctaatttttgtatttttagtggagatggggtttcaccatgttggccaggctggtctcgaactcctgacctcaggcaatacgcctgcctcagcctttcaaagtgctgggattacaggtgtgagccaccgtgcctggccaactcattctttttaaaaaataaattcatttatttatttacttgagacggtgttgctttgttgcccaggctggagtgcagtggtgtgattacagctcactgcagcctcgacctcctgggctcaaggagcctccca

SEQ ID NO: 93337 - DNA, 1131 bp, Homo sapiens
ataatgacactgatctgactggtcagggtggagcccttgtggcctaatcatctcttaaagatcccacctcttaatactgttacaaatgggaattaaatttcaacatgagttttggaggggatgttcaaaccctagctcttggatttcacaatccatttgatgtttttgaaagtgcaggaattttttgttggaaatttccttctgttttctgaatcacttcttcaaaagggtactcttcatctttctatccttttctttcggtatatgcataggtccttttggcttgtgactaattttgaatggggtagttctgtcagggcttcttatttatcacaggaataatatagatggattttcactgacctttatttaccttggcagtgttataatgtatctttagcacatgtgttttcttgtatcctcagcacctgcctcagagggttggccattgctatagtttataatctggttagactgtagcttcttcaagtgagacagttggaagcttttattttatatttcttatgggatttgtataagcacacttttccactgagactgatgaattgtttattcttaaggcgtatatatagatctgtggggggcggggtcccatcctgggatttgaactatgtctgcccctttgtcacagacaggcaggttattctggccaaaaactggacccttggagagttctgtgttgcttaggtttcgggtttggtggtcagtgatttatcttagtttactttggcccatggttatacaactaattttttggggtttgaagaaaatgaagactcatgacaatttagtcaattcttcaatgtggaaaggtttcttggccagacatggtggcttacacctgtaatcccagcactttgggaggccaaggtgggaggatctcttgaggttaggaattcaagacaagcctgggcaaaatagcaagacccaatctgcacaaaaaaattaaaaacgtatctgggcgtattggtgcacatttgaagtcttggctatttgggaagctggggagggaggactgtttgaacccaggagttagtggctgcagtgagctgtgatcacaccaccacattctagtctgggtgacagagcgagatcctgactcagaaaaaa

SEQ ID NO: 93338 - DNA, 2209 bp, Homo sapiens
gctctctcgggcccatccctgacttcactactggcagaatcctccagcggccggcggcgaggacttctttgtctcccagactccgccttgggctcggacgccgccagggttgcaggtacagactctctggtctagctggctcttccggccacaggcgcggcagtccggccggaaaggccggattcagggatccagagcgcgagcccggcctgggagtccgcctactcccggctcccgtcgaggccgcgtgggatcccgttggccgcgcaggcgtcgatctcccctttttgacactgcaactcccatgaggccctgcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgagggtgagtgtatcgccgcagcgggtgtgtggggggccccacaattactcctcccccttcttttgccatagcactaagatattgggaacaaactcctggctccgctcttctcccagccacagcagcgcgcctttcagcgtctgcgctcctacagagcaccatcatgctccgcaccttccctactgtggccaccgtgcaccccccatctctgcaagcctcgggtcttgccctcctcccccacgcggtgtcggtaacgcggaagcctgtgtccgggcgtaggcgctgcatacgtagcgtccctcgaactcggcgaacctacagtagtccttgttagaaaaaccagggctcctctcccgcacaggctaggggagaaatctaccttcacgcccaggactgaagaagggcaggtgatggcccctagagtggttgtgggtcaatctctttcagctgtgtcccagcctcttcctcgaggaggctctttaaccccgagggttgtgccccgcgcgctgcaacgccattggcgtaaccaagggccagttgtgtttccctgtctagtccttttgtcccgtggcaagttggctgcctgttggggaagtcagaggtggcgacttcaactccgtcggaggcaactcactttgttggagggatgtatagggtatggacaaacctctttgttccagaggcatatacaattttaagtcaatcccgtgccatcactatttttgcaatctcttatcaattgtactattgttttctgaatagttctctttaaattgacttacttaaaaagtttaaatgcattagtctcgacctaagcaatataaatgaaaccgtgggtttcatgggctacttataattgtttatgtaagttgaaataaaagcactagtcattaaaatgttcgttttcgtaccattaaaatcatcttgcataccgccagttgtaccctaggaacactttaggaaacaatatattaagctaagcagtgtattcaaagtaatttcatacttaaggtgcagtgttgtgtcattattttttcttggctggggaggtcaagctggcatcctggagcagcatgggaaccagacagattggggtgcaatggaaggttttagaaactcagtacgaatttactgatcatctattcctttactgtgtatccagaatttgtaccattacatcctgctgctgccttccatgagaagtgtattttttttttttttgatacggagttttgttcttgttgcccaggctggagtgcagtggcgtgatctcggctcactgcaacctccgcctcccgggttcaagcgattctcctgcctcagcctcctgagtagctggaattacaggcgcgtgccaccatgcccggctacttttgtatttttagtagagacggggttttaccatgttggtcaggctggtctcgaacttgtgacctcgttatccgcccacctcggcctcctaaagtgctgggattacaggcgtgagccaccgtgcccggccaggcaaattatatgtacaggcaattcataaaagtcatatggatgtccaatatatagaaagaagttgctgacaccaattattatcagtgcaaataaatagagtggggaagaattctttcacctatcagattggcg

SEQ ID NO: 93339 - DNA, 1070 bp, Homo sapiens
acccgtagtgcggggcggggcctcggggcccgtcggaaattgtagtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggtaagtgaggcttccctcccaagccgcctgccaagcgctacgcaggaggctgtgccagctttattccgccccagctcccatcccgtgtcggtttatttctcagtaaagccaggagattttacagaggtcttgcaaccctagggatatatgattctgtccctggaggagaaacgtcagcctctgtggatgtaagcttgcaacaggtagcttgtggaagttaggaagaactagggatttaaccatgtggaaatcttgtaagcatccaatagtatttgttcccctttggaattgttggggaagagcagtatcctatgtctgtgtctcaggcagtggggagggaaatgaccaaagaagaaaagctgcagcttcggaaggaaaagaaacagcagaagaagaaacggaaggaagaaaagggggcagaaccagagactggctctgctgtatctgcagccc

SEQ ID NO: 93340 - DNA, 1029 bp, Homo sapiens
aagggtacttcagtagagtttgcagcccccctaactccccacccccacccccagaatgaacattgcctcagggcacttctttcttgatttcccttcctttaaatctcactatattttcatttttttttttttaacctgtagttgtacggaagttgcaagagtttgagctgccttatgtgtctgtcaccagccttcggagtcaagagtataagattgtgctaaggaagaggtcagggctgggcctggaaggggaggggtgggaggtgctgtgctggattggattattgggccacatattgagacagaataatctggacaagggggtgtagtgctgggtgtttctgccaggcctcccaagcttcctcccactataccattagcccctgatagttccagattgctcctgttttgcccattttccattctacctcttgccttaacccagcttagccccattacccctttccaccccttggcctcacagttattgggactctgcctatgatgacgatgtcatggagaaccgggttggcctgaacctgctttatgctcaggtgagcttggagctgcctcagaacccttcccctgaagaaaataacgggtgactcactctcccaagaaaactgctgtcgtgtctttgttcccaatttgtggggaagttcctagaatactatcagtgctgctggcacaatatctactctccctacttttattaagctgacaagatcaaggacttactgcagagaggtcgctcaagtgtggggctaggggtcaggctggacagaggtaatggtagacgctttccttggattgctgactgggacctcctactgcctgccccttgtctctactatagacggtatcagatattgagcgtgggtggatcttggtcaccaaggaacagcaccggcaactcaaatctctgcaagagaaagtctccaagaaggaggtgagccctgcctcctctctgtcttcctctaagggcttgcagtggcgcgatcttggctcactgcaagctctgcctctcag

SEQ ID NO: 93341 - DNA, 1089 bp, Homo sapiens
aatctggcggcagtatcaggaaggtaggcagcaagtgtggactgagcagtgagcaggtgtgctccccttgccttttgtcctagatgtgaggcttgtcttgagagggaggggaagtgatcctgccctcaccggcaccttgtgtctgtccccagatgctgcgccggcgggtggggggtactctgagacgctcagacagccagcaagcagtgaagtccccaccactgcttgtaagtattacctcctggtcagaaccctggctctcagccctgcctcacctctcctagtgagtttctgacacctctgcctcttcttccccaggagtcacctgatgccacccgggagtctatggtcaaactctcagtgagttccagcgttggtgaggttgctgtttgttgggggatcttgcacgcccaagatctctgaccccaccctgcctttgttacagagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctacctctggttccctctcactgcccctgcttcccccatcacagcatggactactatgctaagggtaaggccaaattgcctgccattgccaattcagcatagacatggctttgttagtgtttcc

SEQ ID NO: 93342 - DNA, 1559 bp, Homo sapiens
ctctgtccatactcctctacgctgccttagtgagactggaagattctgactgttgttcttgaccccaggaatgtgatgagcagccaggaagttgtagatttcattcaatcaaagatcagccagcgtgatgaaaatggggagcttcggttattgtcatccattgtggaagaggtgagtaccagggtggagaagagagggtgtctggtctgcacagccagggttcactcttttaatctgagctaagtcggcaatctgggagcattatcagtaattgctgacagacgctaaaccccgactccaaagttccaccttctgtcatttccctgacttagccttatgccttatggactagcaggtgggccgttgtgtgatacctcttgcccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgccgcggccgcttcccacggactacgcgtcccgtgcgtctctgcggcggcggaagcggaagcgagtacggaggtaccagctggtctccgtagggg

SEQ ID NO: 93343 - DNA, 2488 bp, Homo sapiens
attgtatatacattatcttttgtcattgtgatggggtcttcctggttcctgctagtatttatgtgcttttttttcccctcaagactggagcagttattagccccaatagccaatcattaagcctaaatcctaattcacagtagcattgtgggcttcctggatcctcagccagaatagggtttttacaacttaacaataaaaaatgagacgtcagaggggaagtatagtaactagtgttgttttgattaagaaggggatgaaacacaaaaaccaaaagaagtctgtggaggaggaggagctagggcatgttcttctgagacttgagcgagaggaaccttgggagtgggaggttgtggggaagttagaggctgcaagggctgttgaggtagtgagagggacggatcccatgaggagtctggcatgggggctctgatttagcctcttccctgcagtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggtaagggcctgtgagggcaggcagatgctgaagttgcagagaggtcctgtttggttgccgtctgtagttttcaactctctttccttctcctattttgacatcatcccccaagacccactgtattctaagctttagtcttgaattcattgagctccatcatcacaggtaccatttgcctttttacctcttcctttgttggtactataacaagcagatctagttctggcttttcagagtctgtctcctagagagagaacaaggagatagttgttaccttggctagttgactgttttcttctctggaaaatttattttctggccacagtgcctgaaagatatttttggctggcagcccttgccttgtcctgggctttttgctagtgactgctaagcccagttcaggatgtcagttgtactcatgctagccctttccatccccccaattttcatgaccatatacttgtatctttcagtgttttgaggacctgtgttcagtcaggacctcttgattctgagtatgagctgtggggagggaggggatcatcccagtctcagcagtctgggatcctccccctggcaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggaggtgtgtggggaaggggagcaatgagtcttgaaaagccacaaggcaggtgtgaatcccctaattttgattttgagacaggggatccccctgatactttaggatggaagtaatagtcatggggatttattctgcaaggggaatgagatggtaagcctttggggttgaattatctaaaaacaagggagagggagtgtgctgctgtctctagaaagatgaaatgtgtgcttctcctgtttgttaaagctcttttgggggtcccagtgaaagcaagcataggtgaacgatcaggagcacatcagtgaggaacgcatgttcagaagcccccatgatgctccttttcttcctcttaagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggtaagggccaagaaactgggaaagacttctagggtctttctctctgtcccagactacctagtagcaaactttaatcttcctagtgcttgtgcctttcaaagcactttaatatctactacctctgttcttatatttctgtgaaataactaagatgggtagaggtatcattatacataggtatcattatacccatcttatgtaacatttgaatgatgaaaaagacctgtgagtgccgggcgtggtggctcacgcctgtaatcccagcactttgggaggctgaggctggtggatcgcctgaggtcaggagttcgag

SEQ ID NO: 93344 - DNA, 1911 bp, Homo sapiens
gcacatgcctgtaatctcagctattcagcaggcggaggcaggagaatcgcttgaacccacgaggcggaggttgcagtgagccaagatcgcgccactgcactccagcttgggtgacagggcgagactctgtctcaaaaaaaaaaagaagaaaaaatcctttattctggttttcccgtagcttccacagatccaaaagggtcaggtttatttccagtagccaaatattctgccatctggactgagatatctcctaggttgaggttattatagaggtagtaacctgattctttcttccttttctccttcccctttcctcctttgcctccctcctcttttcttcctctgtatttattttatcattccttcttcctttcttatttctaggccatataggccagccagggaaaggttagtaaggggtgacattgatccctatgacctgaggaatattcttcgaccttgagacatgccgattatgctcttcttttcctaggatgctcacaactgtattcctgagctggacagtgagacagccatgttttctgtctacgatggacatggaggtaactttaacagatcatattggtaacattctaggaccccaattccagacgttccagggcaagaacaggtccctttgttcatttactttccagggtctggccctcattatcatttcctgcgtggtgctgtttttctgtattctgtcattcttttttcccagtaggtactgtattggtttataatctcaccaggacttgttttaatccaaagagcctctatctttttttatttttattttttaaaatttttaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgggcaacagagcaagactcttgtcttaaaaaacaaaaaagtgtacccagttgagctgattctttatctttttttcactggagaactaagtatacaggtgagaaaagacgagatatttatacccgagagaattgatggtgaaatccatttttttggatcagaacttccccaaacagtgtccttcaaatagggttcaggggtgctaagatatttatcccctcaacccttggggttcactccagtatggcatataaatattgtatcactttctatgtgtggggagcagtgctccaggtgaccttccttcctttccttctaggggaggaagttgccttgtactgtgccaaatatcttcctgatatcatcaaagatcagaaggcctacaaggaaggcaagctacagaaggtctgtctgcttacaccgcccattcctcacttgtgtaggcttttcccttgttctctagcccttgggcttttcctttctttttgtcctctagctgctgctgcttatttactcttgaagaattctgttcctaaaacgagcttattggccgccttttagacttgccttattattcctaggcctctgagctgtttttatctgtgagtgtctcttagtgtggtggctcacactcttaatttgtattccatccttgtgctcaggattgtatatagggagttcattttgtactagtcttagactattttgcttatattcaggctttagaagatgccttcttggctattgacgccaaattgaccactgaagaagtcattaaagagctggcacagattgcagggcgacccactgaggatgaagatgaaaaagaaaaagtagctgatgaagatgatggtgagt

SEQ ID NO: 93345 - DNA, 1031 bp, Homo sapiens
ggccttttactaacttcggaaaacttgaattatgtcagtccctaggttttcctttttattatgcttcgttttctttctctcttaggatttctctaaaacttaatcagtaattctcatttgcctgtaattgtagtttatagtttctttgattgtaagtcatttcatcaatttttttcatcacaacctacctacaaagggcttttctagaaaattttactctggacaaaaggggaaaagaaaaatattggggggaaagtagtagtattaggtaaaacttgatgtgaaactacaaaagagaagagggaaaactgcggtagggaggaaagggaggaagacgggttaaccgtggctttgtgaagagcattctgaagtctaggcaaaagggccagggaaatactctgtctggtattgagggtttctccacctaccgggtgggcttcaggtaacagcgaaatactgtctcccttgggaattgtttcagatccctcgctcctccctgtggttagctctggaatgacagtatgaacttaaatgttttgttttccgattcaaattttatattcataactgaccttaataacaattttataattaggtataaaatttcaggattggagtgtatcctatagttcatctcatctgctttggctccctttttttttttttgagacagaatttcgctcttgttgcccaggctggaatgcaatggcgcgatctcggctcaccgcaacctccgcctcccaggttcgagcaattctcctgcctcagcctccctagtagttgggattacaggcatgtgccaccacgcctggcttattttgtatttttagtagagacagggtttcttcatgtgggtcaggctggtgttgaactcctgacttaggtgatctgcctgcctcggtctcccaaagtgctaggattacaggcatgaaccaccacaccctgcggctcccacattttatagctaagaaattgaggcccagaaaggttaggacactgttttggtggaaagaatttgtaggatcagatcg

SEQ ID NO: 93346 - DNA, 1624 bp, Homo sapiens
tccgcaaaccccgcccgatttggttcaattaaagttgaccagtatttgttccgagcttaggaagtacttggccaggccatgcgaggcctatatgagaagaatgtgagtcttttctgaaagcgaagacctcgatctgtgatataattcgagttaatacaatgtagaaatgtttggtacagcctattctgggtgggaaaagctcaaggatgggaggaggagctgtttcttggaggattgaaaggatgtaggctctcagagaggatgcctctggattgcattatgccacaggaaaagggaataatgttataaggtttggaggagtgagggaagaatgtgaactgcatttggggaggatttctgaggaagctggctggactcggagaatgattgtaagtggtaatattaactagctagcttgataaaaagaagcgccaagatgagtgacttggacttcattgtcgtcctggtgtaacctttggcatcgtttgtctagtctttgtatgcagtgtacattggagggagagagtctggggcactgttgtgttgttgttttttgtttgtttttgagacagagtctcgctctgtcgcccaggctacaagctccgcctcccgggttcacgccattctcctgcctcagcctcccgagtagctgggactacaggcgcccgccaccacgcctggctaattttttgtatttttagtagagacgaggtttcaccgtgttagccaggatggtctccatctcctgacctcgtgatccgcccgcctcggcctcccaaagtgttgggattacaggcgtgagccaccgcaccccgcctactattgttttttttttaagacagagtttcgctcttgttgcccaggctgcagtgcagtggcgctatcttggctcactgcaacctccgcctcccaggttcaagcgattctcctgcctcagcctcccgagtagctaggattccacgcctggctaatttttgtatttttagtagagacggggtttcaccatgttggccaggctggtctcgaactcctgacctcgtgatctacccgcctcagcctcccaaagtgctgggattacaggcgtgagccaccgcgcctggcctggggcactgctactagttagagagctcttactctaagcaggagatgagaagagctgggagtaaggtggtaccacgcagggtggcaatgggaatccagatgaaaggacaaattagacaataacaaataagacagatttggtaataaattgcattcaagggatggagagaaaaggagaaattctccaaactatgacaaaattgattcttttcagccgggcacagtggctcacacttgtaatcccagcactttgggaggccaagggggggtggtggatcacttgaggccagaagttcgagaccagcctggccaacatgtgaaacccgtctctactaaaaatacaaaaattagccaggcgtagtggtgcgctcctgtaatcccagctacttgggaggctaaggcaggcgaatagcttgaaccccagaggcggaggttgcagtgaaccaagatggcgccactgcactccaccctgggtgacagagcaactccgtctcaaaaaaaaaaaaaagattctttaaaaaga
